(12) United States Patent
Meissner et al.

(10) Patent No.: US 12,031,154 B2
(45) Date of Patent: *Jul. 9, 2024

(54) UNIVERSAL DONOR STEM CELLS AND RELATED METHODS

(71) Applicant: President and Fellows of Harvard College, Cambridge, MA (US)

(72) Inventors: Torsten B. Meissner, Cambridge, MA (US); Leonardo M. R. Ferreira, Cambridge, MA (US); Jack L. Strominger, Cambridge, MA (US); Chad A Cowan, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/993,674

(22) Filed: Nov. 23, 2022

(65) Prior Publication Data

US 2023/0303968 A1    Sep. 28, 2023

Related U.S. Application Data

(60) Continuation of application No. 17/148,556, filed on Jan. 13, 2021, now Pat. No. 11,618,881, which is a division of application No. 15/572,776, filed as application No. PCT/US2016/031551 on May 9, 2016, now Pat. No. 10,968,426.

(60) Provisional application No. 62/158,999, filed on May 8, 2015.

(51) Int. Cl.
| | | |
|---|---|---|
| *C12N 5/0735* | (2010.01) | |
| *A61K 39/00* | (2006.01) | |
| *C12N 5/074* | (2010.01) | |
| *C12N 15/86* | (2006.01) | |
| *C12N 15/90* | (2006.01) | |

(52) U.S. Cl.
CPC .......... *C12N 5/0606* (2013.01); *A61K 39/001* (2013.01); *C12N 5/0696* (2013.01); *C12N 15/86* (2013.01); *C12N 15/907* (2013.01); *C12N 2310/20* (2017.05); *C12N 2501/50* (2013.01); *C12N 2501/599* (2013.01); *C12N 2501/998* (2013.01); *C12N 2510/00* (2013.01)

(58) Field of Classification Search
CPC .................................................. C12N 5/0606
See application file for complete search history.

(56) References Cited

U.S. PATENT DOCUMENTS

| | | |
|---|---|---|
| 5,272,082 A | 12/1993 | Santoli et al. |
| 6,986,887 B2 | 1/2006 | Lawman et al. |
| 7,951,925 B2 | 5/2011 | Ando et al. |
| 8,013,143 B2 | 9/2011 | Mcswiggen et al. |
| 8,105,831 B2 | 1/2012 | Russell et al. |
| 8,420,395 B2 | 4/2013 | Calos |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 9,181,527 B2 | 11/2015 | Sentman |
| 9,273,283 B2 | 3/2016 | Sentman |
| 9,597,357 B2 | 3/2017 | Gregory et al. |
| 9,738,908 B2 | 8/2017 | Wu et al. |
| 9,822,370 B2 | 11/2017 | Musunuru et al. |
| 9,885,033 B2 | 2/2018 | Joung et al. |
| 10,208,319 B2 | 2/2019 | Musunuru et al. |
| 10,968,426 B2 | 4/2021 | Meissner et al. |
| 11,203,758 B2 | 12/2021 | Zhao et al. |
| 11,208,661 B2 | 12/2021 | Zhao et al. |
| 2002/0012660 A1 | 1/2002 | Colman et al. |
| 2002/0106742 A1 | 8/2002 | Samson et al. |
| 2002/0188963 A1 | 12/2002 | Loring |

(Continued)

FOREIGN PATENT DOCUMENTS

| | | |
|---|---|---|
| JP | 2016/520308 A | 7/2016 |
| WO | WO-2001/073002 A2 | 10/2001 |

(Continued)

OTHER PUBLICATIONS

Canver, et al. "Characterization of Genomic Deletion Efficiency Mediated by Clustered Regularly Interspaced Palindromic Repeats (CRISPR)/Cas9 Nuclease System in Mammalian Cells," Journal of Biological Chemistry, 289(31):21312-21324, (Aug. 2014).

(Continued)

*Primary Examiner* — Anoop K Singh
*Assistant Examiner* — David A Montanari
(74) *Attorney, Agent, or Firm* — Morse, Barnes-Brown & Pendleton, P.C.; Lisa M. Warren, Esq.; Erin E. Bryan, Esq.

(57) ABSTRACT

Disclosed herein are universal donor stem cells and related methods of their use and production. The universal donor stem cells disclosed herein are useful for overcoming the immune rejection in cell-based transplantation therapies. In certain embodiments, the universal donor stem cells disclosed herein do not express one or more MHC-I and MHC-II human leukocyte antigens. Similarly, in certain embodiments, the universal donor stem cells disclosed herein do not express one or more human leukocyte antigens (e.g., HLA-A, HLA-B and/or HLA-C) corresponding to MHC-I and MHC-II human leukocyte antigens, thereby rendering such cells hypoimmunogenic.

32 Claims, 134 Drawing Sheets

Specification includes a Sequence Listing.

(56) References Cited

U.S. PATENT DOCUMENTS

| | | |
|---|---|---|
| 2006/0024819 A1 | 2/2006 | Finney |
| 2007/0283452 A1 | 12/2007 | Liu et al. |
| 2008/0182328 A1 | 7/2008 | Snyder et al. |
| 2008/0188000 A1 | 8/2008 | Reik et al. |
| 2010/0062003 A1 | 3/2010 | Murphy et al. |
| 2010/0076057 A1 | 3/2010 | Sontheimer et al. |
| 2010/0093617 A1 | 4/2010 | Barrangou et al. |
| 2010/0227805 A1 | 9/2010 | Karin et al. |
| 2011/0110897 A1 | 5/2011 | Schwarz et al. |
| 2011/0262406 A1 | 10/2011 | Del Campo et al. |
| 2011/0300538 A1 | 12/2011 | Barrangou et al. |
| 2012/0088676 A1 | 4/2012 | Weill et al. |
| 2012/0142062 A1 | 6/2012 | Doyon et al. |
| 2012/0192298 A1 | 7/2012 | Weinstein et al. |
| 2012/0225927 A1 | 9/2012 | Sah et al. |
| 2012/0251618 A1 | 10/2012 | Schrum et al. |
| 2012/0321667 A1 | 12/2012 | Sentman |
| 2013/0122591 A1 | 5/2013 | Cost et al. |
| 2013/0156849 A1 | 6/2013 | de Fougerolles et al. |
| 2013/0177577 A1 | 7/2013 | Kobayashi et al. |
| 2013/0288251 A1 | 10/2013 | Horvath et al. |
| 2013/0330778 A1 | 12/2013 | Zainer et al. |
| 2014/0030240 A1 | 1/2014 | Gregory et al. |
| 2014/0065667 A1 | 3/2014 | Guschin et al. |
| 2014/0080216 A1 | 3/2014 | Cost et al. |
| 2014/0093913 A1 | 4/2014 | Cost et al. |
| 2014/0106449 A1 | 4/2014 | June et al. |
| 2014/0120622 A1 | 5/2014 | Gregory et al. |
| 2014/0134143 A1 | 5/2014 | Baylink et al. |
| 2014/0134195 A1 | 5/2014 | Russell |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang et al. |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273230 A1 | 9/2014 | Chen et al. |
| 2014/0273231 A1 | 9/2014 | Zhang |
| 2014/0273232 A1 | 9/2014 | Zhang et al. |
| 2014/0273233 A1 | 9/2014 | Chen et al. |
| 2014/0273234 A1 | 9/2014 | Zhang et al. |
| 2014/0287938 A1 | 9/2014 | Zhang et al. |
| 2014/0295556 A1 | 10/2014 | Joung et al. |
| 2014/0295557 A1 | 10/2014 | Joung et al. |
| 2014/0301990 A1 | 10/2014 | Gregory et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0335620 A1 | 11/2014 | Zhang et al. |
| 2014/0336133 A1 | 11/2014 | Miller et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349405 A1 | 11/2014 | Sontheimer et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357530 A1 | 12/2014 | Zhang et al. |
| 2014/0377868 A1 | 12/2014 | Joung et al. |
| 2015/0017136 A1 | 1/2015 | Galetto et al. |
| 2015/0020223 A1 | 1/2015 | Zhang et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044191 A1 | 2/2015 | Liu et al. |
| 2015/0044192 A1 | 2/2015 | Liu et al. |
| 2015/0056225 A1 | 2/2015 | Russell |
| 2015/0056705 A1 | 2/2015 | Conway et al. |
| 2015/0071889 A1 | 3/2015 | Musunuru et al. |
| 2015/0110760 A1 | 4/2015 | Zhang et al. |
| 2015/0110762 A1 | 4/2015 | Holmes et al. |
| 2015/0139994 A1 | 5/2015 | Xu |
| 2015/0152436 A1 | 6/2015 | Musunuru et al. |
| 2015/0166969 A1 | 6/2015 | Takeuchi et al. |
| 2015/0176013 A1 | 6/2015 | Musunuru et al. |
| 2015/0283178 A1 | 10/2015 | June et al. |
| 2015/0344912 A1 | 12/2015 | Kim et al. |
| 2016/0009813 A1 | 1/2016 | Themeli et al. |
| 2016/0024524 A1 | 1/2016 | Joung et al. |
| 2016/0046724 A1 | 2/2016 | Brogdon et al. |
| 2016/0143953 A1 | 5/2016 | Gregory et al. |
| 2016/0168594 A1 | 6/2016 | Zhang et al. |
| 2016/0185861 A1 | 6/2016 | Bedoya et al. |
| 2016/0311907 A1 | 10/2016 | Brogdon et al. |
| 2016/0348073 A1 | 12/2016 | Meissner et al. |
| 2016/0362472 A1 | 12/2016 | Bitter et al. |
| 2017/0175128 A1 | 6/2017 | Welstead et al. |
| 2018/0141992 A1 | 5/2018 | Cowan et al. |
| 2018/0155717 A1 | 6/2018 | Valamehr et al. |
| 2018/0249688 A1 | 9/2018 | Ayares et al. |
| 2018/0362975 A1 | 12/2018 | Chen et al. |
| 2019/0015487 A1 | 1/2019 | Bhoumik et al. |
| 2019/0032049 A1 | 1/2019 | Naldini et al. |
| 2019/0262309 A1 | 8/2019 | Alici et al. |
| 2019/0376045 A1 | 12/2019 | Schrepfer et al. |
| 2021/0161971 A1 | 6/2021 | Nagy et al. |
| 2021/0261916 A1 | 8/2021 | Meissner et al. |
| 2022/0333119 A1 | 10/2022 | Musunuru et al. |
| 2023/0303969 A1 | 9/2023 | Meissner et al. |
| 2023/0323288 A1 | 10/2023 | Meissner et al. |

FOREIGN PATENT DOCUMENTS

| | | |
|---|---|---|
| WO | 2005/113805 A2 | 12/2005 |
| WO | WO-2008/052770 A2 | 5/2008 |
| WO | WO-2008/102274 A2 | 8/2008 |
| WO | WO-2009/019528 A1 | 2/2009 |
| WO | WO-2010/015899 A2 | 2/2010 |
| WO | WO-2010/143917 A2 | 12/2010 |
| WO | 2012/145384 A1 | 10/2012 |
| WO | WO-2013/016446 A2 | 1/2013 |
| WO | WO-2013/126794 A2 | 8/2013 |
| WO | 2013/158292 A1 | 10/2013 |
| WO | 2013/176915 A1 | 11/2013 |
| WO | 2013/176916 A1 | 11/2013 |
| WO | WO-2014/065596 A1 | 5/2014 |
| WO | WO-2014/093622 A2 | 6/2014 |
| WO | 2014/153470 A2 | 9/2014 |
| WO | WO-2014/150624 A1 | 9/2014 |
| WO | WO-2014/151994 A1 | 9/2014 |
| WO | WO-2014/153115 A2 | 9/2014 |
| WO | 2014/165825 A2 | 10/2014 |
| WO | 2014/184741 A1 | 11/2014 |
| WO | 2014/184744 A1 | 11/2014 |
| WO | 2014/191128 A1 | 12/2014 |
| WO | WO-2014/204726 A1 | 12/2014 |
| WO | 2015/006498 A2 | 1/2015 |
| WO | 2015/057976 A1 | 4/2015 |
| WO | WO-2015/113063 A1 | 7/2015 |
| WO | 2016/057821 A2 | 4/2016 |
| WO | 2016/057835 A2 | 4/2016 |
| WO | 2016/063264 A1 | 4/2016 |
| WO | 2016/073955 A2 | 5/2016 |
| WO | 2016/112779 A1 | 7/2016 |
| WO | 2016/160721 A1 | 10/2016 |
| WO | 2016/183041 A2 | 11/2016 |
| WO | 2017/079673 A1 | 5/2017 |
| WO | 2018/132783 A1 | 7/2018 |

OTHER PUBLICATIONS

Chrstianson, et al., "Enhanced Human CD4+ T Cell Engraftment in Beta2-Microglobulin-Deficient NOD-Scid Mice," Journal of Immunology, 158:3578-3586, (1997).

(56) References Cited

OTHER PUBLICATIONS

Cowan, Chad A. Abstract "Isogenic Human Pluripotent Stem Cell-Based Models of Human Disease Mutations." National Institutes of Health Grant No. DK097768 (Funding Start Date Sep. 25, 2012).
DiTomaso, et al., "Immunobiological Characterization of Cancer Stem Cells Isolated from Glioblastoma Patients," Human Cancer Biology, 16(3):800-831, (Jan. 26, 2010).
Final Office Action for U.S. Appl. No. 15/083,021, dated Jan. 10, 2019.
Final Office Action for U.S. Appl. No. 15/083,021, dated Mar. 4, 2021.
Final Office Action for U.S. Appl. No. 16/908,618, dated Sep. 7, 2022.
Gussow, et al., "The Human Beta w-Microglobulin Gene. Primary Structure and Definition of the Transcriptional Unit," Journal of Immunology, 139(9):3132-3138, (Nov. 1, 2987).
Harrer, et al., "Generation of Stem Cell-Derived Hypoimmunnogenic b Cells That Circumvent Immune Detection," Master's Thesis. Degree Program Tissue Engineeing and Regenerative Medicine University of Applied Sciences, Vienna. Sep. 2018. Retrieved from the internet <URL: https://static1.squarespace.com/static/559921a3e4b02c1d7480f8f4/t/5c790ded24a69426265feb35/1551437298166/Harrer+Jacqueline_852 _. pdf>.
Hu, et al., "Generation of HypoImmunogenic Induced Pluripotent Stem Cells for Allogeneic Cell and Tissue Transplantation," Transplantation, 101(5S-3: p. S2, (May 2017).
International Search Report for PCT/US2016/024554, dated Aug. 25, 2016.
International Search Report from PCT/US2016/031551, dated Nov. 30, 2016.
International Search Report from PCT/US2020/018467, dated Sep. 17, 2020.
Jaiswal, et al., "CD47 is Upregulated on Circulating Hematopoietic Stem Cells and Leukemia Cells to Avoid Phagocytosis," Cell, 138:271-285, (Jul. 24, 2009).
Koller, et al., "Normal Development of Mice Deficient in β2M, MHC Class I Proteins, and CD8+ T Cells," Science, 248:1227-1230, Jun. 8, 1990).
Lloyd, et al., "Beyond the Antigen Receptor Editing the Genome of T-Cells for Cancer Adoptive Cellular Therapies," Frontiers in Immunology, 4(22):1-7, (Aug. 2013).
Intentionally Left Blank.
Lu, et al., "Generating Hypoimmunogenic Human Embryonic Stem Cells by the Disruption of Beta 2-Microglobulin," Stem Cell Rev., 9(6):806-813, (Aug. 10, 2013).
Ma, et al., "Heritable Multiplex Genetic Engineering in Rats Using CRISPR/Cas9," PLoS One, 9(3):e89413:pp. 1-8, (2014).
Mandal, et al., "Efficient Ablation of Genes in Human Hematopoietic Stem and Effector Cells Using CRISPR/Cas9," Cell Stem Cell, 15(5):643-652, (Nov. 6, 2014).
Mattapally, et al., "Human Leukocyte Antigen Class I and II Knockout Human Induced Pluripotent Stem Cell-Derived Cells: Universal Donor for Cell Therapy," Journal of American Heart Association, 2018(7):1-13, (Nov. 29, 2018).
Meissner, et al., "Genome Editing for Human Gene Therapy," Methods in Enzymology, 546:273-295, (2014).
Meissner, et al., "The Universal Donor Stem Cell: Removing the Immune Barrier to Transplantation Using CRISPR/Cas9 (TRAN1P.946)," The Journal of Immunology, pp. 1-5, (Dec. 10, 2021).
NCBI Accession No. NG_012920.1, pp. 1-6 (2013).
Non-Final Office Action for U.S. Appl. No. 15/083,021, dated Apr. 2, 2018.
Non-Final Office Action for U.S. Appl. No. 15/083,021, dated Jun. 2, 2020.
Non-Final Office Action for U.S. Appl. No. 15/572,776, dated Apr. 1, 2020.
Non-Final Office Action for U.S. Appl. No. 16/908,618, dated Dec. 17, 2021.
Non-Final Office Action for U.S. Appl. No. 17/148,556, dated Jan. 21, 2022.
Non-Final Office Action for U.S. Appl. No. 17/148,556, dated May 31, 2022.
Non-Final Office Action for U.S. Appl. No. 17/497,927, dated Feb. 17, 2022.
Non-Final Office Action for U.S. Appl. No. 17/525,644, dated Nov. 25, 2022.
Notice of Allowance for U.S. Appl. No. 15/572,776, dated Sep. 16, 2020.
Notice of Allowance for U.S. Appl. No. 17/148,556, dated Oct. 27, 2022.
Notice of Allowance for U.S. Appl. No. 17/497,927, dated Jun. 23, 2022.
Rebmann, et al., "HLA-G as a Tolerogenic Molecule in Transplantation and Pregnancy," Journal of Immunology Research, 2014:1-16, (2014).
Riolobos, et al., "HLA Engineering of Human Pluripotent Stem Cells," Molecular Therapy, 21(6):1232-1241, (Jun. 2013).
Romieu-Mourez, et al., "Regulation of MHC Class II Expressiona nd Antigen Processing in Murine and Human Mesenchymal Stromal Cells by IFN-gamma, TGF-beta, and Cell Density," The Journal of Immunology, 179:1549-1558, (2007).
Rong, et al., "An Effective Approach to Prevent Immune Rejection of Human ESC-Derived Allograts," Cell Stem Cell, 14(1):121-130, (Jan. 2, 2014).
Sadelain, et al., "Safe Harbours for the Integration of new DNA in the Human Genome," Nature Reviews Cancer, 12:51-58, (2012).
Tena, et al., "Transgenic Expression of Human CD47 Markedly Increases Engraftment in a Murine Model of Pig-to-Human Hematopoietic Cell Transplantation," American Journal of Transplantation, 14:2713-2722, (2014).
Timmermans, et al. "Generation of T Cells from Human Embryonic Stem Cell-Derived Hematopoietic Zones," J. Immunology, 182:6879-6888, (2009).
Toriaki, et al., "A Foundation for Universal T-Cell Based Immunotherapy: T Cells Engineered to Express a CD19-Specific Chimeric-Antigen-Receptor and Eliminate Expression of Endogenous TCR," Blood, 119(24):5697-5705, (Jun. 14, 2012).
Van den Berg, et al., "Innate Immune "Self" Recognition: A Role for CD47-SIRPalpha Interactions in Hematopoietic Stem Cell Transplantation," Trends in Immunology, 29(5):203-206, (Apr. 3, 2008).
Desphande, et al., "Clustered Regularly Interspaced Short Palindromic Repeats/Cas9 Genetic Engineering: A Novel Therapeutic Approach in Colon Carcinomas," American Journal of Robotic Surgery, 1:1-4, (2014).
Han, et al., "Generation of Hypoimmunogenic Human Pluripotent Stem Cells," Proceedings of the National Academy of Sciences, 116(21):10441-10446, (2019).
Non-Final Office Action for U.S. Appl. No. 17/525,644, dated Apr. 3, 2023.
Chiba et al., "Genome Editing in Human Pluripotent Stem Cells Using Site-Specific Nucleases," *Methods in Molecular Biology*, 1239:267-280, (2015).
Cho, et al., "Analysis of off-target effects of CRISPR/Cas-derived RNA-guided endonucleases and nickases," Genome Research (24): 132-141 (2014).
Cho, et al., "Targeted Genome Engineering in Human Cells with RNA-Guided Endonucleases," *Supplementary Information, Nature Biotechnology*, pp. 1-11, (2013).
Christian, et al., "Treating DNA Double-Strand Breaks with TAL Effector Nucleases," Genetics 757-761 (2010).
Christianson, et al., "Enhanced human CD4+ T cell engraftment in beta2-microglobulin-deficient NOD-scid mice." Journal of Immunology (Baltimore, Md.: 1950) 158.8 (1997): 3578-3586.
Cong, et al., "Multiplex Genome Engineering Using CRISPR/Cas Systems," Science 339: 819-823 (2013).
Cowan, "Human Cell-Based Models of Primary Adipocyte Disorders," National Institutes of Health Grant No. DK095384 (Funding Start Date Apr. 1, 2012), Abstract.
Cowan, "Integrating Lipid Genotypes and Phenotypes in IPS Derived Hepatocytes/Adipocytes," National Institutes of Health Grant No. HL107440 (Funding Start Date Jul. 5, 2011), Abstract.

(56) References Cited

OTHER PUBLICATIONS

Cradick, et al., "CRISPR/Cas9 Systems Targeting B-Globin and CCR5 Genes Have Substantial Off-Target Activity," *Nucleic Acids Research*, pp. 1-9, (2013).
Ding, et al., "A TALEN genome editing system to generate human stem cell-based disease models," Cell Stem Cell 12(2): 238-251 (2013).
Ding, et al., "Enhanced Efficiency of Human Pluripotent Stem Cell Genome Editing through Replacing TALENs with CRISPRs," Cell Stem Cell 12: 393-394; plus supplemental materials (2013) (published online on Apr. 4, 2013).
Doudna et al., "The new frontier of genome engineering with CRISPR-Cas9," *Science*, 346(6213):1077, 1258096-1 through 1258096-9, (2014).
Edelstein, et al., "Gene Therapy Clinical Trials Worldwide 1989-2004—An Overview," *The Journal of Gene Medicine*, 6:597-602, (2004).
Extended European Search Report from European Application 14779492.9, dated Nov. 29, 2016.
Extended European Search Report from European Application 14822545.1, dated Oct. 24, 2016.
Final Office Action for U.S. Appl. No. 14/485,288, dated Apr. 26, 2017.
Final Office Action for U.S. Appl. No. 14/485,288, dated Aug. 24, 2015.
Final Office Action for U.S. Appl. No. 14/509,924, dated Feb. 14, 2017.
Final Office Action for U.S. Appl. No. 14/809,787 dated Dec. 2, 2016.
Gaj, et al., "ZFN, TALEN, and CRISPR/Cas-Based Methods for Genome Engineering," *Trends in Biotechnology*, 31(7):397-405, (2013).
GenBank M13792.1 Human Adenosine Deaminase (ADA) Gene, Complete cds [online] Oct. 4, 1995 [retrieved Oct. 25, 2014]. Available on the internet: <URL:; http://www.ncbi.nlm.nih.gov/nuccore/M13792>. Especially p. 17 n\35125-35147 and nt 35090-35112.
GenBank: AY136510.1, Kutlar, et al., "A New Hemoglobin, Beta Chain Variant 'Hb S-Wake' Confirmed to be on the Same Chromosome With Hemoglobin S Mutation, Detected in an African-American Family," Retrieved from the internet on Dec. 23, 2015 < http://www.ncbi.nlm.nih.govlnucleotide/23268448?report=genbanl<&log$=nuclalign&blast_rank=2&RID=7NNHZVRH014>.
GenBank: EF150856.1, Kutlar, et al., "*Homo sapiens* beta-globin (HBB) gene, HBB-Hb sickle- Monroe allele, exons 1, 2 and partial cds," Retrieved from the internet on Feb. 22, 2016.http://www.ncbi.nlm.nih.gov/nuccore/EF150856>.
Geurts, et al., "Knockout Rats via Embryo Microinjection of Zinc-Finger Nucleases," Science 325:433 (2009).
Gonzalez et al., "An iCRISPR Platform for Rapid, Multiplexable, and Inducible Genome Editing in Human Pluripotent Stem Cells," *Cell Stem Cell*, 15:215-226, (2014).
Hendel, et al., "Quantifying Genome-Editing Outcomes at Endogenous Loci with SMRT Sequencing," Cell Reports 7: 293-305 (2014).
High, et al., "DNA-Cleaving Enzymes Trigger a Repair Process That Can Now be Harnessed to Correct Mutations in the Human Genome in vitro. This Represents Another Step Towards Gene-Correction Strategies for Treating Human Disease," *Nature*, 435:577 & 579, (2005).
Holt, et al., "Human Hematopietic Stem/Progenitor Cells Modified by Zinc-Finger Nucleases Targeted to CCRG Control HIV-1 in vivo," *Nature Biotechnology*, 28.8:839-847, (2010).
Hruscha, et al., "Efficient CRISPR/Cas9 genome editing with low off-target effects in zebrafish," Development (140):4982-4987 (2013).
Hsu, et al., "DNA targeting specificity of RNA-guided Cas9 nucleases." Nature biotechnology 31.9 (2013): 827-832.
Hwang, et al., "Efficient Genome Editing in Zebrafish Using a CRISPR-Cas System," *Nature Biotechnology*, 31(3):227-229, (Mar. 2013).

International Preliminary Report on Patentability for International Application PCT/US2014/46034, mailed Jan. 21, 2016.
International Search Report for International Application PCT/US2014/033082, dated Nov. 4, 2014.
International Search Report for International Application PCT/US2015/054762, dated Mar. 11, 2016.
International Search Report for PCT/US15/59621, dated Jun. 3, 2016.
Jiang, et al., "RNA-Guided Editing of Bacterial Genomes Using CRISPR-Cas Systems," *Nature Biotechnology*, 31(3):233-239, (Mar. 2013).
Jinek, et al., "A programmable Dual-RNA-Guided DNA Endonuclease in Adaptive Bacterial Immunity," Science 337: 816-821 (2012).
Johnson-Salbia, et al., "Gene Therapy: Optimising DNA Delivery to the Nucleus," Current Drug Targets 2: 371-399 (2001).
Jun et al., "CRISPR/Cas: a novel way of RNA-guided genome editing," *Hereditas*, 35(11):1265-1273, (2013), English Abstract.
Kariko et al., "Incorporation of Pseudouridine Into mRNA Yields Superior Nonimmunogenic Vector With Increased Translational Capacity and Biological Stability," *Molecular Therapy*, 16(11): 1833-1840, (2008).
Khalili et al., "Genome editing strategies: potential tools for eradicating HIV-1/AIDS," *J. Neurovirol*, 21(3):310-321, (2015).
Lagresle-Peyrou, et al., "Human adenyiate kinase 2 deficiency causes a profound haematopoietic defect associated with sensorineural deafness," Nat Genet 41(1): 106-111 (2009).
Late Breaking Abstracts: Presented at the American Society of Gene & Cell Therapy's 16th Annual Meeting, May 15-18, 2013, Salt Lake City, Utah (56 pages).
Li, et al., "In vivo genome editing restores haemostasis in a mouse model of haemophilia," Nature 475: 217-221 (2011).
Lin, et al., "CRISPR/Cas9 systems have off-target activity with insertions or Deletions Between Target DNA and Guide RNA Sequences," *Nucleic Acids Research*, pp. 1-13, (2014).
Lloyd et al., "Beyond the antigen receptor: editing the genome of T-Cells for cancer adoptive cellular therapies," *Frontiers in Immunology*, 4(221):1-7, (2013).
Luo, et al., "Synthetic DNA delivery systems," Nature Biotechnology 18: 33-37 (2000).
Mali, et al., "RNA-Guided Human Genome Engineering via Cas9," *Science*, 339: 823-826 (2013).
Mandal, et al., "Efficient Ablation of Genes in Human Hematopoietic Stem and Effector Cells using CRISPR/Cas9," *Cell Stem Cell*, 15:643-652, (Nov. 6, 2014).
Mandal, et al., "Reprogramming Human Fibroblasts to Pluripotency Using Modified mRNA," *Nature Protocols*, 8(3):568-582, (2013).
Meissner, et al., "Genome Editing for Human Gene Therapy," *Methods of Enzymology*, 546:273- 295, (2014).
Musunuru, "Genetic and Functional Analysis of a Novel Locus Associated with LDL-C and MI," National Institutes of Health Grant No. HL098364, (Funding Start Date May 3, 2010), Abstract.
Musunuru, "Stem Cell Models of Familial Combined Hypolipidemia," National Institutes of Health Grant No. HL118744 (Funding Start Date Feb. 1, 2013), Abstract.
NCBI Accession No. NG012920.1, "*Homo sapiens* Beta-2-microglobulin (B2M), RefSeqGene on Chromosome 15." NCBI, Jul. 8, 2013. Accessed Apr. 24, 2019 (6 pages).
Non-Final Office Action for U.S. Appl. No. 14/485,288, dated Mar. 26, 2015.
Non-Final Office Action for U.S. Appl. No. 14/485,288, dated Sep. 6, 2016.
Non-Final Office Action for U.S. Appl. No. 14/509,787, dated Apr. 11, 2016.
Non-Final Office Action U.S. Appl. No. 15/524,968, dated Apr. 5, 2023.
Notice of Allowance for U.S. Appl. No. 14/485,288, dated Jul. 14, 2017.
Pelletier et al., "Mouse Genome Engineering via CRISPR-Cas9 for Study of Immune Function," *Cell Press*, 42:18-27, (2015).
Pfeifer, et al., "Gene Therapy: Promises and Problems," Annu. Rev. Genomics Hum. Genet. 2: 177-211 (2001).
Porteus, et al., "Gene targeting using zinc finger nucleases," Nature Biotechnology 23(8): 967-973 (2005).

(56) References Cited

OTHER PUBLICATIONS

Ramalingam, et al., "A Crispr Way to Engineer the Human Genome," *Genome Biology*, 14(107):1-4, (2013).
Ramirez, et al., "Unexpected failure rates for modular assembly of engineered zinc fingers," Nature Methods 5(5): 374-375 (2008).
Ran, et al., "Double Nicking by RNA-Guided CRISPR Cas9 for Enhanced Genome Editing Specificity," Cell 154: 1380-1389 (2013).
Randau, "RNA processing in the minimal organism Nanoarchaeum equitans," Genome Biol 13.7 : 6 (2012).
Ren, et al., "Multiplex Genome Editing to Generate Universal Car T Cells Resistant to PD1 Inhibition," *Clin. Cancer Res.*, 23(9):2255-2266, (May 1, 2017).
Rieder, et al., *Homo sapiens* Interleukin 2 Receptor, Gamma (Severe Combined Immunodeficiency) (IL2RG) Gene, Complete cds: Genbank: AY692262.1. Jul. 21, 2004 [Retrieved on Mar. 3, 2016]. Retrieved from the Internet: <URL: http://www.ncbi.nlm.nih.gov/nucleotide/50897 469>; pp. 1-4.
Riolobis, et al., "HLA Engineering of Human Pluripotent Stem Cells," *The American Society of Gene & Cell Therapy*, 21(6):1232-1241, (Jun. 2013).
Schwank, et al., "Functional Repair of CFTR by CRISPR/Cas9 in Intestinal Stem Cell Organoids of Cystic Fibrosis Patients," Cell Stem Cell 13: 653-658 (2013).
Sequence alignment between NCBI accession No. NG-012920.2 and Seq ID No. 1, pp. 1-3. (Year: 2018). Retrieved Mar. 31, 2023, from GenCore version 6.4.2. (5 pages).
Shalem, et al., "Genome-scale CRISPR-Cas9 knockout screening in human cells," *Science* 343, 84-87 (2014).
Shen, et al., "Generation of Gene-Modified Mice via Cas9/RNA-Mediated Gene Targeting," *Cell Research*, 23:720-723, (2013).
Shoji, et al., "Current Status of Delivery Systems to Improve Target Efficacy of Oligonucleotides," Current Pharmaceutical Design 10: 785-796 (2004).
Smithies, et al., "Insertion of DNA Sequences Into the Human Chromosomal β-Globin Locus by Homologous Recombination," *Nature*, 317(19):230-234, (Sep. 1985).
Talkowski, et al., "Next-Generation Sequencing Strategies Enable Routine Detection of Balanced Chromosome Rearrangements for Clinical Diagnostics and Genetic Research," The American Journal of Human Genetics (88): 469-481 (2011).
Tasher, et al., "The Genetic Basis of Severe Combined Immunodeficiency and its Variants," The Application of Clinical Genetics 5: 67-80 (2012).
Tebas, et al., "Gene Editing of CCR5 in Autologous CD4 T Cells of Persons Infected with HIV," *The New England Journal of Medicine*, 370(10):901-910, (Mar. 6, 2014).
Third Party Submission Under 37 CFR 1.290 for U.S. Appl. No. 14/485,288, made/submitted Jul. 14, 2015.
Wang et al., "One-Step Generation of Mice Carrying Mutations in Multiple Genes by CRISPR/Cas-Mediated Genome Engineering," *Cell*, 153:910-918, (2013).
Wang, et al., "Genetic screens in human cells using the CRISPR-Cas9 system," *Science* 343, 80- 84 (2014).
Wiginton, et al., "Complete Sequence and Structure of the Gene for Human Adenosine Deaminase," Biochemistry 25(25): 8234-8244. Abstract (1986).
Wilen, et al., "Engineering HIV-Resistant Human CD4+ T Cells With CXCR4-Specific Zinc-Finger Nucleases," *PLoS Pathogens*, 7(4):1-15, (Apr. 2011).
Woodbine, et al., PRKDC Mutations in a SCID Patient with Profound Neurological Abnormalities. The Journal of Clinical Investigation 123(7): 2969-2980. (2013).
Wu et al., "Target specificity of the CRISPR-Cas9 system," *Quantitative Biology*, 2(2):59-70, (2014).
Xie et al., "Seamless gene correction of β-thalassemia mutations in patient-specific iPSCs using CRISPR/Cas9 and piggyBac," *Genome Research*, 24:1526-1533, (2014).
Zetsche, et al., "Cpf1 is a single RNA-guided endonuclease of a class 2 CRISPR-Cas system." Cell 163.3 (2015): 759-771.

Zhang et al., "CRISPR/Cas9 for Genome Editing: Progress, Implications and Challenges," *HMG Advance Acess*, Published Mar. 20, 2014 pp. 1-21.
Final Office Action for U.S. Appl. No. 17/525,644, dated Sep. 9, 2023.
Non-Final Office Action for U.S. Appl. No. 17/993,667, dated Nov. 24, 2023.
Non-Final Office Action for U.S. Appl. No. 17/993,680, dated Nov. 24, 2023.
Final Office Action for U.S. Appl. No. 15/524,968, dated Oct. 19, 2023.
"Breeding Genetically Modified Animals for Food Production - Symposium Summary" Swedish University of Agriculture Sciences, pp. 1-3, (2014).
Alignment—16278645 SEQ 815 vs. Kmiec Seq ID No. 473 (2021).
Brandl, et al., "Creation of Targeted Genomic Deletions Using TALEN or CRISPR/Cas Nuclease Pairs in One-Cell Mouse Embryos," *FEBS Open Bio.*, 5:26-35, (2015).
Carroll, "A CRISPR Approach to Gene Targeting," Molecular Therapy 20.9 (2012): 1658-1660.
Chitra, et al., "Beta-2 Microglobulin as an Immunological Marker to Assess the Progression of Human Immunodeficiency Virus Infected Patients on Highly Active Antiretroviral Therapy," *Clinica Chimica Acta*, 412:1151-1154, (2011).
Cradick, et al., "CRISPR/Cas9 systems targeting B-globin and CCR5 genes have substantial off-target activity," Nucleic Acids Research, 1-9 (2013).
Davis, et al., "Micro-Injection-Mediated Hematopoietic Stem Cell Gene Therapy," *Current Opinion in Molecular Therapeutics*, 2(4):412-419, (2000).
Edelstein, et al., "Gene therapy clinical trials worldwide 1989-2004—an overview," The Journal of Gene Medicine 6: 597-302 (2004).
Final Office Action for U.S. Appl. No. 15/818,710, dated Apr. 20, 2021.
Final Office Action for U.S. Appl. No. 15/818,710, dated Feb. 21, 2023.
Final Office Action for U.S. Appl. No. 14/509,787, dated Mar. 1, 2019.
Final Office Action for U.S. Appl. No. 14/509,787 dated Mar. 22, 2021.
Final Office Action for U.S. Appl. No. 15/818,710, dated Apr. 22, 2019.
Final Office Action for U.S. Appl. No. 16/278,645, dated Feb. 4, 2021.
Final Office Action for U.S. Appl. No. 17/327,620, dated Feb. 3, 2022.
Final Office Action for U.S. Appl. No. 17/327,620, dated Jan. 6, 2023.
Final Office Action for U.S. Appl. No. 17/327,625 dated Mar. 27, 2023.
Final Office Action for U.S. Appl. No. 17/327,625, dated Dec. 24, 2021.
Final Office Action for U.S. Appl. No. 14/509,787, dated May 24, 2018.
Final Office Action for U.S. Appl. No. 17/327,606, dated Dec. 12, 2022.
Gaj, et al., Trends in Biotechnology 31(7):397-405 (2013).
GenBank AY136510.1 Kutlar, et al., "A new hemoglobin, beta chain . . . " Jul. 26, 2002 Kutlar, et al., A New Hemoglobin, Beta Chain Variant 'Hb S-Wake' Confirmed to be on the Same Chromosome with Hemoglobin S Mutation, Detected in An African-American Family: Genbank: AY13651 0.1. Jul. 26, 2002 [Retrieved on Dec. 23, 2015]. Retrieved from the Internet: URL:http://www.ncbi.nlm.nih.gov/nucleotide/23268448.
GenBank M137921.1 Human adenosine deaminase . . . p. 17n/ 35125-35147 and nt 35090-35112.
GenBank: AY692262.1, Rieder, et al., *Homo sapiens* Interleukin 2 Receptor, Gamma (Severe Combined ; Immunodeficiency) (IL2RG) Gene, Complete cds: Genbank: AY692262.1. Jul. 21, 2004 [Retrieved on Mar. 3, 2016]. Retrieved from the Internet: <URL:; http://www.ncbi.nlm.nih.gov/nucleotide/50897 469>; pp. 1-4.

(56) References Cited

OTHER PUBLICATIONS

Goh, "CRISPR—What Can go Wrong and How to Deal with it," *SiTOOLs Biotech Blog*, pp. 1-9, (Apr. 11, 2017).
Graham, et al. "Resources for the Design of CRISPR Gene Editing Experiments." Genome biology 16.1 (2015): 1-21.
Gussow, et al., "The Human Beta 2-Microglobulin Gene. Primary Structure and Definition of the Transcriptional Unit," *Journal of Immunology*, 139(9):3132-3138, (Nov. 1, 1987), GenBank Supplement pp. 1-5.
High, et al., "DNA-cleaving enzymes trigger a repair process that can now be harnessed to correct mutations in the human genome in vitro. This represents another step towards gene-correction strategies for treating human disease," Nature 435 pp. 577 & 579 (2005).
Holt, et al., "Human hematopoietic stem/progenitor cells modified by zinc-finger nucleases targeted to CCRG control HIV-1 in vivo," Nature biotechnology 28.8, 839-847 (2010).
Hsu et al., "Development and Applications of CRISPR-Cas9 for Genome Engineering," *Cell*, 157:1262-1278, (2014).
International Search Report for International Application PCT/US2014/46034, dated Jan. 23, 2015.
International Search Report for International Application PCT/US2015/054747, dated Apr. 29, 2016.
International Search Report for International Application PCT/US2015/054765, dated Mar. 11, 2016.
Jinek, et al., "RNA-programmed genome editing in human cells," eLife Research Article pp. 1-9 (2013).
Li et al., "MAGeCK enables robust identification of essential genes from genome-scale CRISPR/Cas9 knockout screens," *Genome Biology*, 15:1-12, (2014).
Lin et al., "Enhanced homology-directed human genome engineering by controlled timing of CRISPR/Cas9 delivery," *Elife*, DOI: 10.7554:1-13, (2014).
Lin, et al., "CRISPR/Cas9 systems have off-target activity with insertions or deletions between target DNA and guide RNA sequences," Nucleic Acids Research 1-13 (2014).
Lombardo, et al., "Gene Editing in Human Stem Cells Using Zinc Finger Nucleases and Integrase-Defective Lentiviral Vector Delivery," *Nature Biotechnology*, 25(11):1298-1306, (2007).
Maier, et al., "Efficient Clinical Scale Gene Modification via Zinc Finger Nuclease-Targeted Disruption of the HIV Co-receptor CCR5," *Human Gene Therapy*, 24:245-258, (Mar. 2013).
Mali, et al., "RNA-Guided Human Genome Engineering via Cas9," Science 339: 823-826 (2013); and Supplemental Material.
Mandal, et al., "Efficient ablation of genes in human hematopoietic stem and effector cells using CRISPR/Cas9," Cell Stem Cell, 15(5):643-52, 2014.
Masquelier, et al., "A Novel 24-Base Pair Deletion in the Coding Region of CCR5 in an African Population," *AIDS*, 21(1):111-122, (2007).
Meissner, et al., "Genome Editing for Human Gene Therapy," Methods in Enzymology, 256: pp. 273-295, 2014.
Merkle et al., "Modeling Human Disease with Pluripotent Stem Cells: from Genome Association to Function," *Cell Stem Cell* , 12:656-668, (2013).
Non-Final Office Action for U.S. Appl. No. 14/509,924, dated Jul. 29, 2016.
Non-Final Office Action for U.S. Appl. No. 14/509,787, dated Jul. 28, 2020.
Non-Final Office Action for U.S. Appl. No. 14/509,787, dated Oct. 25, 2021.
Non-Final Office Action for U.S. Appl. No. 14/509,924, dated Mar. 12, 2018.
Non-Final Office Action for U.S. Appl. No. 15/818,710, dated Aug. 3, 2023.
Non-Final Office Action for U.S. Appl. No. 15/818,710, dated Jul. 27, 2020.
Non-Final Office Action for U.S. Appl. No. 15/818,710, dated Jun. 8, 2022.
Non-Final Office Action for U.S. Appl. No. 15/818,710, dated Sep. 13, 2018).
Non-Final Office Action for U.S. Appl. No. 16/278,645, dated Jul. 17, 2020.
Non-Final Office Action for U.S. Appl. No. 16/278,645, dated Aug. 19, 2021.
Non-Final Office Action for U.S. Appl. No. 17/327,606, dated May 27, 2022.
Non-Final Office Action for U.S. Appl. No. 17/327,620, dated Oct. 18, 2021.
Non-Final Office Action for U.S. Appl. No. 17/327,625, dated Sep. 3, 2021.
Non-Final Office Action for U.S. Appl. No. 17/327,625, dated Oct. 5, 2023.
Non-Final Office Action for U.S. Appl. No. 17/728,927, dated Sep. 13, 2023.
Notice of Allowance for U.S. Appl. No. 14/509,924, dated Oct. 10, 2018.
Palu, et al., "In pursuit of new developments for gene therapy of human diseases," Journal of Biotechnology 68:1-13 (1999).
Papapetrou, et al., "Genomic Safe Harbors Permit High β-Globin Transgene Expression in Thalassemia Induced Pluripotent Stem Cells," *Nature Biotechnology*, 29(1):73-81, (Jan. 2011).
Pavel-Dinu, et al. "Gene correction for SCID-X1 in long-term hematopoietic stem cells." Nature communications 10.1 (2019): 1634.
STIC Alignment 16278645 SEQ 814 vs WO2001/73002 SEQ485 and 465 (2020).
STIC Alignment 16278645 SEQ814 vs WO2001/73002 SEQ481 (2020).
Tebas, et al., "Gene Editing of CCR5 in Autologous CD4 T Cells of Persons Infection with HIV," *The New England Journal of Medicine*, 370(10):901-910, (Mar. 6, 2014).
Third Party Observation for PCT Application PCT/US2014/033082, made/submitted Aug. 3, 2015.
Third Party Submission Under 37 CFR 1.290 for U.S. Appl. No. 14/485,288, mad/submitted Jul. 14, 2015.
Zhang et al., "CRISPR/Cas9 for genome editing: progress, implications and challenges," *HMG Advance Access*, Published Mar. 20, 2014 pp. 1-21.
Cho, et al., "Targeted genome engineering in human cells with the Cas9 RNA-guided endonuclease," Nature Biotechnology, 31:230-232, 2013.
Final Office Action for U.S. Appl. No. 15/818,710, dated Mar. 6, 2024.
Notice of Allowance for U.S. Appl. No. 17/993,667, dated Mar. 20, 2024.
Notice of Allowance for U.S. Appl. No. 17/993,680, dated Mar. 26, 2024.

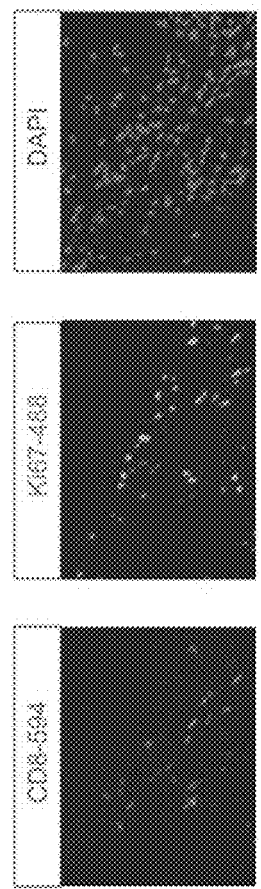
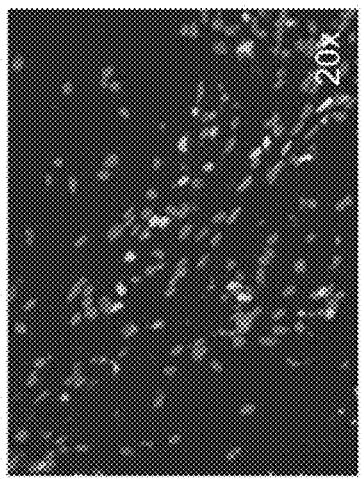
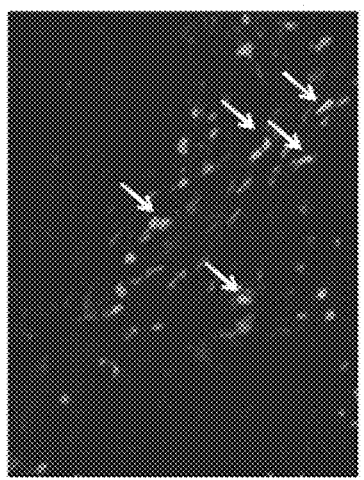
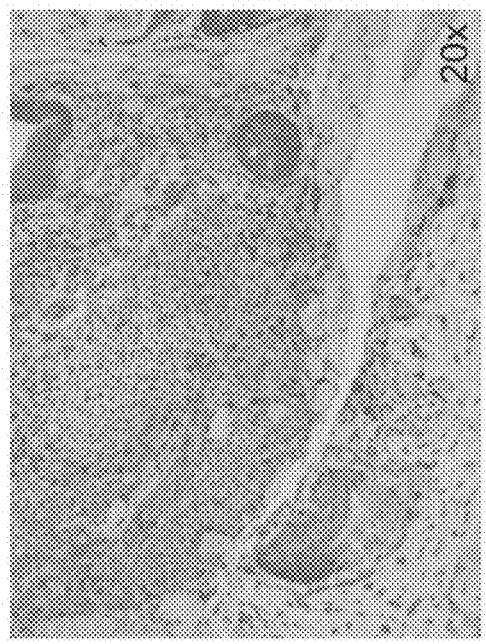
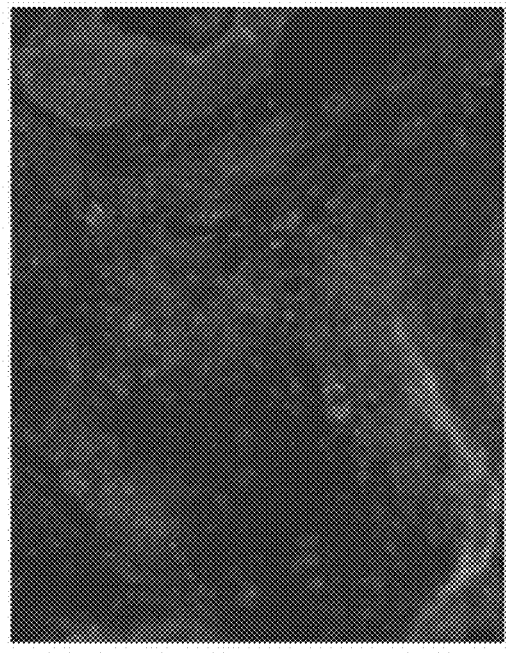
FIGS. 8A-8C

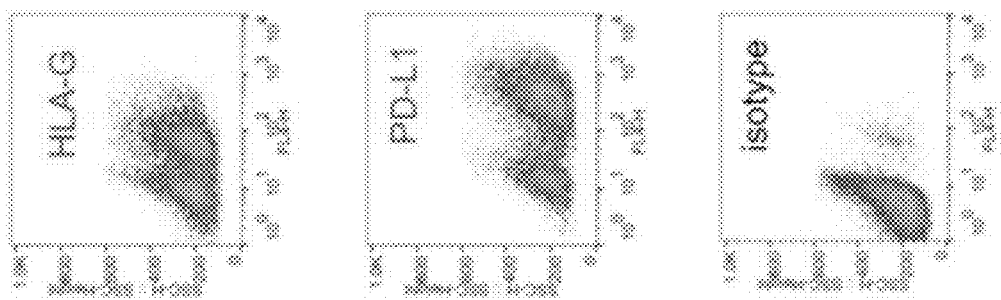
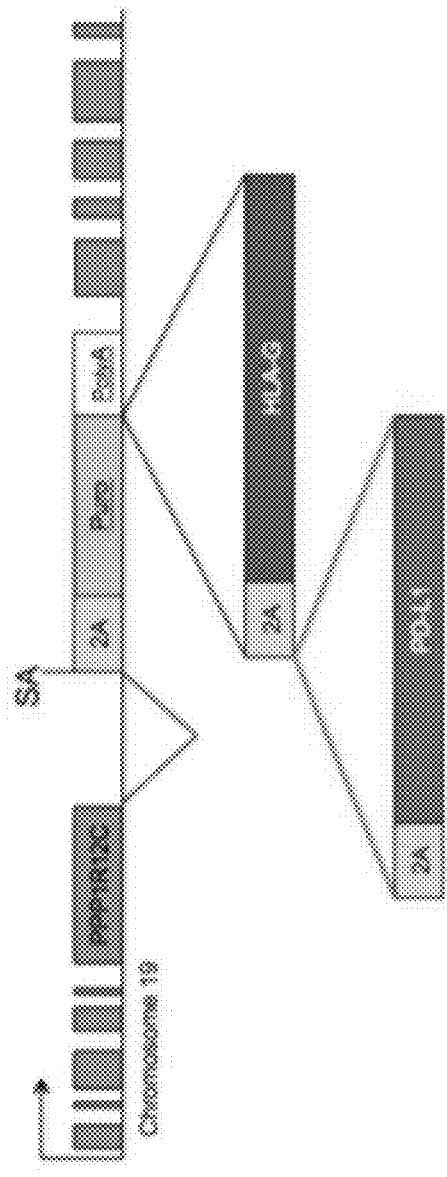
FIGS. 11A-11C

1    MDKKYSIGLD IGTNSVGWAV ITDEYKVPSK KFKVLGNTDR HSIKKNLIGA LLFDSGETAE

61   ATRLKRTARR RYTRRKNRIC YLQEIFSNEM AKVDDSFFHR LEESFLVEED KKHERHPIFG

121  NIVDEVAYHE KYPTIYHLRK KLVDSTDKAD LRLIYLALAH MIKFRGHFLI EGDLNPDNSD

181  VDKLFIQLVQ TYNQLFEENP INASGVDAKA ILSARLSKSR RLENLIAQLP GEKKNGLFGN

241  LIALSLGLTP NFKSNFDLAE DAKLQLSKDT YDDDLDNLLA QIGDQYADLF LAAKNLSDAI

301  LLSDILRVNT EITKAPLSAS MIKRYDEHHQ DLTLLKALVR QQLPEKYKEI FFDQSKNGYA

361  GYIDGGASQE EFYKFIKPIL EKMDGTEELL VKLNREDLLR KQRTFDNGSI PHQIHLGELH

421  AILRRQEDFY PFLKDNREKI EKILTFRIPY YVGPLARGNS RFAWMTRKSE ETITPWNFEE

481  VVDKGASAQS FIERMTNFDK NLPNEKVLPK HSLLYEYFTV YNELTKVKYV TEGMRKPAFL

541  SGEQKKAIVD LLFKTNRKVT VKQLKEDYFK KIECFDSVEI SGVEDRFNAS LGTYHDLLKI

601  IKDKDFLDNE ENEDILEDIV LTLTLFEDRE MIEERLKTYA HLFDDKVMKQ LKRRRYTGWG

661  RLSRKLINGI RDKQSGKTIL DFLKSDGFAN RNFMQLIHDD SLTFKEDIQK AQVSGQGDSL

721  HEHIANLAGS PAIKKGILQT VKVVDELVKV MGRHKPENIV IEMARENQTT QKGQKNSRER

781  MKRIEEGIKE LGSQILKEHP VENTQLQNEK LYLYYLQNGR DMYVDQELDI NRLSDYDVDH

841  IVPQSFLKDD SIDNKVLTRS DKNRGKSDNV PSEEVVKKMK NYWRQLLNAK LITQRKFDNL

901  TKAERGGLSE LDKAGFIKRQ LVETRQITKH VAQILDSRMN TKYDENDKLI REVKVITLKS

961  KLVSDFRKDF QFYKVREINN YHHAHDAYLN AVVGTALIKK YPKLESEFVY GDYKVYDVRK

1021 MIAKSEQEIG KATAKYFFYS NIMNFFKTEI TLANGEIRKR PLIETNGETG EIVWDKGRDF

1081 ATVRKVLSMP QVNIVKKTEV QTGGFSKESI LPKRNSDKLI ARKKDWDPKK YGGFDSPTVA

1141 YSVLVVAKVE KGKSKKLKSV KELLGITIME RSSFEKNPID FLEAKGYKEV KKDLIIKLPK

1201 YSLFELENGR KRMLASAGEL QKGNELALPS KYVNFLYLAS HYEKLKGSPE DNEQKQLFVE

1261 QHKHYLDEII EQISEFSKRV ILADANLDKV LSAYNKHRDK PIREQAENII HLFTLTNLGA

1321 PAAFKYFDTT IDRKRYTSTK EVLDATLIHQ SITGLYETRI DLSQLGGD    (SEQ ID NO: 1)

FIG. 12

PCR screening confirms clone 1D as a homozygous knock-out clone
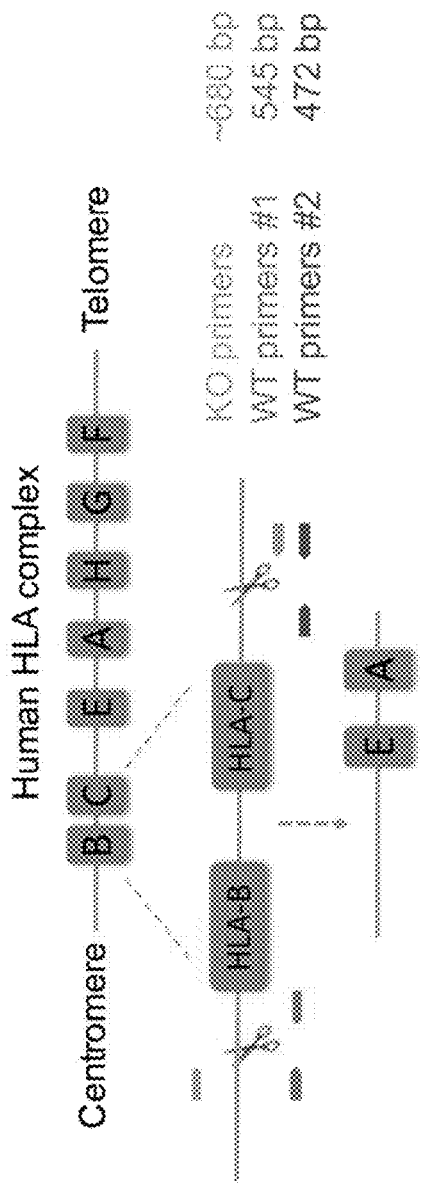
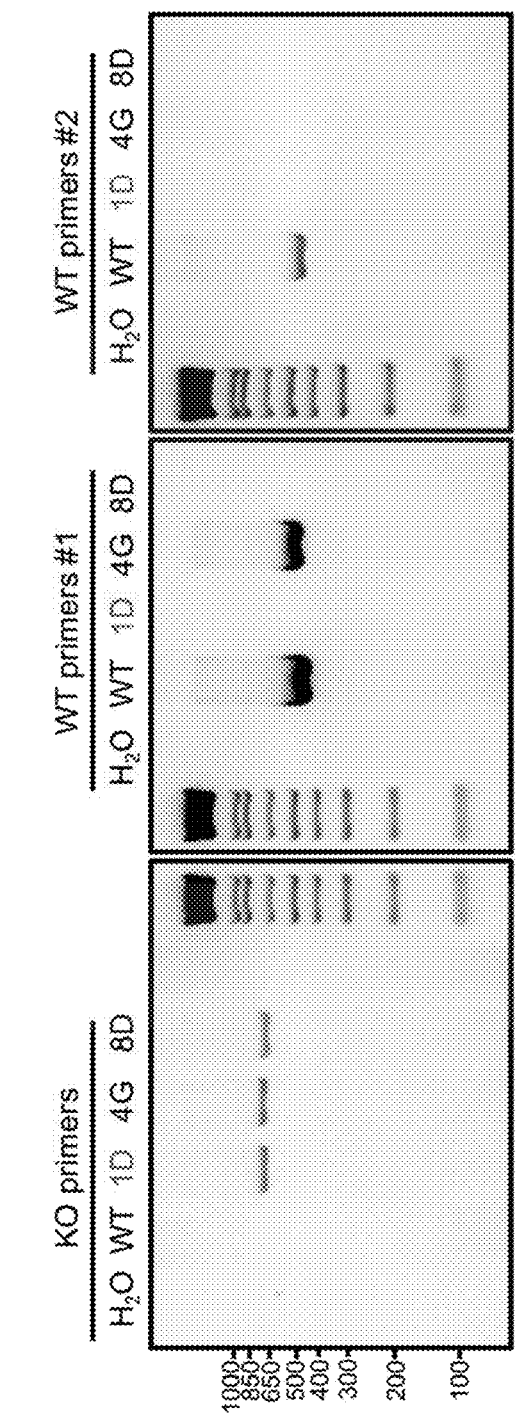
FIG. 14B CRISPR sgRNA sequences:

sgRNA #5: AGCGGCAAGTGGGAGGCGGC    SEQ ID NO: 818017
sgRNA #6: CGGCTCGTGGGCTGCATGTG    SEQ ID NO: 818018

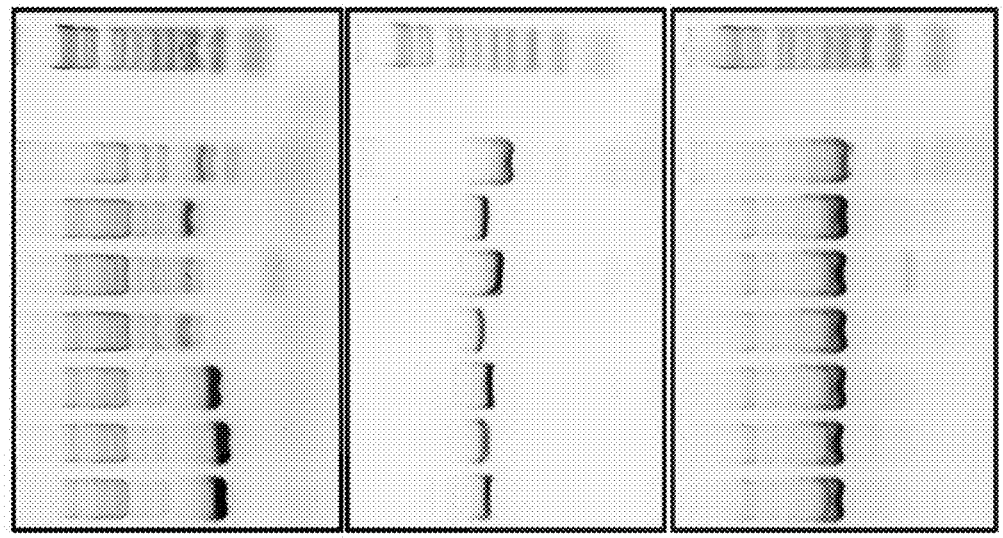
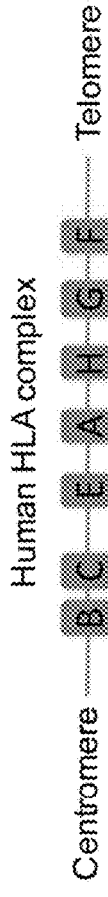
PCR screening confirms clone 4E as a heterozygous HLA-A knockout clone
FIG. 14I

Targeting of HuES9

NLRC5 mutations, HuES-9

| | | |
|---|---|---|
| 1F5 A4 | GCAGCCGTCCTGTGAGCCGC---------CCAAAGACCCAGAAACCCTGA | SEQ ID NO: 818058 |
| 2C7 A8 | GCAGCCGTCCTGTGAGCCGC---------AAAGACCCAGAAACCCTGA | SEQ ID NO: 818059 |
| 3E7 A26 | GCAGC---------ACCCACAAACCCTGA | SEQ ID NO: 818060 |
| 3F7 1c4 | GCAGCCGTCCTGTGAGCCGCAC--------AAAGACCCAGAAACCCTGA | SEQ ID NO: 818061 |

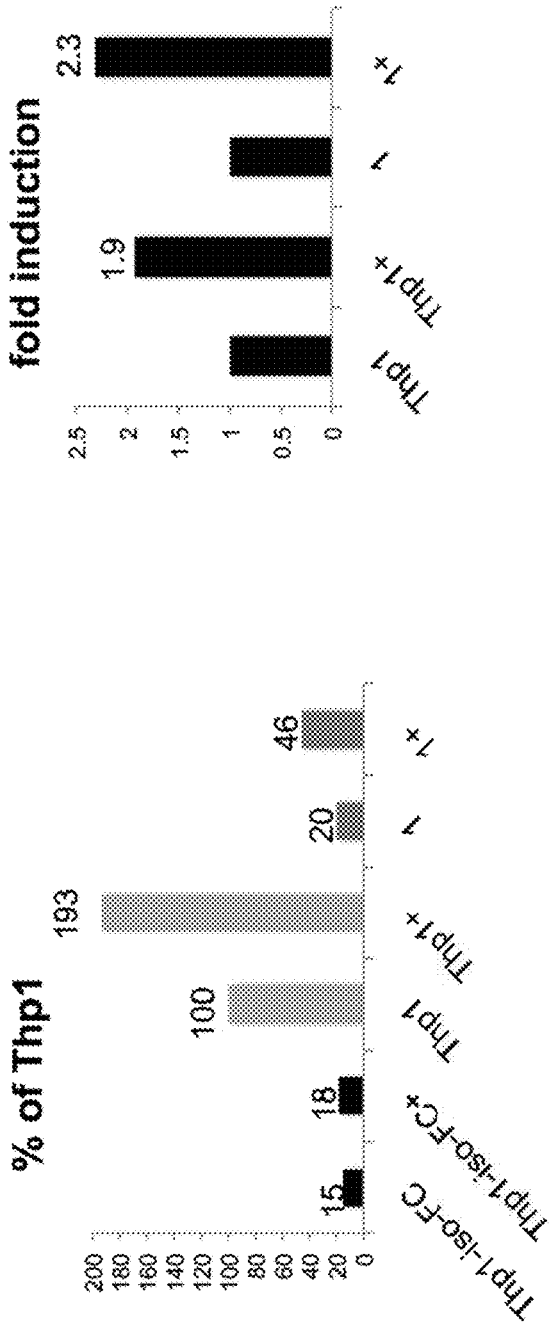
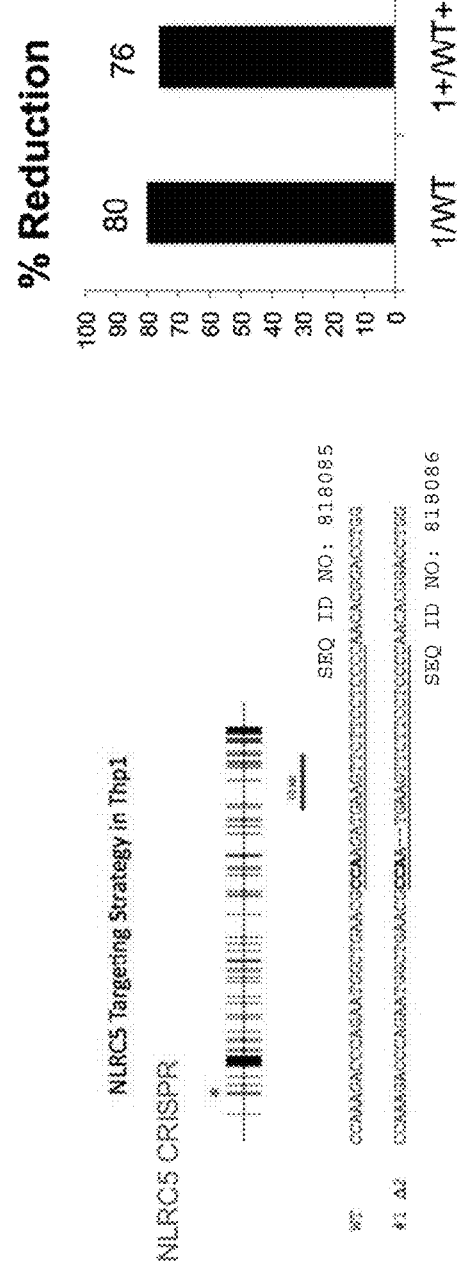
FIG. 16A

CRISPRs used for Lentiviral Transduction of Thp-1

CIITA

GGTCCATCTGGTCATAGAAG(TGG)  SEQ ID NO: 818103

NLRC5

CR1

GATGTCCAGGGTTCGGACACC(TGG)  SEQ ID NO: 818104

CR2

GATGAGGCCCTCCAGCCTAT(GGG)  SEQ ID NO: 818105

IRF1

CR1

GATGCCTGTTTGTTCCGGAGC  SEQ ID NO: 818106

CR2

GAGATGATCTTCCAGATCCCA  SEQ ID NO: 818107

CR3

GCTCGGATGGCATGAGACCC  SEQ ID NO: 818108

FIG. 16E

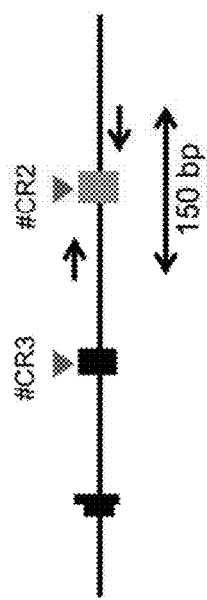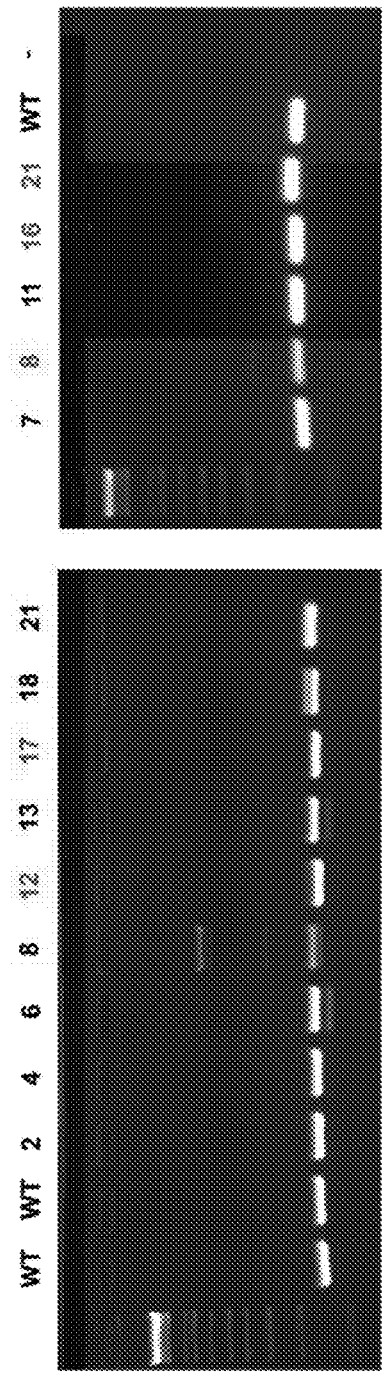
FIG. 17G

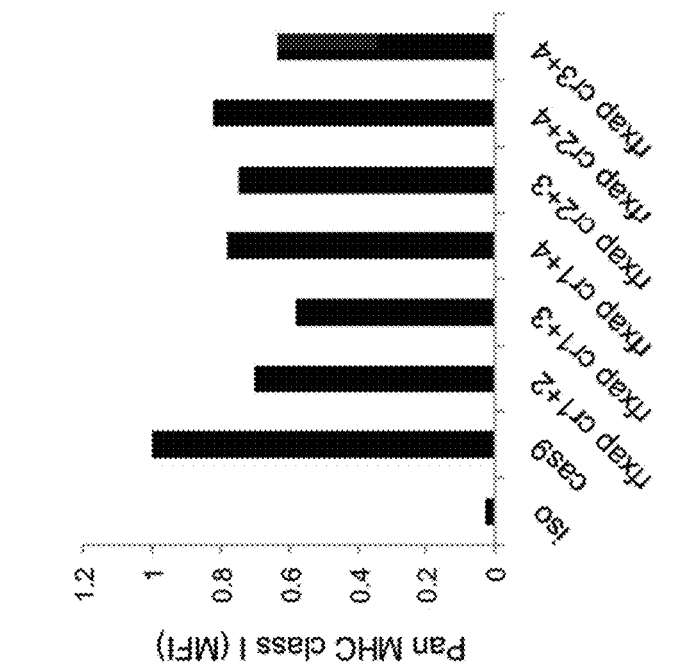
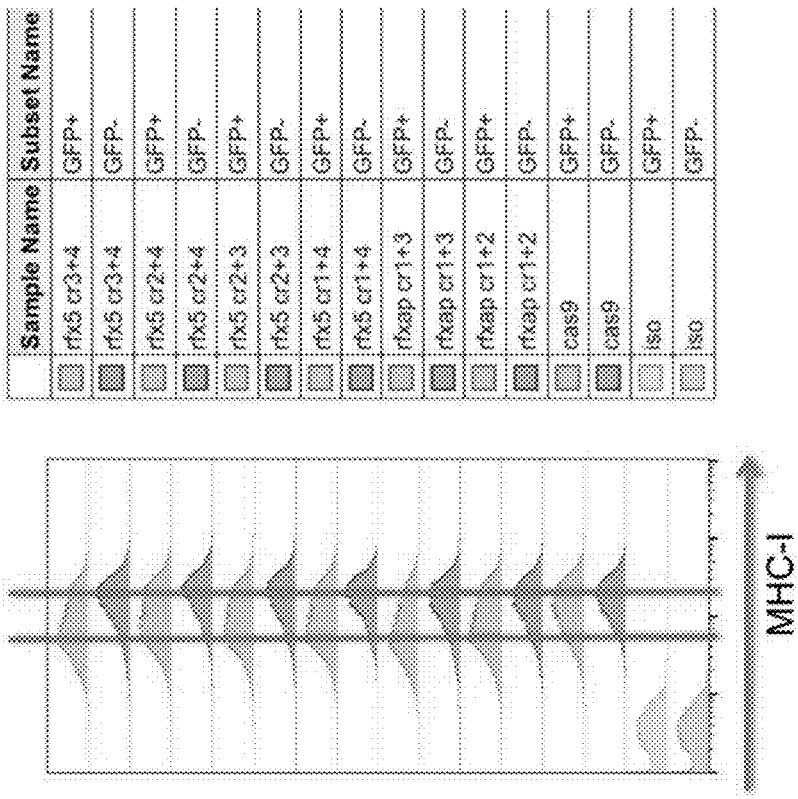
FIG. 18H

Dual Guide Targeting of NFY-A in 293T Cells

Mock    CR2+CR3    CR2+CR4    CR3+CR4    bp
308      246        282 246    246

CRISPR Pair #1: AGTGTACCTCACAGCCTTCT    SEQ ID NO: 818136
CRISPR Pair #2: GACAGAGCAGATTGTTGTCC    SEQ ID NO: 818137
CRISPR Pair #3: AGTGAGATTCCTGTCCACTC    SEQ ID NO: 818138
CRISPR Pair #4: GACAGATTCAGCAGCAGGTA    SEQ ID NO: 818139

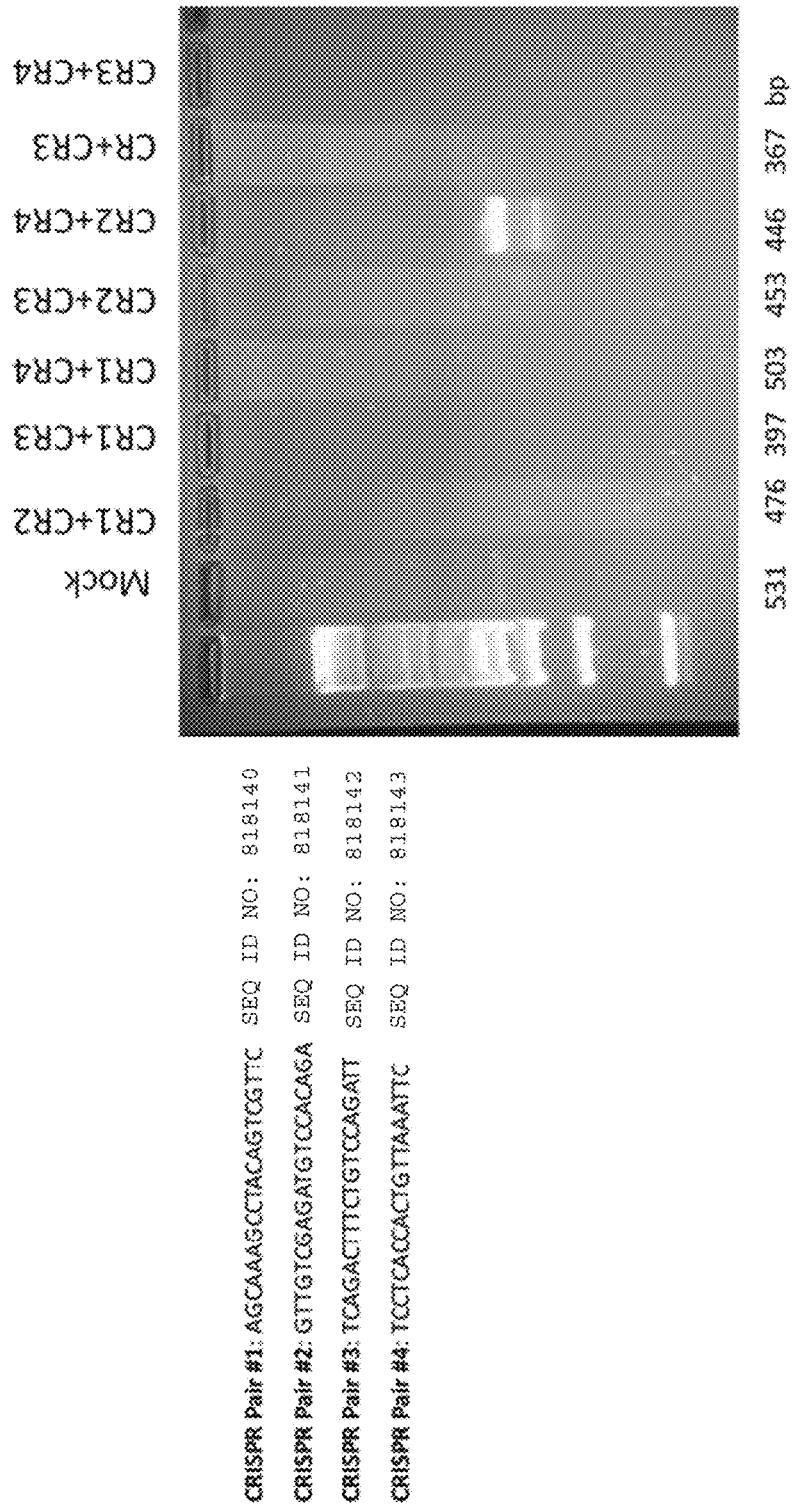

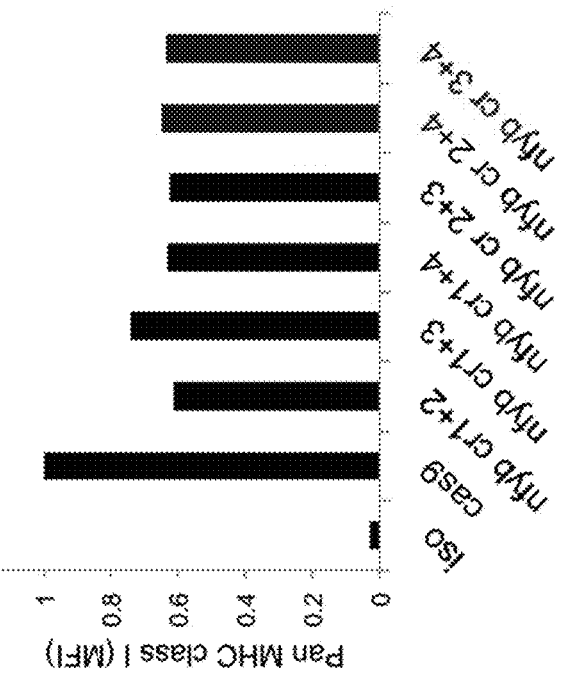
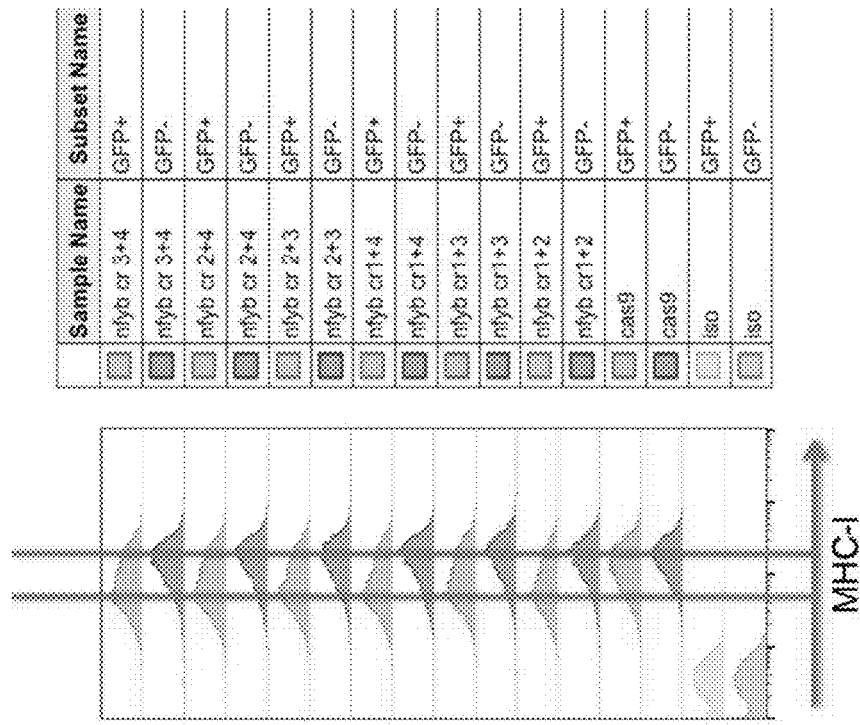
FIG. 19E

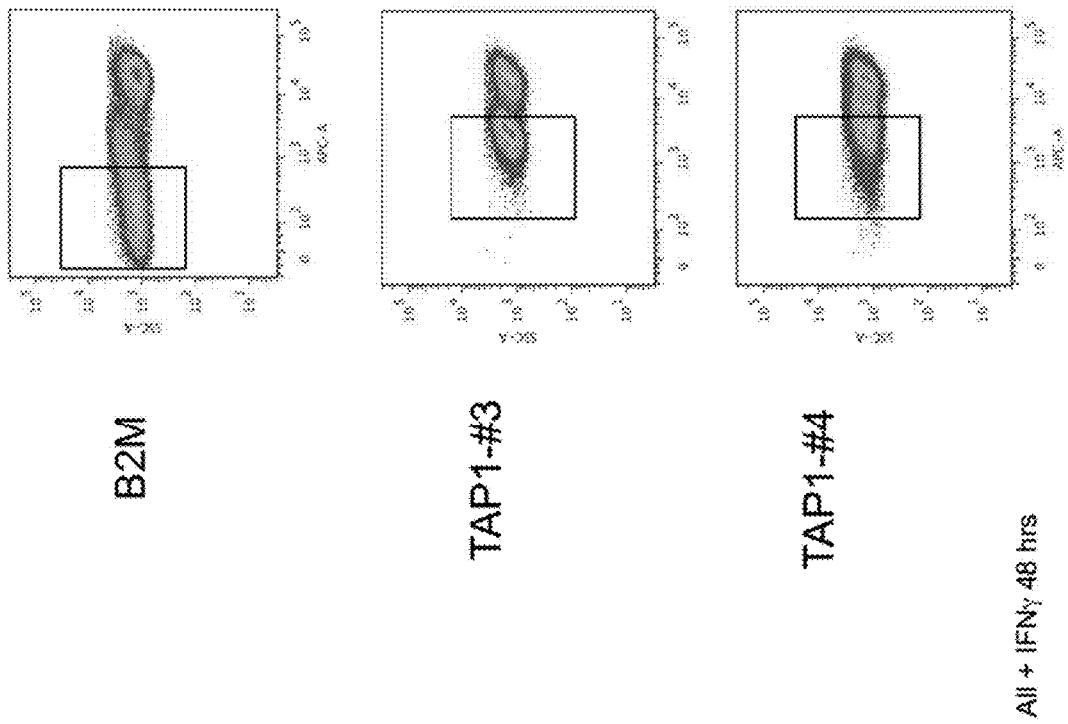

FIG. 21A

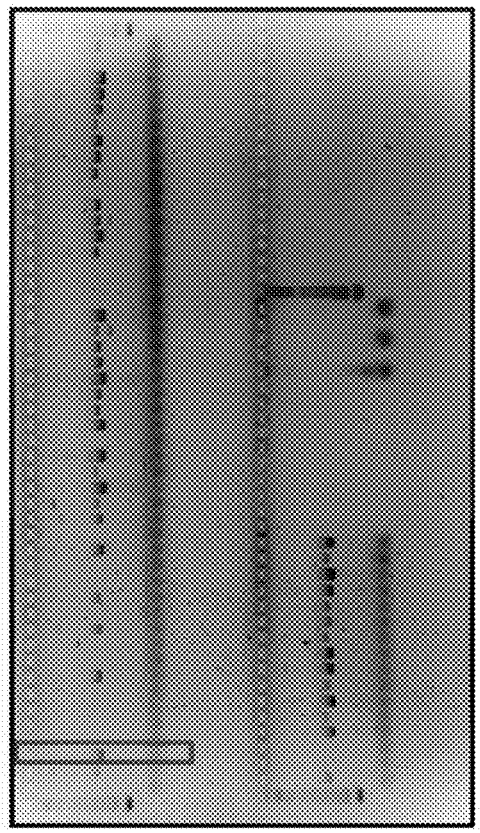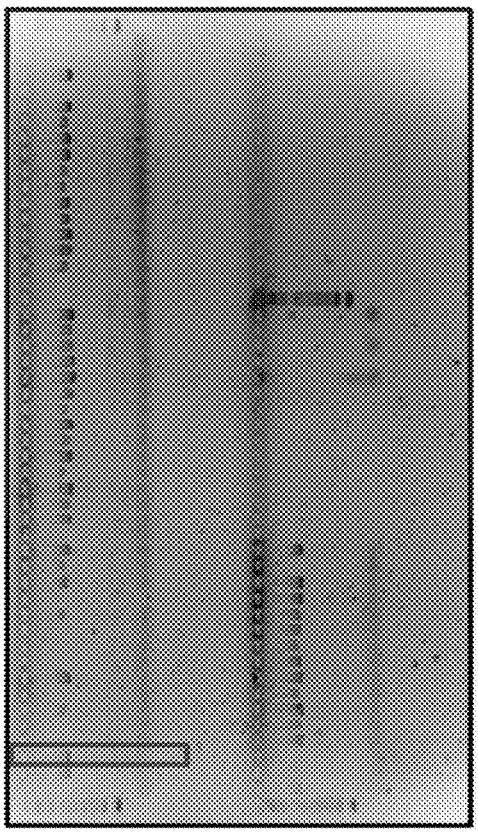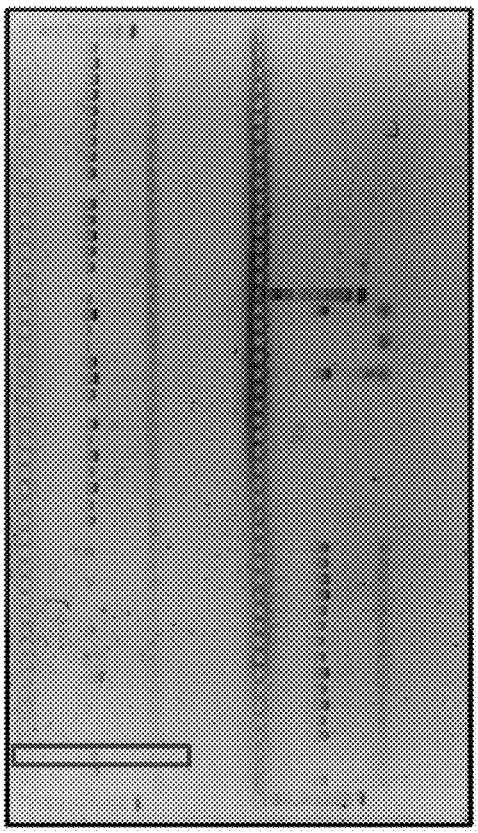
PCR screening confirms 1G as a heterozygous KI clone for PD-L1/HLA-G
FIG. 22E

Deletion of TRAC and TRBC in HuES9 to disrupt TCR Expression

TRAC     SEQ ID NO: 818164
CR1 AGAGCAACAGTGCTGTGGCC(TGG)
CR2 TGGAATAATGCTGTTGTTGA(AGG)
         SEQ ID NO: 818165

TRBC     SEQ ID NO: 818166
CR1 CGCTGTCAAGTCCAGTTCTA(CGG)
CR2 GGCTCTCGGAGAATGACGAG(TGG)
         SEQ ID NO: 818167

|       | TCRA |              | TCRB  |
|-------|------|--------------|-------|
|       | HuES9 | B2M-/-CIITA-/- | HuES9 |

**TCRA KO in HuES9
*TCRB KO in HuES9

***TCRA KO in HuES9 B2M-/-CIITA-/-, in fact this is now a triple knock-out stem cell line for B2M-/-, CIITA-/-, TCR-/-, which upon differentiation into T cells will be devoid of MHC-I and -II and no TCR surface expression; the perfect blank canvas for introducing a Chimeric Antigen Receptor (CAR). Additional modifications such as deletion of the inhibitory receptors PD-1 and CTLA4 will make this cells powerful tools for cancer immunotherapy.

CRISPR gGTAGAAAAACAATTAGACC(TGG) SEQ ID NO: 818168

KO in JEG-3, a choriocarcinoma cell line and in 2 melanoma cell lines, 501 and MalMe.

CRISPRs targeting PD-L1 are very useful in breaking tolerance in cancer immunotherapy!

FIG. 25A

Dual Guide Targeting of OX40 in 293T Cells

CR 1, 2 and 4 work!!!

SEQ ID NO: 818189  CRISPR #1: CCTTGCGGGGTGTGTGGCTATA
SEQ ID NO: 818190  CRISPR #2: TGGGGCTGAGCACCGTGACG
SEQ ID NO: 818191  CRISPR #3: GCAGAGCCGCACACGGCCCG
SEQ ID NO: 818192  CRISPR #4: TCTCTGCTGTCGCCAGAGTC

Dual Guide Targeting of ICOS in 293T Cells

SEQ ID NO: 818213 CRISPR #1: GAAGACACCCTTACCTCTAC
SEQ ID NO: 818214 CRISPR #2: CAGTCACTCATCAAGGTAAA
SEQ ID NO: 818215 CRISPR #3: GTTCAATGACAACATCATTC
SEQ ID NO: 818216 CRISPR #4: TAGAACAGAGATCACAAGAC

Various Cell Lines Tested

| | HLA-A | HLA-B/C | NLRC5 | CIITA | B2M | IRF1 |
|---|---|---|---|---|---|---|
| HuES8 | + | + | | | | |
| HuES9 | | | + | | + | + |
| BJ-RiPSCs | | | + | + | | |
| Thp1 | | | + | + | + | + |
| Jurkat | | | | | + | + |
| Primary T cells | + | | | + | + | + |
| HEK293T | + | + | | | | |

HuES8 and HuES9 are human ES cell lines
BJ-RiPSCs is an iPSC line

All other enhanceosome components (RFX and NFY) were only tested in HEK293T cells at this point

FIG. 27

Modified ES cells can be differentiated into various different Cell types with reduced or absent HLA expression MPCs = Mesenchymal Progenitor Cells [Mesoderm]
ECs = Endothelial cells [Mesoderm]
Macrophages [Mesoderm]

Hepatocytes [Endoderm]
Beta-Cells [Endoderm]

NPCs = Neural progenitor cells [Ectoderm]

Representatives of all three germ layers

FIG. 28A

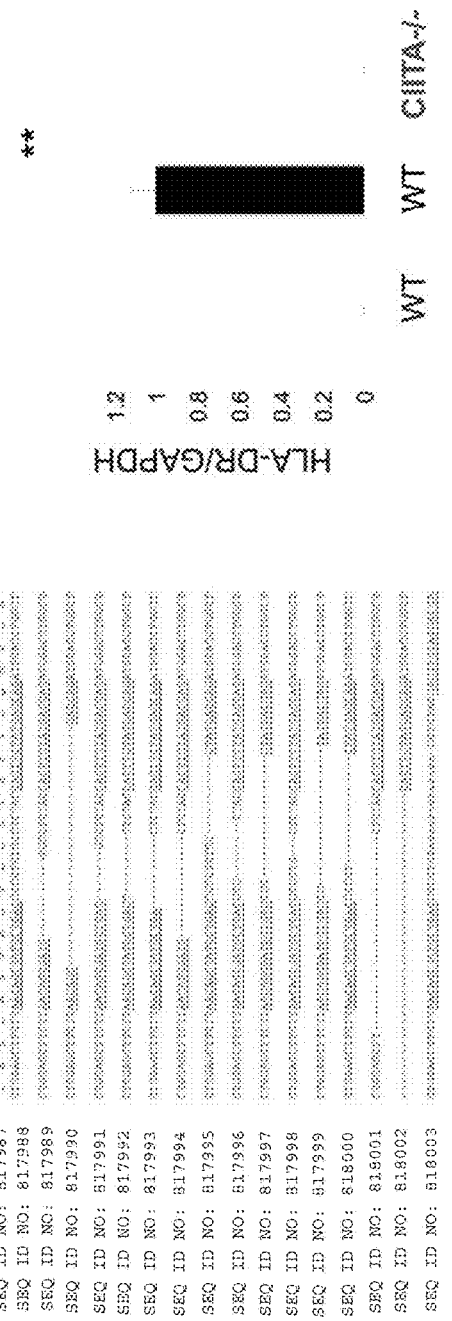
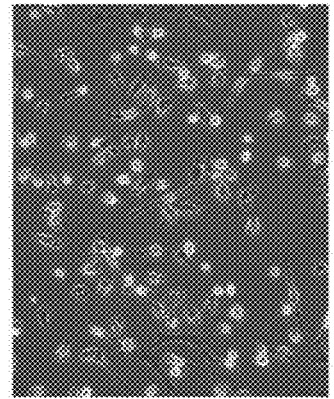
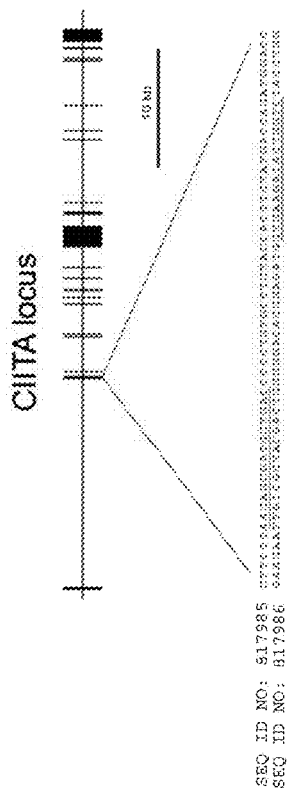
FIG. 28H

'Hypoimmunogenic' DKO Cell Lines Generated

| HuES9 | MHC-I | MHC-II |
|---|---|---|
| WT | yes | yes |
| NLRC5-/- C2TA-/- | reduced | no |
| B2M-/- C2TA-/- | no | no |

FIG. 29A

CRISPR Targeting of B7-H3 in JEG-3 cells

GCTGACAGATACCAAACAGC (TGG) SEQ ID NO: 818229

FIG. 30A

```
WT   CACAGCTCAACCTCATCTGGCAGCTGACAGATACCAAACAGCTGGTGCACAGCTTT  SEQ ID NO: 818230
C11 Δ16  CACAGCTCAACCTNATCTGGCAG---------------------AGCTGGTGCACAGCTTT  SEQ ID NO: 818231
G6  Δ26  CACAGCTCAACCTCATCTGG---TG-C-----------ACAG---------TTT  SEQ ID NO: 818232
```

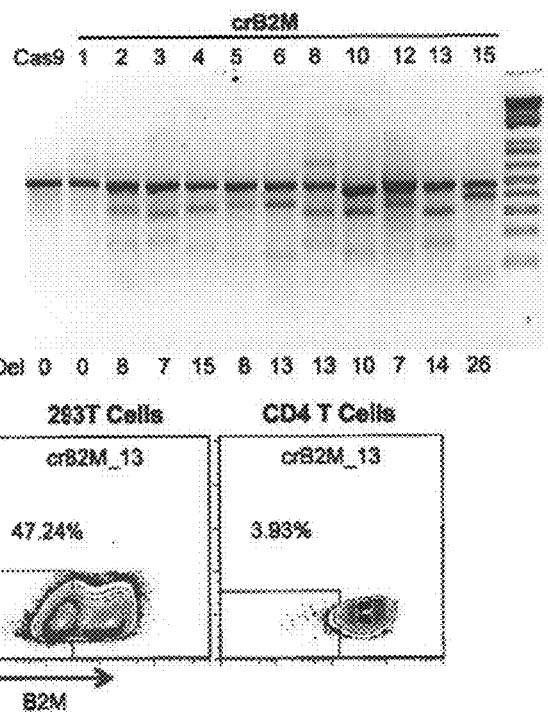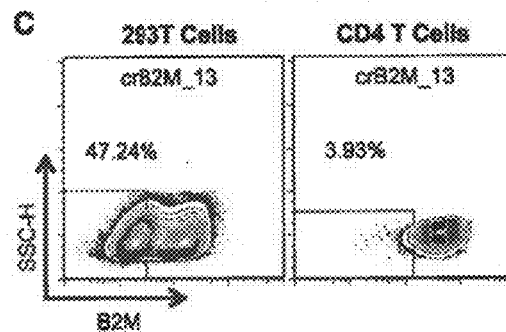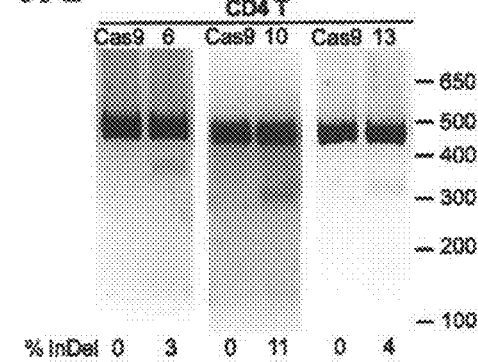
FIGS. 33A-33E

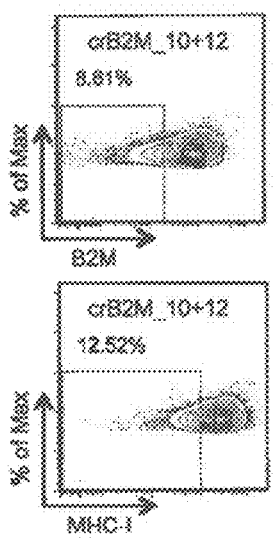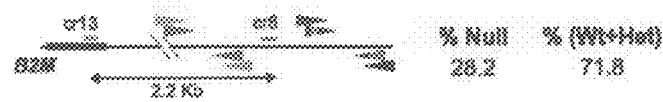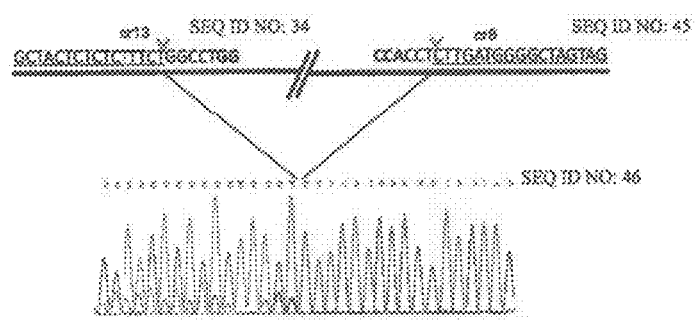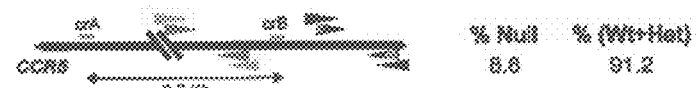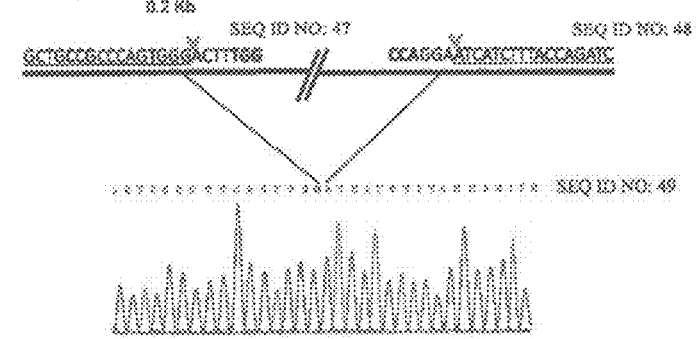
FIGS. 35A-35G

Cpf1 crRNA design and cloning

Express guides (crRNAs) as U6 promoter-direct repeat seq – 20 nt guide PCR product!

Fw primer (binding U6 promoter)
GAGGGCCTATTTCCCATGATTCCT (24 nt)   (SEQ ID NO: 42546)

Rev primers: rev comp target seq (20 nt)-rev comp direct repeat seq-rev comp and U6 P Rev primer example: AsCpf1 DNMT1 GUIDE 4 (63 nt)
CTTTATTTACTGAAGAAAAGTACAGATCTGAAATGTAATTGCTTTGTCTGACAGAG
(SEQ ID NO: 42547)

Cells transfected with Cpf1 DNA (either As or Lb) and crRNA PCR product generated using Lentiguide-puro plasmid as template (for hU6 promoter) and guide specific reverse primers

FIG. 39

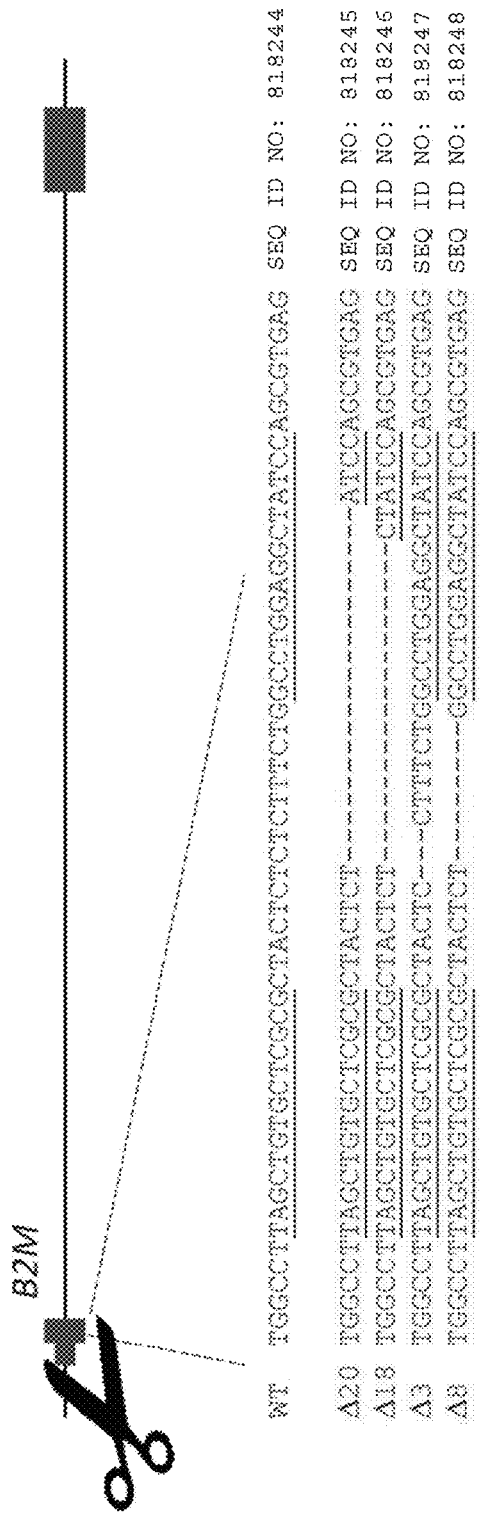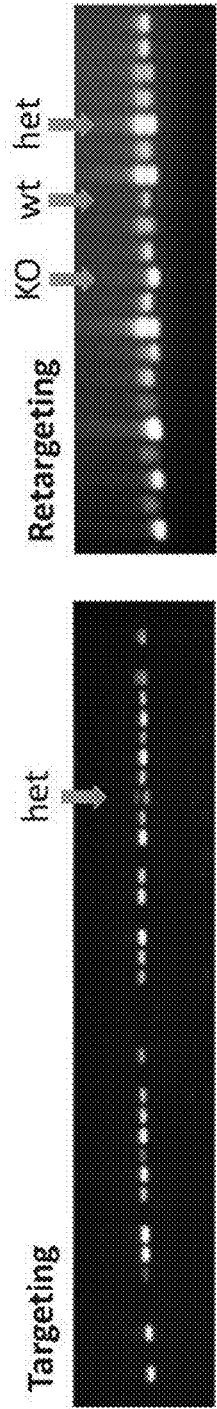
FIG. 40A

UNIVERSAL DONOR STEM CELLS AND RELATED METHODS

CROSS-REFERENCE TO RELATED APPLICATIONS

This application is a continuation application of U.S. application Ser. No. 17/148,556, filed Jan. 13, 2021, which is a divisional application of U.S. application Ser. No. 15/572,776, (now U.S. Pat. No. 10,968,426), filed Nov. 8, 2017, which is a national stage filing under 35 U.S.C. 371 of International Application No. PCT/US2016/031551, filed May 9, 2016, which claims the benefit of U.S. Provisional Application No. 62/158,999, filed on May 8, 2015, the contents of which are hereby incorporated by reference in its entirety. International Application No. PCT/US2016/031551 was published under PCT Article 21(2) in English.

BACKGROUND OF THE INVENTION

Degenerative diseases pose a disproportionate threat to human health. Often age-related, these diseases result in the progressive deterioration of affected tissues and organs and, ultimately, disability and death of the affected subject. The promise of regenerative medicine is to replace diseased or missing cells with new healthy cells. Over the past five years, a new paradigm for regenerative medicine has emerged the use of human pluripotent stem cells (hPSCs) to generate any adult cell type for transplantation into patients. In principle, hPSC-based cell therapies have the potential to treat most if not all degenerative illnesses, however the success of such therapies may be limited by a subject's immune response.

Strategies that have been considered to overcome the immune rejection include HLA-matching (e.g. identical twin or umbilical cord banking), the administration of immunosuppressive drugs to the subject, blocking antibodies, bone marrow suppression/mixed chimerism, HLA-matched stem cell respositories and autologous stem cell therapy. Needed are novel approaches, compositions and methods for overcoming immune rejection associated with cell replacement therapies.

SUMMARY OF THE INVENTION

Disclosed herein are efficient strategies to overcome immune rejection in cell-based transplantation therapies by the creation of universal donor stem cell lines that, as quality-controlled cell-based products, will form the base for regenerative cell therapies.

The present inventors have successfully employed genome editing tools such as a TALEN and/or CRISPR system in human pluripotent stem cells to reduce expression or knock out the highly polymorphic classical MHC-I genes (HLA-A, HLA-B and HLA-C) and/or MHC-II genes. In certain aspects, such reduced expression or knock out of the MHC-I and/or MHC-II genes is accomplished by directly and/or indirectly targeting the NLRC5, B2M and CIITA genes and other components of the MHC enhanceosome (e.g., transcriptional regulators of MHC-I or MHC-II).

Disclosed herein are methods of preparing hypoimmunogenic stem cells, the method comprising modulating expression of one or more MHC-I and MHC-II human leukocyte antigens by the stem cell and thereby preparing the hypoimmunogenic stem cell. Also disclosed are methods of modulating expression of one or more MHC-I and MHC-II human leukocyte antigens by a stem cell, comprising deleting one or more genes encoding one or more transcriptional regulators of MHC-I or MHC-II from at least one allele of the cell and thereby modulating expression of the one or more MHC-I and MHC-II human leukocyte antigens.

In certain aspects, modulating expression of the one or more MHC-I and MHC-II human leukocyte antigens comprises reducing, inhibiting and/or interfering with the expression of the one or more MHC-I and MHC-II human leukocyte antigens. In certain embodiments, modulating expression of the one or more MHC-I and MHC-II human leukocyte antigens comprises deleting one or more genes encoding one or more transcriptional regulators of MHC-I or MHC-II from at least one allele of the cell. For example, in certain embodiments such methods comprise deleting one or more genes encoding one or more of the transcriptional regulators of MHC-I or MHC-II selected from the group consisting of NLRC5, CIITA, B2M and combinations thereof.

In certain aspects, the methods disclosed herein further comprise modulating expression of one or more tolerogenic factors by the stem cell. Modulating expression of the tolerogenic factors may comprises increasing the expression of the tolerogenic factors. Such tolerogenic factors may be inserted into a safe harbor locus (e.g., the AAVS1 locus) of at least one allele of the cell. In certain embodiments, such tolerogenic factors inhibit immune rejection. In certain embodiments, such tolerogenic factors are selected from the group consisting of HLA-C, HLA-E, HLA-G, PD-L1, CTLA-4-Ig, CD47, C1-inhibitor, and IL-35.

Also disclosed herein are methods of preparing a hypoimmunogenic stem cell, the method comprising modulating expression of one or more tolerogenic factors by the stem cell and thereby preparing the hypoimmunogenic stem cell. In certain embodiments, modulating expression of the tolerogenic factors comprises increasing the expression of the tolerogenic factors. Such tolerogenic factors may be inserted into a safe harbor locus (e.g., the AAVS1 locus) of at least one allele of the cell. In certain embodiments, such tolerogenic factors are selected from the group consisting of HLA-C, HLA-E, HLA-G, PD-L1, CTLA-4-Ig, CD47, C1-inhibitor, and IL-35. In certain embodiments, such tolerogenic factors inhibit immune rejection of the stem cell or of a differentiated stem cell prepared therefrom.

In certain aspects, the methods disclosed further comprise modulating expression of one or more MHC-I and MHC-II human leukocyte antigens by the cell, for example, by deleting one or more genes encoding one or more transcriptional regulators of MHC-I or MHC-II from at least one allele of the cell. In certain embodiments, transcriptional regulators of MHC-I or MHC-II from are selected from the group consisting of NLRC5, CIITA, B2M and combinations thereof.

Also disclosed herein are human stem cells that do not express NLRC5 (e.g., a NLRC5$^{-/-}$ knockout mutant stem cell). Similarly, also disclosed are human stem cells that do not express CIITA (e.g., a CITTA$^{-/-}$ knockout mutant stem cell). Also disclosed are human stem cells that do not express B2M (e.g., a B2M$^{-/-}$ knockout mutant stem cell). In certain embodiments, also provided are human stem cells that do not express one or more of NLRC5, CIITA and B2M. In still other embodiments, also disclosed are human stem cells that do not express one or more of HLA-A, HLA-B and HLA-C.

In certain embodiments, the stem cells disclosed herein expresses one or more tolerogenic factors (e.g., one or more tolerogenic factors that inhibit immune rejection). In certain aspects, such tolerogenic factors are inserted into a safe harbor locus (e.g., the AAVS1 locus) of at least one allele of the cell. In certain embodiments, the tolerogenic factors are selected from the group consisting of HLA-C, HLA-E, HLA-G, PD-L1, CTLA-4-Ig, CD47, C1-inhibitor, and IL-35.

In some embodiments, the cell is an embryonic stem cell. In certain embodiments, the cell is a pluripotent stem cell. In certain embodiments, the stem cell is hypoimmunogenic.

In some embodiments, the cell has reduced MHC-I expression relative to the original genotype or relative to a wild-type human stem cell. In certain embodiments, the cell has reduced MHC-II expression relative to the original genotype or relative to a wild-type human stem cell. For example, such cells may have reduced expression of one or more of HLA-A, HLA-B and HLA-C relative to the original genotype or relative to a wild-type human stem cell.

Also disclosed herein are human stem cells that have been altered such that they comprise one or more tolerogenic factors inserted into a safe harbor locus (e.g., the AAVS1 locus) of at least one allele of the cell. In certain embodiments, such tolerogenic factors inhibit immune rejection. In certain embodiments, the tolerogenic factors are selected from the group consisting of HLA-C, HLA-E, HLA-G, PD-L1, CTLA-4-Ig, CD47, C1-inhibitor, and IL-35. In certain aspects, such cells do not express one or more of NLRC5, CIITA and B2M. In certain aspects, such cells do not express one or more of HLA-A, HLA-B and HLA-C. In certain embodiments, such cells have reduced expression of one or more of HLA-A, HLA-B and HLA-C relative to a wild-type human stem cell.

Also disclosed herein are methods of using the hypoimmunogenic cells disclosed herein for cell replacement therapy. For example, the universal stem cells disclosed herein may be incubated under appropriate conditions and differentiated into hypoimmunogenic cardiomyocytes, endothelial cells, hepatocytes or pancreatic beta cells.

Also disclosed herein are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 36353-81239, thereby editing the NLRC5 gene to reduce or eliminate NLRC5 surface expression and/or activity in the cell.

Also disclosed are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 5184-36352, thereby editing the CIITA gene to reduce or eliminate CIITA surface expression and/or activity in the cell.

Also disclosed are methods for producing hypoimmunogenic stem cells, the method comprising contacting a stem cell with a Cas protein or a nucleic acid sequence encoding the Cas protein and a first pair of ribonucleic acids having sequences selected from the group consisting of SEQ ID NOs: 81240-85644, thereby editing the B2M gene to reduce or eliminate B2M surface expression and/or activity in the cell.

Also disclosed are methods for producing a hypo-immunogenic stem cell, the method comprising: (a) contacting a stem cell with a Cas protein or a nucleic acid sequence encoding the Cas protein and a first pair of ribonucleic acids having sequences selected from the group consisting of SEQ ID NOs: 36353-81239, thereby editing the NLRC5 gene to reduce or eliminate NLRC5 surface expression and/or activity in the cell; (b) contacting a stem cell with a Cas protein or a nucleic acid sequence encoding the Cas protein and a second pair of ribonucleic acids having sequences selected from the group consisting of SEQ ID NOs: 5184-36352, thereby editing the CIITA gene to reduce or eliminate CIITA surface expression and/or activity in the cell; and/or (c) contacting a stem cell with a Cas protein or a nucleic acid sequence encoding the Cas protein and a third pair of ribonucleic acids having sequences selected from the group consisting of SEQ ID NOs: 81240-85644, thereby editing the B2M gene to reduce or eliminate B2M surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 36353-81239, thereby editing the NLRC5 gene to reduce or eliminate NLRC5 surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 5184-36352, thereby editing the CIITA gene to reduce or eliminate CIITA surface expression and/or activity in the cell.

Also disclosed are methods for producing hypoimmunogenic stem cells, the method comprising contacting a stem cell with a Cas protein or a nucleic acid sequence encoding the Cas protein and a first ribonucleic acid having a sequence selected from the group consisting of SEQ ID NOs: 81240-85644, thereby editing the B2M gene to reduce or eliminate B2M surface expression and/or activity in the cell.

Also disclosed herein are methods for producing hypo-immunogenic stem cells, the method comprising: (a) contacting a stem cell with a Cas protein or a nucleic acid sequence encoding the Cas protein and a first ribonucleic acid having a sequence selected from the group consisting of SEQ ID NOs: 36353-81239, thereby editing the NLRC5 gene to reduce or eliminate NLRC5 surface expression and/or activity in the cell; (b) contacting a stem cell with a Cas protein or a nucleic acid sequence encoding the Cas protein and a second ribonucleic acid having a sequence selected from the group consisting of SEQ ID NOs: 5184-36352, thereby editing the CIITA gene to reduce or eliminate CIITA surface expression and/or activity in the cell; and/or (c) contacting a stem cell with a Cas protein or a nucleic acid sequence encoding the Cas protein and a third ribonucleic acid having a sequence selected from the group consisting of SEQ ID NOs: 81240-85644, thereby editing the B2M gene to reduce or eliminate B2M surface expression and/or activity in the cell.

Also disclosed herein are hypoimmunogenic stem cells comprising a modified genome comprising a first genomic modification in which the NLRC5 gene has been edited to reduce or eliminate NLRC5 surface expression and/or activity in the cell by contacting the cell with a Cas protein or a nucleic acid encoding a Cas protein and a ribonucleic acid having a sequence selected from the group consisting of SEQ ID NOs: 36353-81239.

Also disclosed are hypoimmunogenic stem cells comprising a modified genome comprising a first genomic modification in which the CIITA gene has been edited to reduce or eliminate CIITA surface expression and/or activity in the cell by contacting the cell with a Cas protein or a nucleic acid encoding a Cas protein and a ribonucleic acid having a sequence selected from the group consisting of SEQ ID NOs: 5184-36352.

Also disclosed are hypoimmunogenic stem cells comprising a modified genome comprising a first genomic modification in which the B2M gene has been edited to reduce or eliminate B2M surface expression and/or activity in the cell by contacting the cell with a Cas protein or a nucleic acid encoding a Cas protein and a ribonucleic acid having a sequence selected from the group consisting of SEQ ID NOs: 81240-85644.

Also disclosed herein are hypoimmunogenic stem cells comprising a modified genome comprising: (a) a first genomic modification in which the NLRC5 gene has been edited to reduce or eliminate NLRC5 surface expression and/or activity in the cell by contacting the cell with a Cas protein or a nucleic acid encoding a Cas protein and a ribonucleic acid having a sequence selected from the group consisting of SEQ ID NOs: 36353-81239; (b) a second genomic modification in which the CIITA gene has been edited to reduce or eliminate CIITA surface expression and/or activity in the cell by contacting the cell with a Cas protein or a nucleic acid encoding a Cas protein and a ribonucleic acid having a sequence selected from the group consisting of SEQ ID NOs: 5184-36352; and/or (c) a third genomic modification in which the B2M gene has been edited to reduce or eliminate B2M surface expression and/or activity in the cell by contacting the cell with a Cas protein or a nucleic acid encoding a Cas protein and a ribonucleic acid having a sequence selected from the group consisting of SEQ ID NOs: 81240-85644.

Also disclosed are hypoimmunogenic stem cells comprising a modified genome comprising a first genomic modification in which the NLRC5 gene has been edited to delete a first contiguous stretch of genomic DNA, thereby reducing or eliminating NLRC5 surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 36353-81239.

Also disclosed are hypoimmunogenic stem cells comprising a modified genome comprising a first genomic modification in which the CIITA gene has been edited to delete a first contiguous stretch of genomic DNA, thereby reducing or eliminating CIITA surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 5184-36352.

Also disclosed are hypoimmunogenic stem cells comprising a modified genome comprising a first genomic modification in which the B2M gene has been edited to delete a first contiguous stretch of genomic DNA, thereby reducing or eliminating B2M surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 81240-85644.

Also disclosed herein are hypoimmunogenic stem cells comprising a modified genome comprising: (a) a first genomic modification in which the NLRC5 gene has been edited to delete a first contiguous stretch of genomic DNA, thereby reducing or eliminating NLRC5 surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 36353-81239; (b) a second genomic modification in which the CIITA gene has been edited to delete a first contiguous stretch of genomic DNA, thereby reducing or eliminating CIITA surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 5184-36352; and/or (c) a third genomic modification in which the B2M gene has been edited to delete a first contiguous stretch of genomic DNA, thereby reducing or eliminating B2M surface expression and/or activity in the cell, wherein the first contiguous stretch of genomic DNA has been deleted by contacting the cell with a Cas protein or a nucleic acid encoding a Cas protein and a first pair of ribonucleic acids having sequences selected from the group consisting of SEQ ID NOs: 81240-85644.

The above discussed, and many other features and attendant advantages of the present inventions will become better understood by reference to the following detailed description of the invention.

BRIEF DESCRIPTION OF THE DRAWINGS

The patent or application file contains at least one drawing executed in color. Copies of this patent or patent application publication with color drawings will be provided by the Office upon request and payment of the necessary fee.

FIG. 2A graphically illustrates MHC-I and MHC-II surface molecules that define donor compatibility during organ transplant. FIG. 2B illustrates the HLA region 6p21.1-21.3.

FIG. 3A illustrates a model of the MHC-II enhanceosome. FIG. 3B depicts a model of the NLRC5 enhanceosome at the MHC-I promoter.

FIG. 5A depicts a time line of macrophage differentiation. FIG. 5B shows a bright-field image of stem cell-derived macrophages on day 5 of M-CSF medium. FIG. 5C shows MHC-II expression in induced macrophages, as assessed by qPCR 48 hrs. post stimulation with IFNγ, and evidences reduced MHC-II expression relative to wild-type cells. As illustrated in FIG. 5C, MHC-II expression can be efficiently abrogated by targeting the first coding exon of the CIITA gene depicted in FIGS. 10A-10B.

FIGS. 8A-8C demonstrate that proliferation of infiltrating CD8+ T cell indicates immune rejection. FIGS. 8A and 8B illustrate immunostaining of teratoma-infiltrating CD3+ lymphocytes. FIG. 8C illustrates co-staining of CD8 and Ki67, which is a proliferation marker, and highlights proliferating CD8+ T cells (white arrows). Nuclear DAPI staining is shown in blue.

FIG. 9A illustrates the NLRC5 locus. FIG. 9B shows targeting of the NLRC5 locus to abrogate NLRC5 expression. FIGS. 9C-9D illustrate reduced MHC-I expression in NLTC5$^{-/-}$ HLCs.

FIG. 10A depicts the CIITA locus. FIG. 10B shows the targeting of the CIITA locus to abrogate MHC-II expression.

FIGS. 11A-11C demonstrate that tolerogenic factors, such as PD-L1 and HLA-G, can be expressed from a safe harbor locus.

FIG. 12 shows an exemplary amino acid sequence of a Cas protein. Yellow highlights indicate Ruv-C-like domain. Underlining indicates HNH nuclease domain.

FIGS. 14A-14J demonstrates the targeting of HLA-A, HLA-B and HLA-C. FIG. 14A depicts an HLA-B and HLA-C knock-out strategy. Two short guide RNAs (sgRNAs) were designed upstream of the HLA-B locus and downstream of HLA-C, which allow excision of the HLA-B and HLA-C genes. sgRNA #1 and sgRNA #2 target the HLA-B upstream region, and sgRNA #3 and sgRNA #4 target HLA-C the downstream region. FIG. 14B shows that PCR screening confirms clone 1D as a homozygous knock-out clone. FIG. 14B includes a schematic showing the PCR verification strategy for successful deletion of HLA-B and HLA-C. Two pairs of wild-type (WT) primers were designed flanking each cutting site, with predicted amplicon sizes of 545 bp and 472 bp. Clone 1D was identified as a homozygous knock-out clone by the presence of about 680 bp PCR band generated with KO primers and the absence of bands using the two different sets of WT primers. Genomic DNA was isolated from the indicated targeted HuES8 clones. FIG. 14C provides a schematic showing sequence confirmation of HLA-B, HLA-C deletion in 1D KO clone. The sequencing results of 1D PCR product demonstrated successful deletion of HLA-B and HLA-C genes in HuES8. FIG. 14D shows that RT-PCR confirms the loss of HLA-B and HLA-C mRNA expression in HuES8 cells. RT-PCR with HLA-B and HLA-C specific primers demonstrated the mRNA expressions of HLA-B and HLA-C in clone 1D are eliminated. GAPDH, TOP1 and HPRT1 were used as internal controls. FIG. 14E provides a schematic showing sequence confirmation of HLA-B RT-PCR bands obtained from WT and clone 1D. WT and 1D RT-PCR products amplified with HLA-B primers were sequenced and identified as HLA-B and HLA-A mRNAs, respectively using BLAST. These results demonstrated that in the absence of the HLA-B gene, the HLA-B specific primers will amplify HLA-A mRNA in HuES8 clone 1D. FIG. 14F shows the karyotyping of HuES8 clone 1D by NanoString nCounter. HuES8 clone 1D displays a normal karyotype as assessed by NanoString nCounter set. FIG. 14G provides a schematic showing HLA-A knockout strategy using the dual sgRNA approach. The schematic shows the positions of the two sgRNAs (sgRNA #5 and sgRNA #6) that were designed to bind upstream and downstream of HLA-A. FIG. 14H shows the on-target cutting efficiency of HLA-A sgRNA using TIDE. The cutting efficiency of sgRNA #5 and sgRNA #6 was determined in 293T cells using TIDE. FIG. 14I demonstrates that PCR screening confirmed clone 4E as a heterozygous HLA-A knockout clone. PCR screening strategy confirmed deletion of HLA-A in HuES8. KO primers were designed with one primer annealing upstream and one primer annealing downstream of the cutting sites. Upon HLA-A deletion, the resulting amplicon is observed as 220 bp on a 2% agarose gel. Two pairs of WT primers were designed flanking each cutting site, with predicted amplicons sizes of 589 bp and 571 bp. Clone 4E was identified as heterozygous clone due to the presence of bands generated with KO primers and WT primers amplified from genomic DNA. FIG. 14J includes a schematic showing that sequencing confirms successful deletion of HLA-A in HuES8 cells. Sequencing of the PCR product amplified from genomic DNA of clone 4E using KO primers demonstrates successful deletion of HLA-A in HuES8.

Figure 15A:
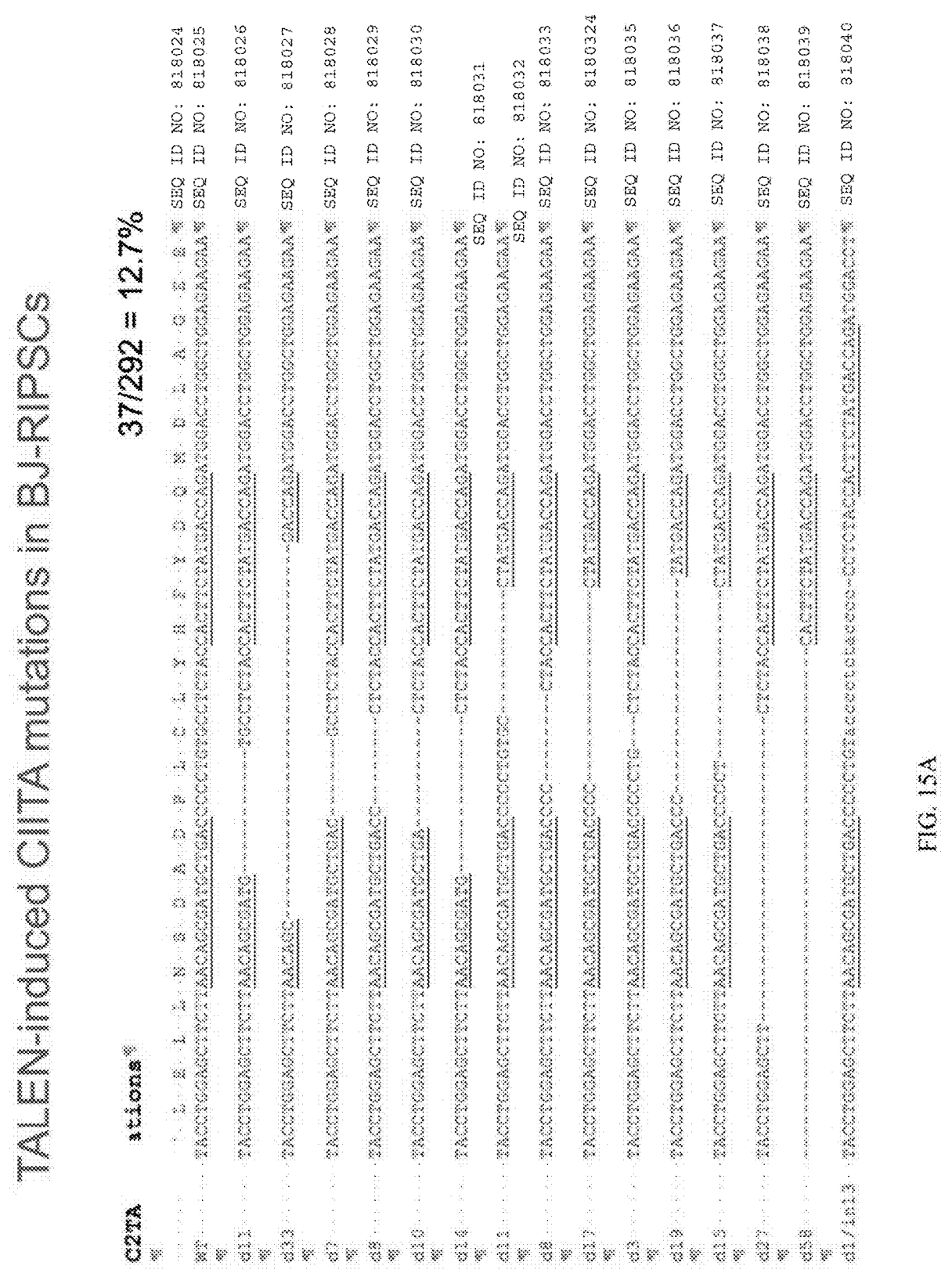
Figure 15B:
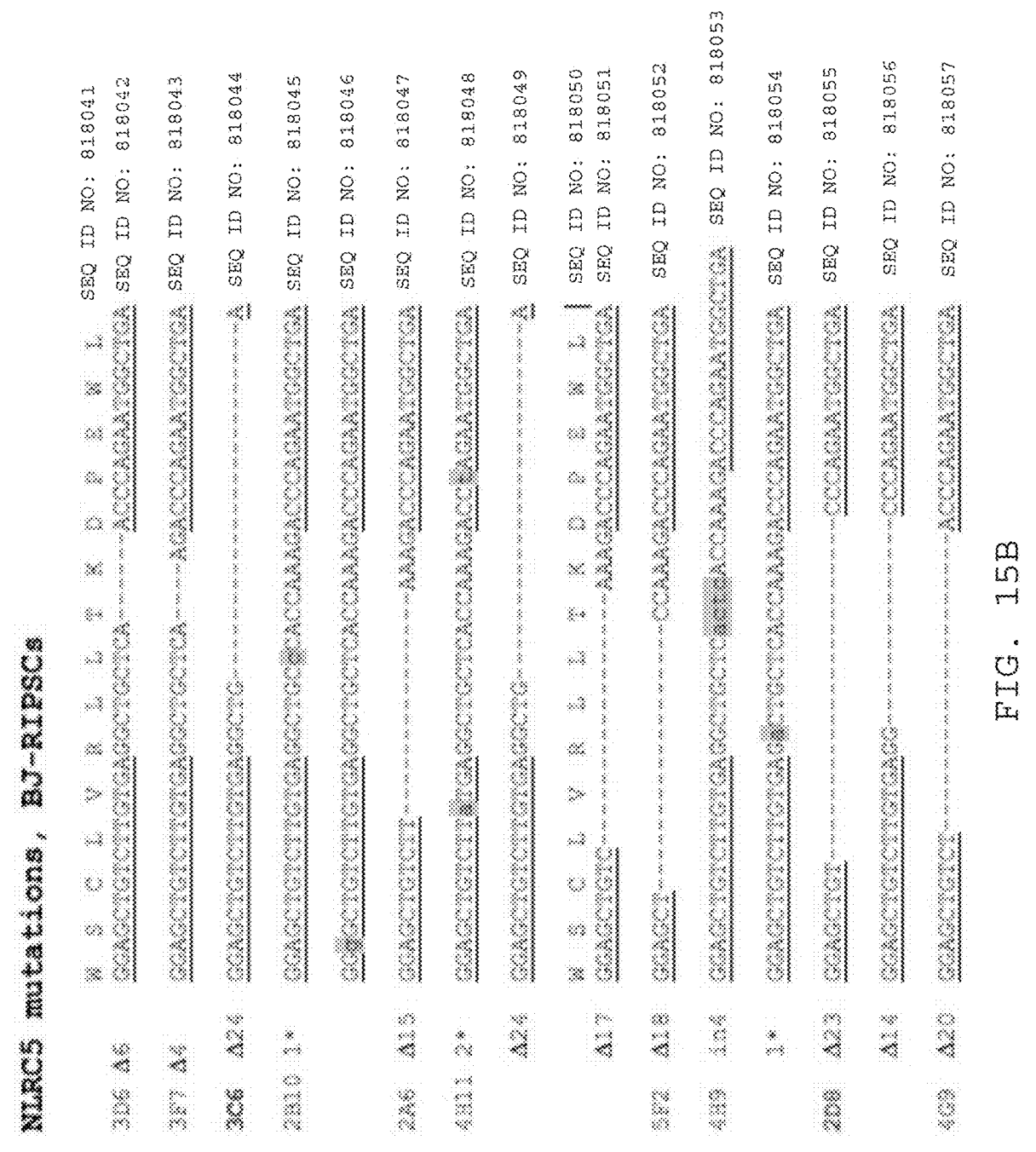
Figure 15D:
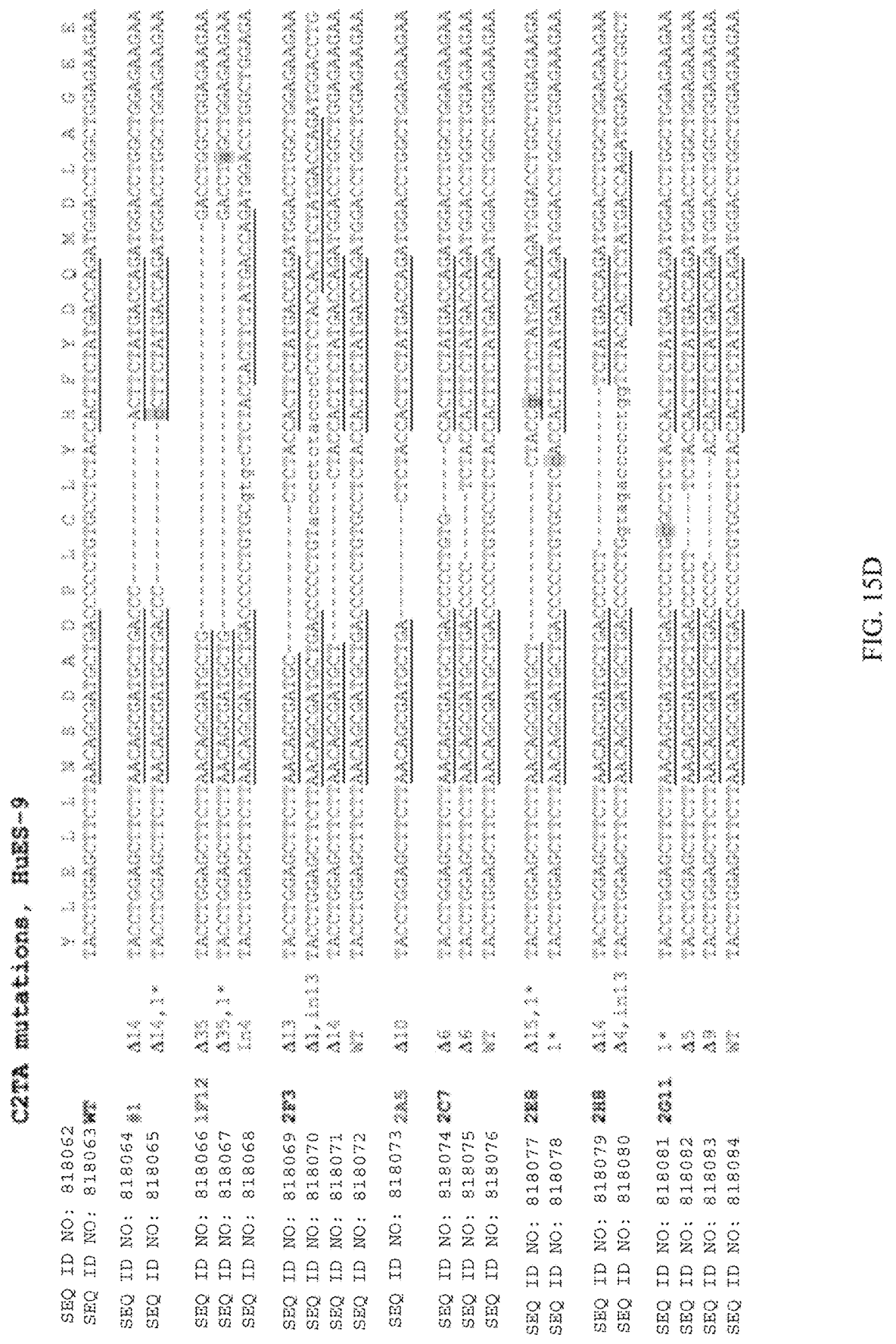

FIGS. 15A-15D show TALEN-induced CIITA and NLRC5 mutations in BJ-RIPSCs and HuES9 cells. FIG. 15A provides a schematic of TALEN-induced CIITA mutations in BJ-RIPSCs. FIG. 15B provides a schematic of TALEN-induced NLRC5 mutations in BJ-RIPSCs. FIG. 15C provides a schematic of TALEN-induced NLRC5 mutations in HuES9s. FIG. 15D provides a schematic of TALEN-induced CIITA mutations in HuES9s.

FIGS. 16A-16G demonstrate targeting of NLRC5 and CIITA utilizing a CRISPR system to achieve a reduction in MHC class I expression and complete loss of MHC class II expression. FIG. 16A shows reduced MHC-I expression in NLRC5−/− Thp1 cells, including a NLRC5 targeting strategy in Thp1 cells. The + indicates 48 hours of IFNγ stimulation. FIG. 16B provides schematics of multiple targeting strategies. FIG. 16B provides a schematic of targeting NLRC5 using CRISPR, a schematic of targeting B2M using CRISPR, a schematic of targeting CIITA using TALENs and a schematic of targeting CIITA using CRISPR. FIG. 16C shows reduced MHC class I expression in HuES9 cells following targeting with NLRC5 or B2M CRISPRs. The graph shows low basal MHC-I expression in stem cells. The MHC-I expression can be increased by IFNγ stimulation. About a 50% reduction of MHC-I expression occurs in IFNγ-treated NLRC5−/− cells. A complete loss of MHC-I surface expression is shown in B2M−/− cells. FIG. 15D shows a lentiviral transduction of Thp-1. A dual-vector lentiviral GeCKO system is used. The two component system includes Lenti-Cas9-Blasticidin, which acts to establish stable Thp-1 Cas9 cell line, and Lenti-Guide-puro, which acts to bring in the guide. FIG. 16E identifies various CRISPRs used for the lentiviral transduction of Thp-1. CRISPRs targeting CIITA, NLRC5 and IRF1 are provided. FIG. 16F shows that CIITA and NLRC5 act independently on MHC-II and MHC-I, respectively. Thp1 was transduced with lentivirus encoding NLRC5 and CIITA. A B2M CRISPR is used as a positive control. All cells were stimulated ON with 50U IFNγ to boost HLA expression. HLA-A2 1:200; DR 1:100. FIG. 16G shows targeting of IRF1 results in loss of MHC-II expression. Thp1, 10 days post CRISPR transduction. All cells were stimulated ON with 50U IFNγ. HLA-A2 1:200; DR 1:100.

FIGS. 17A-17K demonstrate targeting of IRF1 utilizing a CRISPR system to achieve reduced MHC class I expression in human pluripotent stem cells (HuES9) and Thp-1 cells. FIG. 17A shows a dual CRISPR strategy targeting the IRF1 locus. Three different CRISPRs are identified. FIG. 17B demonstrates the testing of different IRF1 guide combinations. Screening results of different guide combinations are provided. FIG. 17C demonstrates a 'dual guide strategy' for the targeted deletion of IRF1. Screening results of the dual guide strategy are provided. FIG. 17D provides a schematic showing sequence confirmation of IRF-1 CRISPR induced deletion. FIG. 17E provides the screening results of IRF-1 targeted HuES9 cells. The screening is of a dual CRISPR strategy using CRISPRs #2 and #3. The presence of the PCR band suggests successful targeting. FIG. 17F demonstrated reconfirmation of IRF-1 clones. Screening results using primers KYM07 and TM377 are provided. FIG. 17G demonstrates genotypes of IRF-1 clones. Screening results are provided. FIG. 17H provides a schematic showing sequence confirmation of IRF-1 CRISPR induced deletion in clone 12. FIG. 17I provides a schematic showing sequence confirmation of IRF-1 CRISPR induced deletion in clone 17. FIG. 17J provides a schematic showing sequence confirmation of IRF-1 CRISPR induced deletion in clone 21. FIG. 17K shows impaired MHC class I induction in IRF1−/− HuES9 clones following IFNγ treatment. P42 are WT; C7 are B2M KO; + identifies 48 hours IFNγ treatment.

FIGS. 18A-18H demonstrate targeting of RFX5, RFX-ANK and RFX-AP in 293T cells utilizing CRISPR results in reduced MHC class I expression. FIG. 18A demonstrates dual guide targeting of RFX5 in 293T cells. Combinations of four different CRISPRs were examined. FIG. 18B shows that the targeting of RFX5 results in reduced MHC class I expression. FIG. 18C demonstrates dual guide targeting of RFX-ANK in 293T cells. Combinations of four different CRISPRs were examined. FIG. 18D shows that the targeting of RFX-ANK results in reduced MHC class I expression. FIG. 18E shows that targeting RFX5 and RFX-ANK results in reduced MHC class I expression. FIG. 18F provides a bar graph showing that targeting RFX5 and RFX-ANK results in reduced MHC class I expression. FIG. 18G demonstrates dual guide targeting of RFX-AP in 293T cells. Combinations of four different CRISPRs were examined. FIG. 18H shows that the targeting of RFX-AP results in reduced MHC class I expression.

FIGS. 19A-19E demonstrate targeting of NFY-A, NFY-B and NFY-C utilizing CRISPR results in reduced MHC class I expression. FIG. 19A demonstrates dual guide targeting of NFY-A in 293T cells. Combinations of four different CRISPRs were examined. FIG. 19B demonstrates dual guide targeting of NFY-C in 293T cells. Combinations of four different CRISPRs were examined. FIG. 19C shows that the targeting of NFY-C and NFY-A results in reduced MHC class I expression. FIG. 19D demonstrates dual guide targeting of NFY-B in 293T cells. Combinations of four different CRISPRS were examined. FIG. 19E shows that the targeting of NFY-B results in reduced MHC class I expression.

FIGS. 20A-20D show that surface trafficking of MHC class I molecules can be suppressed by disrupting the TAP1 gene, an ER-resident peptide transporter. FIG. 20A shows TAP1 CRISPR expression reduces MHC-I surface expression in Jurkat T cells. Combinations of four different CRISPRs was examined. FIG. 20B demonstrates TAP1 CRISPR expression reduces MHC-I surface expression in Jurkat T cells. FIG. 20C demonstrates eliminating HLA surface expression in Jurkat (Cas9) T cells. The Jurkat cell line was established from the peripheral blood of a 14 year old having acute T cell leukemia by Schneider et al. FIG. 20D shows eliminating HLA surface expression in Jurkat (Cas9) T cells. The cells were treated with IFNγ for 48 hours.

FIGS. 21A-21D demonstrate the use of a CRISPR gRNA identified as an HLA Razor that allows simultaneous deletion of all MHC class I alleles by targeting a conserved region in the HLA genes. FIG. 21A provides a schematic showing the targeting of a conserved sequence found in all HLAs by CRISPR or TALENs using an HLA Razor. The two violet boxes indicate the binding sites for the panHLA TALEN pair. The blue arrow indicates the pan-HLA CRISPR tested; the PAM is boxed in blue. FIG. 21B shows the expression of pan-HLA TALENs in 293T and HuES9 cells 72 hours post transfection. FIG. 21C shows HLA-Razor CRISPR blunts MHC class I expression. The 293T cells were co-transfected with Cas9-GFP. The results are shown 72 hours post transfection. FIG. 21D provides a schematic showing a comparison of the activity of two different HLA Razors. Two HLA Razor guides are identified.

FIGS. 22A-22F show the results of a PD-L1 and HLA-G knock-in strategy. FIG. 22A provides a schematic showing PD-L1 and HLA-G knock-in strategy. WT primers and knock-in (KI) primers for clone screening were designed. The amplicon with WT primers is predicted as 488 bp, and the amplicons with KI primers are predicted as 403 bp and 915 bp. FIG. 22B depicts the design of the knock-in donor plasmid. The design of the knock-in donor plasmid shows that the reading frames of PD-L1 and HLA-G are linked by T2A and their expression is driven by a CAGGS promoter. Puromycin was used as a drug resistance marker following the SA-2A gene trap element. FIG. 22C demonstrates ectopic PD-L1 and HLA-G expression in 293T cells. The expression of PD-L1 and HLA-G were examined in the donor plasmid-transfected 293T cells by FACS analysis. APC-conjugated PD-L1 antibody and FITC-conjugated HLA-G antibody were used. FIG. 22D shows ectopic HLA-G expression in JEG-3 cells. Donor plasmid was transfected into an HLA-G−/− JEG-3 cell line, and ectopic HLA-G expression was examined by FACS analysis 48 hours post-transfection. A PE-conjugated HLA-G antibody (MEM/G9) was used to detect surface HLA-G surface expression. FIG. 22E provides PCR screening results that confirm clone 1G as a heterozygous KI clone for PD-L1/HLA-G. Clone 1G was identified as a heterozygous KI clone by the presence of bands using both WT primers and KI-specific primers amplified from genomic DNA of targeted HuES8 cells. FIG. 22F shows stable PD-L1 and HLA-G expression from a safe harbor locus in HuES8. The expression of PD-L1 was verified in HuES8 KI clone 1G by FACS analysis using an APC-conjugated PD-L1 antibody.

FIG. 24 demonstrates that deletion of TRAC and TRBC in HuES9 disrupts TCR expression. A dual guide RNA approach was used to introduce deletions into the TRAC and TRBC loci in HuES9 cells. TCRA wt band is 249 bp, and is 209 bp after deletion. TCRB wt band is 162 bp, and is 140 bp after deletion. Bands identified with a * are TCRB KO in HuES9 cells; bands identified with a  are TCRA KO in HuES9 cells; and bands identified with a * are TCRA KO in HuES9 B2M−/−CIITA−/− cells. TCRA KO in HuES9 B2M−/−CIITA−/− cells is a triple knock-out stem cell line for B2M−/−, CIITA−/− and TCR−/−. Upon differentiation into T cells this triple knock out stem cell line will be devoid of MHC-I, MHC-II and TCR surface expression.

FIGS. 25A-25D demonstrate targeting of CD274/B7-H1/PD-L1 in a variety of cell lines. FIG. 25A identifies an example of a CRISPR guide sequence that may be used when targeting CD274/B7-H1/PD-L1. CD274/B7-H1/PD-L1 knock out cell lines are identified. FIG. 25B shows the screening of targeted B7-H1 colonies in JEG-3 cells. The screening identified a CRISPR cutting efficiency of 22/265 or about 8.3%. FIG. 25C demonstrates the reconfirmation of 501 melanoma knock-out clones. FIG. 25D demonstrates the reconfirmation of MalMe melanoma knock-out clones.

FIG. 26A shows co-stimulatory/co-inhibitory molecules and their receptors on T cells. FIG. 26P demonstrates dual guide targeting of GITR in 293T cells. CRISPRs #1 and #3 were found to work.

FIG. 27 depicts various cell lines tested and with which targets the cells lines were tested. HuES8 and HuES9 are human ES cell lines. BJ-RiPSCs is an iPSC line. All other enhanceosome components not shown in the table (e.g., RFX and NFY) were only tested in HEK293T cells.

FIGS. 28A-28J provides that modified ES cells can be differentiated into various different cell types with reduced or absent HLA expression. FIG. 28A provides that the modified ES call can be differentiated into Mesenchymal Progenitor Cells (MPCs), endothelial cells (ECs), macrophages, hepatocytes, beta-cells and neural progenitor cells (NPCs). FIG. 28B shows reduced MHC-I expression in NLRC5−/− human ES cells. There is low basal MHC-I expression in stem cells. The expression can be increased by IFNγ stimulation. About a 50% reduction in MHC-I expression occurs in IFNγ-treated NLRC5−/− cells. FIG. 28C shows reduced MHC-I expression in NLRC5−/− human mesenchymal progenitor cells (MPCs). A comparison is provided of HuES9 cells and MPCs. FIG. 28D shows reduced MHC-I expression in stem cell-derived NLRC5−/− endothelial cells (ECs). FIG. 28E demonstrates that ECs exhibit similar differentiation efficiency. FIG. 28F shows loss of HLA expression in B2M−/−CIITA−/−ECs. N=3, 48 hours of IFNγ treatment. FIG. 28G demonstrates reduced MHC class I expression in NLRC5−/− hepatocyte-like cells. A schematic is included demonstrating the targeting strategy and CRISPR design. The HLCs are derived from BJ-RiPSCs, day 7 of final hepatocyte differentiation. FIG. 28H demonstrates that mutation of CIITA abrogates MHC class II expression in hESC-derived macrophages. A schematic is included demonstrating the targeting strategy and CRISPR design. The HuES9-derived iMΦs, day 5 M-CSF. FIG. 28I shows neural progenitor cell (NPC) differentiation. B2M−/−CIITA−/−HuES9 form Nestin+ neural rosettes (white arrow). FIG. 28J demonstrates the adaptation of stem cells to spin culture for beta-cell differentiation. This is the first step in the beta-cell differentiation protocol.

FIG. 29A-29B provide in vivo data in a teratoma model. FIG. 29A provides that 'hypoimmunogenic' DKO cell lines were generated. The cell lines generated include WT HuES9, NLRC5−/−CIITA−/− HuES9 and B2M−/−CIITA−/− HuES9. The WT cell lines exhibited MHC-I and MHC-II expression. The NLRC5−/−CIITA−/− cells lines exhibited reduced MHC-I expression and no MHC-II expression. The B2M−/−CIITA−/− cell lines exhibited no MHC-I and MHC-II expression. FIG. 29B shows improved engraftment of genome-edited stem cells in humanized mice. The three cell lines tested were WT HuES9, NLRC5−/−CIITA−/− HuES9 and B2M−/−CIITA−/− HuES9.

FIGS. 30A-30D demonstrates CRISPR targeting of B7-H3 in JEG-3 cells. FIG. 30A provides a CRISPR guide sequence for targeting B7-H3. FIG. 30B shows a screening of targeted B7-H3 colonies in JEG-3 cells. The CRISPR cutting efficiency is shown to be 15/80 or about 18.7%. FIG. 30C shows confirmation of B7-H3 knock-outs through sequencing. FIG. 30D demonstrates loss of B7-H3 surface expression in targeted JEG3 clones.

FIG. 32A is a schematic of gRNAs targeting B2M. FIG. 32B is a histogram of B2M surface expression in HEK293T cells. FIG. 32C shows B2M deletion efficiency with various gRNAs in HEK293T cells; n=3 (mean±SEM). FIG. 32D is a schematic of gRNAs targeting CCR5. Orange and green arrows represent primer pairs used to amplify the region for analysis. FIG. 32E shows results of Surveyor assays of each gRNA targeting CCR5 in K562 cells. % InDels is indicated under each guide. FIG. 32F illustrates B2M deletion efficiency of selected gRNAs in primary CD4+ T cells in comparison to 293T cells; n=6 (mean±SEM). FIG. 32G shows results of surveyor assay of crCCR5_A and crCCR5_B targeting CCR5 in K562 cells and HSPCs. FIG. 32H illustrates clonal deletion efficiency of crCCR5_A and crCCR5_B targeting of CCR5 in HSPCs (n=2) as determined by Sanger sequencing. (Note: crB2M_14 is not depicted in panel A schematic, as it is located 20 Kb downstream of coding sequence.).

FIGS. 33A-33E demonstrate an evaluation of on target mutational efficiencies of various gRNAs targeting B2M. FIG. 33A shows B2M deletion efficiency for all gRNAs targeting B2M locus in HEK293T cells as measured by flow cytometry. Pooled data from 3 independent experiments shown as mean±SEM. FIG. 33B shows B2M deletion efficiencies of selected guides in HEK293T cells, measured as % InDels by CEL Surveyor assay. FIG. 33C is a comparison of B2M surface expression in HEK293T cells and primary CD4+ T cells when transfected with Cas9 and guide crB2M_13. FIG. 33D shows B2M deletion efficiency for selected guides targeting the B2M locus in primary CD4+ T-cells, as measured by flow cytometry. FIG. 33E shows B2M deletion efficiencies of selected guides in primary CD4+ T cells, measured as % InDels by CEL Surveyor assay.

FIG. 34A is a schematic of dual gRNA approach for targeting the B2M locus. gRNA pairs are in red. The offset in base pairs between Cas9 sites for each gRNA combination (right panel). FIG. 34B shows B2M deletion efficiency in CD4+ T cells for 6 dual gRNA combinations (n=3; mean±SEM). FIG. 34C is a FACS plots showing loss of B2M expression of either crB2M_13 or crB2M_8 alone or in combination in primary CD4+ T cells. FIG. 34D is a schematic of dual gRNA approach for targeting CCR5. gRNA pairs are shown in red. Orange and green arrowheads represent primer pairs used to amplify the region. The offset between the Cas9 sites of each gRNA pair (right panel). FIG. 34E is a gel electrophoresis image of CD34+ HSPCs derived clones targeted with crCCR5_D+Q analyzed by PCR. Note the deletion of the 205 bp region between the two gRNA cutting sites (top panel; WT: wild type; ΔCCR5: deleted; green * denotes a WT clone; orange * denotes a heterozygous clone; and red * denotes a homozygous deleted clone). Clonal deletion efficiency for three dual gRNA combinations targeting CCR5 in CD34+ HSPCs (n=4; % mean±SEM; bottom panel).

FIGS. 35A-35G demonstrate the targeting efficiency of dual gRNA combinations. FIG. 35A shows B2M deletion efficiency for 6 dual gRNA combinations from three independent donors as measured by flow cytometry. FIG. 35B are FACS plots showing loss of MHC class I surface expression (bottom panel) following B2M deletion (top panel). FIG. 35C is a schematic of the single cell nested PCR strategy for the B2M locus (left panel), black and gray arrowheads: control primer pairs, orange and green arrowheads: primer pairs flanking targeting region. % B2M null single cells is shown (right panel, n=301). FIG. 35D is a Sanger sequencing chromatogram showing predicted deletion of targeted region at B2M locus. FIG. 35E shows clonal CCR5 deletion efficiency for three dual gRNA combinations in CD34+ HSPC-mPB obtained from multiple donors. DNA isolated from individual colony was analyzed by PCR and gel electrophoresis. FIG. 35F is a schematic of the single cell nested PCR strategy (left panel) for determining deletion of CCR5 in primary CD4+ T cells. % CCR5 null single cells is shown (right panel, n=363). FIG. 35G shows Sanger sequencing chromatogram shows predicted deletion at targeted region.

FIG. 39 depicts Cpf1 crRNA design and cloning information.

FIGS. 40A-40G demonstrate generation and characterization of B2M KO JEG3 cells using TALENs. FIG. 40A depicts a design of B2M TALEN and induced mutations. FIG. 40B depicts an analysis of B2M at the transcript and protein levels. FIG. 40C demonstrates an analysis of B2M at the surface expression level. FIG. 40D demonstrates that AB2M clones are devoid of MHC-I surface expression. FIG. 40E demonstrates that AB2M clones are devoid of HLA-G surface expression. FIG. 40F demonstrates that AB2M clones are devoid of HLA-C surface expression. FIG. 40G demonstrates that AB2M clones are devoid of HLA-E surface expression.

FIG. 41 is a schematic illustration depicting the location of the CRISPR gRNAs targeting the first coding exons of the TCRalpha and TCRbeta chains, respectively.

FIG. 42A depicts the results of a FACS analysis employing an anti-CD3 antibody, which reveals successful TCR deletion in Jurkat T cells that stably express the Cas9 nuclease. FIG. 42B shows the results of a SURVEYOR™ assay confirming cutting at the TCRa and TCRb loci.

FIG. 43A shows the results of a SURVEYOR™ assay demonstrating CRISPR cutting at the TCRa and TCRb loci in CD3+ T cells obtained from two independent donors. FIG. 43B shows the loss of TCR surface expression demonstrated by FACS analysis.

FIG. 44A is a schematic representation of the PD-1 targeting strategy. FIG. 44B demonstrates that the double CRISPR strategy results in cutting by both CRISPRs targeting the PD-1 locus in HEK293T cells. FIG. 44C is a schematic representation of sequencing, which confirmed the predicted deletion in the PD-1 locus after transfection of two CRISPRs targeting the PD-1 gene (PDCD1).

FIG. 45A shows the results of FACS analysis, demonstrating the loss of PD-1 expression in activated Jurkat T cells. FIG. 45B shows the results of a SURVEYOR™ assay confirming cutting at the PD-1 locus.

FIG. 46A is a schematic representation of the CTLA4 targeting strategy. FIG. 46B demonstrates that the double CRISPR strategy results in cutting by both CRISPRs targeting the CTLA4 locus in HEK293T cells. FIG. 46C is a schematic representation of sequencing, which confirmed the predicted deletion in the CTLA4 locus after transfection of two CRISPRs targeting the CTLA4 gene (CTLA4).

FIG. 47A demonstrates that the double CRISPR strategy results in cutting by both CRISPRs targeting the CTLA4 locus in Jurkat T cells. FIG. 47B shows the results of a SURVEYOR™ assay, demonstrating successful cutting by both CTLA4 CRISPRs in Jurkat T cells.

Figure 1:
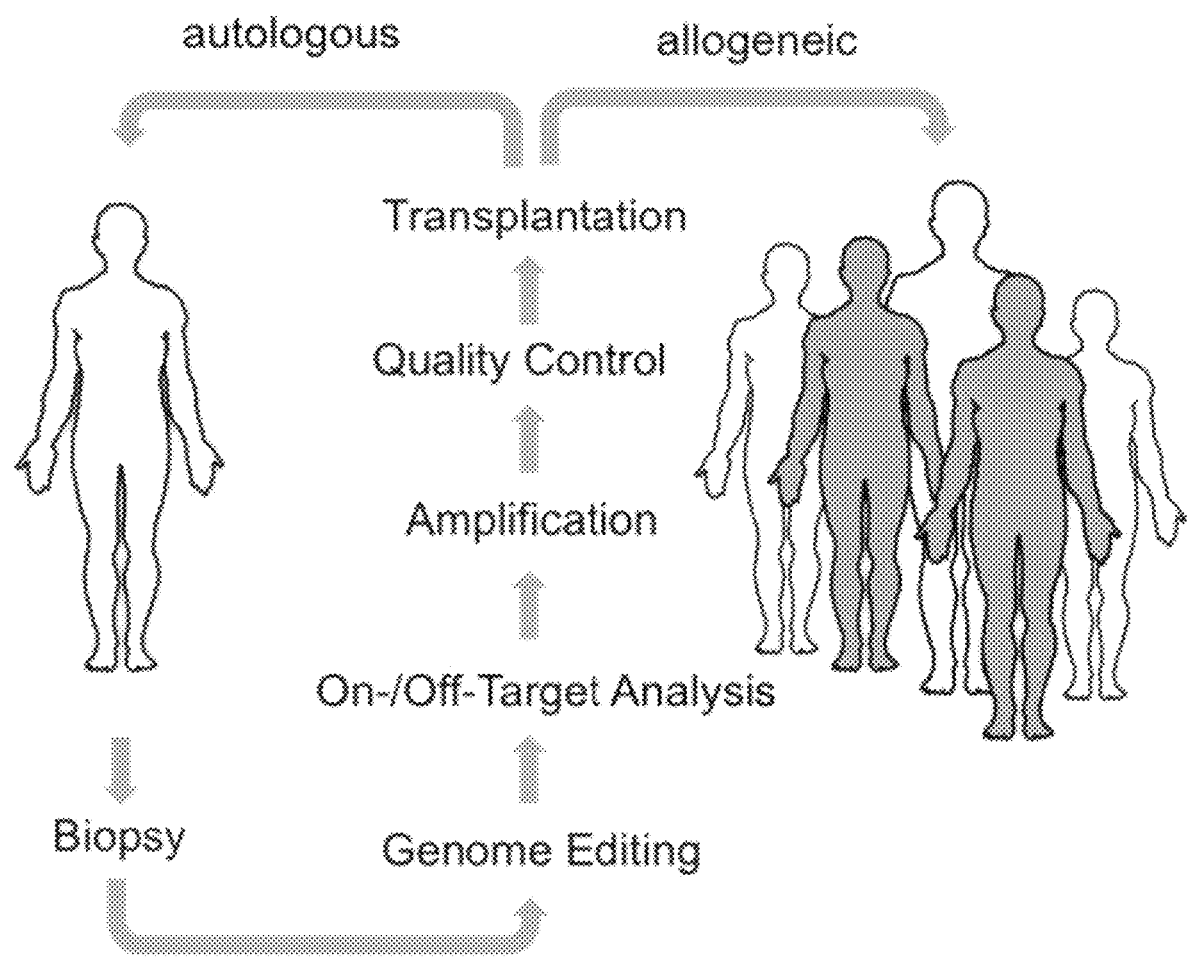
FIG. 1 illustrates the promise of regenerative medicine.

The following Tables 8-54 are submitted herewith as Appendices 1-47, respectively:
- Table 8—exemplary gRNA sequences useful for targeting HLA-A;
- Table 9—exemplary gRNA sequences useful for targeting HLA-B;
- Table 10—exemplary gRNA sequences useful for targeting HLA-C;
- Table 11—exemplary gRNA sequences useful for targeting RFX-ANK;
- Table 12—exemplary gRNA sequences useful for targeting CIITA;
- Table 13—exemplary gRNA sequences useful for targeting NFY-A;
- Table 14—exemplary gRNA sequences useful for targeting NLRC5;
- Table 15—exemplary gRNA sequences useful for targeting B2M;
- Table 16—exemplary gRNA sequences useful for targeting RFX5;
- Table 17—exemplary gRNA sequences useful for targeting RFX-AP;
- Table 18—exemplary gRNA sequences useful for targeting HLA-G;
- Table 19—exemplary gRNA sequences useful for targeting HLA-E;
- Table 20—exemplary gRNA sequences useful for targeting NFY-B;
- Table 21—exemplary gRNA sequences useful for targeting PD-L1;
- Table 22—exemplary gRNA sequences useful for targeting NFY-C;
- Table 23—exemplary gRNA sequences useful for targeting IRF1;
- Table 24—exemplary gRNA sequences useful for targeting TAP1;
- Table 25—exemplary gRNA sequences useful for targeting GITR;
- Table 26—exemplary gRNA sequences useful for targeting 41BB;
- Table 27—exemplary gRNA sequences useful for targeting CD28;
- Table 28—exemplary gRNA sequences useful for targeting B7-1;
- Table 29—exemplary gRNA sequences useful for targeting CD47;
- Table 30—exemplary gRNA sequences useful for targeting B7-2;
- Table 31—exemplary gRNA sequences useful for targeting OX40;
- Table 32—exemplary gRNA sequences useful for targeting CD27;
- Table 33—exemplary gRNA sequences useful for targeting HVEM;
- Table 34—exemplary gRNA sequences useful for targeting SLAM;
- Table 35—exemplary gRNA sequences useful for targeting CD226;
- Table 36—exemplary gRNA sequences useful for targeting ICOS;
- Table 37—exemplary gRNA sequences useful for targeting LAG3;
- Table 38—exemplary gRNA sequences useful for targeting TIGIT;
- Table 39—exemplary gRNA sequences useful for targeting TIM3;
- Table 40—exemplary gRNA sequences useful for targeting CD160;
- Table 41—exemplary gRNA sequences useful for targeting BTLA;
- Table 42—exemplary gRNA sequences useful for targeting CD244;
- Table 43—exemplary gRNA sequences useful for targeting LFA-1;
- Table 44—exemplary gRNA sequences useful for targeting ST2;
- Table 45—exemplary gRNA sequences useful for targeting HLA-F;
- Table 46—exemplary gRNA sequences useful for targeting CD30;
- Table 47—exemplary gRNA sequences useful for targeting B7-H3;
- Table 48—exemplary gRNA sequences useful for targeting VISTA;
- Table 49—exemplary gRNA sequences useful for targeting TLT;
- Table 50—exemplary gRNA sequences useful for targeting PD-L2;
- Table 51—exemplary gRNA sequences useful for targeting FOXP3;
- Table 52—exemplary gRNA sequences useful for targeting CD58;
- Table 53—exemplary gRNA sequences useful for targeting CD2; and
- Table 54—exemplary gRNA sequences useful for targeting HELIOS.

The material submitted herewith in electronic (.txt) form and comprising Appendices 1-47 (Tables 8-54, respectively) is incorporated herein by reference, specifically:
- Appendix 1 (file name: Table8.txt; date created: May 9, 2016; file size: 223,026 bytes);
- Appendix 2 (file name: Table9.txt; date created: May 9, 2016; file size: 327,895 bytes);
- Appendix 3 (file name: Table10.txt; date created: May 9, 2016; file size: 280,849 bytes);
- Appendix 4 (file name: Table11.txt; date created: May 9, 2016; file size: 998,046 bytes);
- Appendix 5 (file name: Table12.txt; date created: May 9, 2016; file size 4,717,823 bytes);
- Appendix 6 (file name: Table13.txt; date created: May 9, 2016; file size 2,813,407 bytes);
- Appendix 7 (file name: Table14.txt; date created: May 9, 2016; file size 6,568,742 bytes);
- Appendix 8 (file name: Table15.txt; date created: May 9, 2016; file size 728,685 bytes);
- Appendix 9 (file name: Table16.txt; date created: May 9, 2016; file size 766,106 bytes);
- Appendix 10 (file name: Table17.txt; date created: May 9, 2016; file size 874,435 bytes);
- Appendix 11 (file name: Table18.txt; date created: May 9, 2016; file size 232,536 bytes);
- Appendix 12 (file name: Table19.txt; date created: May 9, 2016; file size 539,932 bytes);
- Appendix 13 (file name: Table20.txt; date created: May 9, 2016; file size 2,256,084 bytes);
- Appendix 14 (file name: Table21.txt; date created: May 9, 2016; file size 1,303,081 bytes);
- Appendix 15 (file name: Table22.txt; date created: May 9, 2016; file size 6,821,299 bytes);
- Appendix 16 (file name: Table23.txt; date created: May 9, 2016; file size 1,095,386 bytes);

Appendix 17 (file name: Table24.txt; date created: May 9, 2016; file size 941,281 bytes);
Appendix 18 (file name: Table25.txt; date created: May 9, 2016; file size 378,368 bytes);
Appendix 19 (file name: Table26.txt; date created: May 9, 2016; file size 2,706,509 bytes);
Appendix 20 (file name: Table27.txt; date created: May 9, 2016; file size 3,578,977 bytes);
Appendix 21 (file name: Table28.txt; date created: May 9, 2016; file size 3,638,039 bytes);
Appendix 22 (file name: Table29.txt; date created: May 9, 2016; file size 5,083,645 bytes);
Appendix 23 (file name: Table30.txt; date created: May 9, 2016; file size 4,481,092 bytes);
Appendix 24 (file name: Table31.txt; date created: May 9, 2016; file size 393,567 bytes);
Appendix 25 (file name: Table32.txt; date created: May 9, 2016; file size 675,503 bytes);
Appendix 26 (file name: Table33.txt; date created: May 9, 2016; file size 1,002,258 bytes);
Appendix 27 (file name: Table34.txt; date created: May 9, 2016; file size 454,540 bytes);
Appendix 28 (file name: Table35.txt; date created: May 9, 2016; file size 10,463,522 bytes);
Appendix 29 (file name: Table36.txt; date created: May 9, 2016; file size 2,755,910 bytes);
Appendix 30 (file name: Table37.txt; date created: May 9, 2016; file size 733,191 bytes);
Appendix 31 (file name: Table38.txt; date created: May 9, 2016; file size 1,674,331 bytes);
Appendix 32 (file name: Table39.txt; date created: May 9, 2016; file size 2,622,419 bytes);
Appendix 33 (file name: Table40.txt; date created: May 9, 2016; file size 2,049,613 bytes);
Appendix 34 (file name: Table41.txt; date created: May 9, 2016; file size 4,016,813 bytes);
Appendix 35 (file name: Table42.txt; date created: May 9, 2016; file size 4,177,884 bytes);
Appendix 36 (file name: Table43.txt; date created: May 9, 2016; file size 4,326,759 bytes);
Appendix 37 (file name: Table44.txt; date created: May 9, 2016; file size 1,007,674 bytes);
Appendix 38 (file name: Table45.txt; date created: May 9, 2016; file size 1,690,144 bytes);
Appendix 39 (file name: Table46.txt; date created: May 9, 2016; file size 5,427,706 bytes);
Appendix 40 (file name: Table47.txt; date created: May 9, 2016; file size 3,510,941 bytes);
Appendix 41 (file name: Table48.txt; date created: May 9, 2016; file size 3,043,135 bytes);
Appendix 42 (file name: Table49.txt; date created: May 9, 2016; file size 274,899,026 bytes);
Appendix 43 (file name: Table50.txt; date created: May 9, 2016; file size 7,273,026 bytes);
Appendix 44 (file name: Table51.txt; date created: May 9, 2016; file size 2,336,524 bytes);
Appendix 45 (file name: Table52.txt; date created: May 9, 2016; file size 274,899,026 bytes);
Appendix 46 (file name: Table53.txt; date created: May 9, 2016; file size 1,820,108 bytes); and
Appendix 47 (file name: Table54.txt; date created: May 9, 2016; file size 17,165,777 bytes).

DETAILED DESCRIPTION OF THE INVENTION

Recent advances in stem cell biology have made it possible to contemplate the use of a subject's own cells as an unlimited source for transplantation, as generally depicted, for example, in FIG. 1. Unfortunately, genome editing and the generation of induced pluripotent stem cells (iPSCs) followed by the differentiation of such iPSCs remains a costly, time consuming and highly variable process, with regards to pluripotency, epigenetic status, capacity for differentiation, and genomic stability. Moreover, changes occurring during genome editing and prolonged culturing have been found to trigger an adaptive immune response, resulting in immune rejection of even autologous stem cell-derived transplants. To overcome the problem of a subject's immune rejection of stem cell-derived transplants, the present inventors have developed and disclose herein a universal donor stem cell that represents a viable source for any transplantable cell type. Advantageously, the universal stem cells disclosed herein are not rejected by the recipient subject's immune system, regardless of the subject's genetic make-up.

The inventions disclosed herein employ genome editing technologies (e.g., the CRISPR/Cas or TALEN systems) to reduce or eliminate expression of critical immune genes (e.g., by deleting genomic DNA of critical immune genes) or, in certain instances, insert tolerance-inducing factors, in human ES cells and iPSCs, rendering them and the differentiated cells prepared therefrom hypoimmunogenic and less prone to immune rejection by a subject into which such cells are transplanted. As used herein to characterize a cell, the term "hypoimmunogenic" generally means that such cell is less prone to immune rejection by a subject into which such cells are transplanted. For example, relative to an unaltered wild-type cell, such a hypoimmunogenic cell may be about 2.5%, 5%, 10%, 20%, 30%, 40%, 50%, 60%, 70%, 80%, 90%, 95%, 97.5%, 99% or more less prone to immune rejection by a subject into which such cells are transplanted. In some aspects, genome editing technologies (e.g., the CRISPR/Cas or TALEN systems) are used to modulate (e.g., reduce or eliminate) the expression of MHC-I and MHC-II genes.

In certain embodiments, the inventions disclosed herein relate to a stem cell, the genome of which has been altered to reduce or delete critical components of HLA expression. Similarly, in certain embodiments, the inventions disclosed herein relate to a stem cell, the genome of which has been altered to insert one or more tolerance inducing factors. The present invention contemplates altering target polynucleotide sequences in any manner which is available to the skilled artisan, for example, utilizing a TALEN or a CRISPR/Cas system. Such CRISPR/Cas systems can employ a variety of Cas proteins (Haft et al. PLoS Comput Biol. 2005; 1(6)e60). In some embodiments, the CRISPR/Cas system is a CRISPR type I system. In some embodiments, the CRISPR/Cas system is a CRISPR type II system. In some embodiments, the CRISPR/Cas system is a CRISPR type V system. It should be understood that although examples of methods utilizing CRISPR/Cas (e.g., Cas9 and Cpf1) and TALEN are described in detail herein, the invention is not limited to the use of these methods/systems. Other methods of targeting polynucleotide sequences to reduce or ablate expression in target cells known to the skilled artisan can be utilized herein.

The present inventions contemplate altering, e.g., modifying or cleaving, target polynucleotide sequences in a cell for any purpose, but particularly such that the expression or activity of the encoded product is reduced or eliminated. For example, CRISPR/Cas systems may be used to target transcriptional regulators of antigen presentation to produce a hypoimmunogenic stem cell. In some embodiments, the target polynucleotide sequence in a cell (e.g., ES cells or iPSCs) is altered to produce a mutant cell. As used herein, a "mutant cell" generally refers to a cell with a resulting genotype that differs from its original genotype or the wild-type cell. In some instances, a "mutant cell" exhibits a mutant phenotype, for example when a normally functioning stem gene is altered using the CRISPR/Cas systems. In some embodiments, the target polynucleotide sequence in a cell is altered to correct or repair a genetic mutation (e.g., to restore a normal phenotype to the cell). In some embodiments, the target polynucleotide sequence in a cell is altered to induce a genetic mutation (e.g., to disrupt the function of a gene or genomic element).

In some embodiments, the alteration is an indel. As used herein, "indel" refers to a mutation resulting from an insertion, deletion, or a combination thereof. As will be appreciated by those skilled in the art, an indel in a coding region of a genomic sequence will result in a frameshift mutation, unless the length of the indel is a multiple of three. In some embodiments, the alteration is a point mutation. As used herein, "point mutation" refers to a substitution that replaces one of the nucleotides. A CRISPR/Cas system can be used to induce an indel of any length or a point mutation in a target polynucleotide sequence.

In some embodiments, the alteration results in a knock out of the target polynucleotide sequence or a portion thereof. For example, knocking out a target polynucleotide sequence in a cell can be performed in vitro, in vivo or ex vivo for both therapeutic and research purposes. Knocking out a target polynucleotide sequence in a cell can be useful for treating or preventing a disorder associated with expression of the target polynucleotide sequence (e.g., by knocking out a mutant allele in a cell ex vivo and introducing those cells comprising the knocked out mutant allele into a subject).

As used herein, "knock out" includes deleting all or a portion of the target polynucleotide sequence in a way that interferes with the function of the target polynucleotide sequence or its expression product.

In some embodiments, the alteration results in reduced expression of the target polynucleotide sequence. The terms "decrease," "reduced," "reduction," and "decrease" are all used herein generally to mean a decrease by a statistically significant amount. However, for avoidance of doubt, "decreased," "reduced," "reduction," "decrease" includes a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (i.e. absent level as compared to a reference sample), or any decrease between 10-100% as compared to a reference level.

The terms "increased," "increase" or "enhance" or "activate" are all used herein to generally mean an increase by a statically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The term "statistically significant" or "significantly" refers to statistical significance and generally means a two standard deviation (2SD) below normal, or lower, concentration of the marker. The term refers to statistical evidence that there is a difference. It is defined as the probability of making a decision to reject the null hypothesis when the null hypothesis is actually true. The decision is often made using the p-value.

In some embodiments, the alteration is a homozygous alteration. In some embodiments, the alteration is a heterozygous alteration.

In some embodiments, the alteration results in correction of the target polynucleotide sequence from an undesired sequence to a desired sequence. CRISPR/Cas systems can be used to correct any type of mutation or error in a target polynucleotide sequence. For example, CRISPR/Cas systems can be used to insert a nucleotide sequence that is missing from a target polynucleotide sequence due to a deletion. CRISPR/Cas systems can also be used to delete or excise a nucleotide sequence from a target polynucleotide sequence due to an insertion mutation. In some instances, CRISPR/Cas systems can be used to replace an incorrect nucleotide sequence with a correct nucleotide sequence (e.g., to restore function to a target polynucleotide sequence that is impaired due to a loss of function mutation). CRISPR/Cas systems can alter target polynucleotides with surprisingly high efficiency. In certain embodiments, the efficiency of alteration is at least about 5%. In certain embodiments, the efficiency of alteration is at least about 10%. In certain embodiments, the efficiency of alteration is from about 10% to about 80%. In certain embodiments, the efficiency of alteration is from about 30% to about 80%. In certain embodiments, the efficiency of alteration is from about 50% to about 80%. In some embodiments, the efficiency of alteration is greater than or equal to about 80%. In some embodiments, the efficiency of alteration is greater than or equal to about 85%. In some embodiments, the efficiency of alteration is greater than or equal to about 90%, about 91%, about 92%, about 93%, about 94%, about 95%, about 96%, about 97%, about 98%, or about 99%. In some embodiments, the efficiency of alteration is equal to about 100%.

In some embodiments, the target polynucleotide sequence is a genomic sequence. In some embodiments, the target polynucleotide sequence is a human genomic sequence. In some embodiments, the target polynucleotide sequence is a mammalian genomic sequence. In some embodiments, the target polynucleotide sequence is a vertebrate genomic sequence.

In some embodiments, CRISPR/Cas systems include a Cas protein or a nucleic acid sequence encoding the Cas protein and at least one to two ribonucleic acids (e.g., gRNAs) that are capable of directing the Cas protein to and hybridizing to a target motif of a target polynucleotide sequence. In some embodiments, CRISPR/Cas systems include a Cas protein or a nucleic acid sequence encoding the Cas protein and a single ribonucleic acid or at least one pair of ribonucleic acids (e.g., gRNAs) that are capable of directing the Cas protein to and hybridizing to a target motif of a target polynucleotide sequence. As used herein, "protein" and "polypeptide" are used interchangeably to refer to a series of amino acid residues joined by peptide bonds (i.e., a polymer of amino acids) and include modified amino acids (e.g., phosphorylated, glycated, glycosolated, etc.) and amino acid analogs. Exemplary polypeptides or proteins include gene products, naturally occurring proteins, homologs, paralogs, fragments and other equivalents, variants, and analogs of the above.

In some embodiments, a Cas protein comprises one or more amino acid substitutions or modifications. In some embodiments, the one or more amino acid substitutions comprise a conservative amino acid substitution. In some instances, substitutions and/or modifications can prevent or reduce proteolytic degradation and/or extend the half-life of the polypeptide in a cell. In some embodiments, the Cas protein can comprise a peptide bond replacement (e.g., urea, thiourea, carbamate, sulfonyl urea, etc.). In some embodiments, the Cas protein can comprise a naturally occurring amino acid. In some embodiments, the Cas protein can comprise an alternative amino acid (e.g., D-amino acids, beta-amino acids, homocysteine, phosphoserine, etc.). In some embodiments, a Cas protein can comprise a modification to include a moiety (e.g., PEGylation, glycosylation, lipidation, acetylation, end-capping, etc.).

In some embodiments, a Cas protein comprises a core Cas protein. Exemplary Cas core proteins include, but are not limited to Cas1, Cas2, Cas3, Cas4, Cas5, Cas6, Cas7, Cas8 and Cas9. In some embodiments, a Cas protein comprises a Cas protein of an *E. coli* subtype (also known as CASS2). Exemplary Cas proteins of the *E. Coli* subtype include, but are not limited to Cse1, Cse2, Cse3, Cse4, and Cas5e. In some embodiments, a Cas protein comprises a Cas protein of the Ypest subtype (also known as CASS3). Exemplary Cas proteins of the Ypest subtype include, but are not limited to Csy1, Csy2, Csy3, and Csy4. In some embodiments, a Cas protein comprises a Cas protein of the Nmeni subtype (also known as CASS4). Exemplary Cas proteins of the Nmeni subtype include, but are not limited to Csn1 and Csn2. In some embodiments, a Cas protein comprises a Cas protein of the Dvulg subtype (also known as CASS1). Exemplary Cas proteins of the Dvulg subtype include Csd1, Csd2, and Cas5d. In some embodiments, a Cas protein comprises a Cas protein of the Tneap subtype (also known as CASS7). Exemplary Cas proteins of the Tneap subtype include, but are not limited to, Cst1, Cst2, Cas5t. In some embodiments, a Cas protein comprises a Cas protein of the Hmari subtype. Exemplary Cas proteins of the Hmari subtype include, but are not limited to Csh1, Csh2, and Cas5h. In some embodiments, a Cas protein comprises a Cas protein of the Apern subtype (also known as CASS5). Exemplary Cas proteins of the Apern subtype include, but are not limited to Csa1, Csa2, Csa3, Csa4, Csa5, and Cas5a. In some embodiments, a Cas protein comprises a Cas protein of the Mtube subtype (also known as CASS6). Exemplary Cas proteins of the Mtube subtype include, but are not limited to Csm1, Csm2, Csm3, Csm4, and Csm5. In some embodiments, a Cas protein comprises a RAMP module Cas protein. Exemplary RAMP module Cas proteins include, but are not limited to, Cmr1, Cmr2, Cmr3, Cmr4, Cmr5, and Cmr6.

In some embodiments, the Cas protein is a *Streptococcus pyogenes* Cas9 protein or a functional portion thereof. In some embodiments, the Cas protein is a *Staphylococcus aureus* Cas9 protein or a functional portion thereof. In some embodiments, the Cas protein is a *Streptococcus thermophilus* Cas9 protein or a functional portion thereof. In some embodiments, the Cas protein is a *Neisseria meningitides* Cas9 protein or a functional portion thereof. In some embodiments, the Cas protein is a *Treponema denticola* Cas9 protein or a functional portion thereof. In some embodiments, the Cas protein is Cas9 protein from any bacterial species or functional portion thereof. Cas9 protein is a member of the type II CRISPR systems which typically include a trans-coded small RNA (tracrRNA), endogenous ribonuclease 3 (rnc) and a Cas protein. Cas 9 protein (also known as CRISPR-associated endonuclease Cas9/Csn1) is a polypeptide comprising 1368 amino acids. An exemplary amino acid sequence of a Cas9 protein (SEQ ID NO: 1) is shown in FIG. 12. Cas 9 contains 2 enconuclease domains, including an RuvC-like domain (residues 7-22, 759-766 and 982-989) which cleaves target DNA that is noncomplementary to crRNA, and an HNH nuclease domain (residues 810-872) which cleave target DNA complementary to crRNA. In FIG. 12, the RuvC-like domain is highlighted in yellow and the HNH nuclease domain is underlined.

In some embodiments, the Cas protein is Cpf1 protein or a functional portion thereof. In some embodiments, the Cas protein is Cpf1 from any bacterial species or functional portion thereof. In some aspects, Cpf1 is a *Francisella novicida* U112 protein or a functional portion thereof. In some aspects, Cpf1 is a *Acidaminococcus* sp. BV3L6 protein or a functional portion thereof. In some aspects, Cpf1 is a *Lachnospiraceae bacterium* ND2006 protein or a function portion thereof. Cpf1 protein is a member of the type V CRISPR systems. Cpf1 protein is a polypeptide comprising about 1300 amino acids. Cpf1 contains a RuvC-like endonuclease domain. Cpf1 cleaves target DNA in a staggered pattern using a single ribonuclease domain. The staggered DNA double-stranded break results in a 4 or 5-nt 5' overhang.

As used herein, "functional portion" refers to a portion of a peptide which retains its ability to complex with at least one ribonucleic acid (e.g., guide RNA (gRNA)) and cleave a target polynucleotide sequence. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional portion comprises a combination of operably linked Cpf1 protein functional domains selected from the group consisting of a DNA binding domain, at least one RNA binding domain, a helicase domain, and an endonuclease domain. In some embodiments, the functional domains form a complex. In some embodiments, a functional portion of the Cas9 protein comprises a functional portion of a RuvC-like domain. In some embodiments, a functional portion of the Cas9 protein comprises a functional portion of the HNH nuclease domain. In some embodiments, a functional portion of the Cpf1 protein comprises a functional portion of a RuvC-like domain.

It should be appreciated that the present invention contemplates various ways of contacting a target polynucleotide sequence with a Cas protein (e.g., Cas9). In some embodiments, exogenous Cas protein can be introduced into the cell in polypeptide form. In certain embodiments, Cas proteins can be conjugated to or fused to a cell-penetrating polypeptide or cell-penetrating peptide. As used herein, "cell-penetrating polypeptide" and "cell-penetrating peptide" refers to a polypeptide or peptide, respectively, which facilitates the uptake of molecule into a cell. The cell-penetrating polypeptides can contain a detectable label.

In certain embodiments, Cas proteins can be conjugated to or fused to a charged protein (e.g., that carries a positive, negative or overall neutral electric charge). Such linkage may be covalent. In some embodiments, the Cas protein can be fused to a superpositively charged GFP to significantly increase the ability of the Cas protein to penetrate a cell (Cronican et al. ACS Chem Biol.2010; 5(8):747-52). In certain embodiments, the Cas protein can be fused to a protein transduction domain (PTD) to facilitate its entry into a cell. Exemplary PTDs include Tat, oligoarginine, and penetratin. In some embodiments, the Cas9 protein comprises a Cas9 polypeptide fused to a cell-penetrating peptide. In some embodiments, the Cas9 protein comprises a Cas9 polypeptide fused to a PTD. In some embodiments, the Cas9 protein comprises a Cas9 polypeptide fused to a tat domain. In some embodiments, the Cas9 protein comprises a Cas9 polypeptide fused to an oligoarginine domain. In some embodiments, the Cas9 protein comprises a Cas9 polypeptide fused to a penetratin domain. In some embodiments, the Cas9 protein comprises a Cas9 polypeptide fused to a superpositively charged GFP. In some embodiments, the Cpf1 protein comprises a Cpf1 polypeptide fused to a cell-penetrating peptide. In some embodiments, the Cpf1 protein comprises a Cpf1 polypeptide fused to a PTD. In some embodiments, the Cpf1 protein comprises a Cpf1 polypeptide fused to a tat domain. In some embodiments, the Cpf1 protein comprises a Cpf1 polypeptide fused to an oligoarginine domain. In some embodiments, the Cpf1 protein comprises a Cpf1 polypeptide fused to a penetratin domain. In some embodiments, the Cpf1 protein comprises a Cpf1 polypeptide fused to a superpositively charged GFP.

In some embodiments, the Cas protein can be introduced into a cell containing the target polynucleotide sequence in the form of a nucleic acid encoding the Cas protein (e.g., Cas9 or Cpf1). The process of introducing the nucleic acids into cells can be achieved by any suitable technique. Suitable techniques include calcium phosphate or lipid-mediated transfection, electroporation, and transduction or infection using a viral vector. In some embodiments, the nucleic acid comprises DNA. In some embodiments, the nucleic acid comprises a modified DNA, as described herein. In some embodiments, the nucleic acid comprises mRNA. In some embodiments, the nucleic acid comprises a modified mRNA, as described herein (e.g., a synthetic, modified mRNA).

In some embodiments, nucleic acids encoding Cas protein and nucleic acids encoding the at least one to two ribonucleic acids are introduced into a cell via viral transduction (e.g., lentiviral transduction).

In some embodiments, the Cas protein is complexed with one to two ribonucleic acids. In some embodiments, the Cas protein is complexed with two ribonucleic acids. In some embodiments, the Cas protein is complexed with one ribonucleic acid. In some embodiments, the Cas protein is encoded by a modified nucleic acid, as described herein (e.g., a synthetic, modified mRNA).

The methods of the present invention contemplate the use of any ribonucleic acid that is capable of directing a Cas protein to and hybridizing to a target motif of a target polynucleotide sequence. In some embodiments, at least one of the ribonucleic acids comprises tracrRNA. In some embodiments, at least one of the ribonucleic acids comprises CRISPR RNA (crRNA). In some embodiments, a single ribonucleic acid comprises a guide RNA that directs the Cas protein to and hybridizes to a target motif of the target polynucleotide sequence in a cell. In some embodiments, at least one of the ribonucleic acids comprises a guide RNA that directs the Cas protein to and hybridizes to a target motif of the target polynucleotide sequence in a cell. In some embodiments, both of the one to two ribonucleic acids comprise a guide RNA that directs the Cas protein to and hybridizes to a target motif of the target polynucleotide sequence in a cell. The ribonucleic acids of the present invention can be selected to hybridize to a variety of different target motifs, depending on the particular CRISPR/Cas system employed, and the sequence of the target polynucleotide, as will be appreciated by those skilled in the art. The one to two ribonucleic acids can also be selected to minimize hybridization with nucleic acid sequences other than the target polynucleotide sequence. In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some embodiments, at least one of the one to two ribonucleic acids comprises a sequence selected from the group consisting of the ribonucleic acid sequences of SEQ ID NOs: 2-817976. In some embodiments, at least one ribonucleic acid comprises a sequence selected from the group consisting of the ribonucleic acid sequences of SEQ ID NOs: 2-817976.

In some embodiments, at least one of the one to two ribonucleic acids comprises a sequence with a single nucleotide mismatch to a sequence selected from the group consisting of the ribonucleic acid sequences of SEQ ID NOs: 2-817976. In some embodiments, at least one ribonucleic acid comprises a sequence with a single nucleotide mismatch to a sequence selected from the group consisting of the ribonucleic acid sequences of SEQ ID NOs: 2-817976.

In some embodiments, each of the one to two ribonucleic acids comprises guide RNAs that directs the Cas protein to and hybridizes to a target motif of the target polynucleotide sequence in a cell. In some embodiments, one or two ribonucleic acids (e.g., guide RNAs) are complementary to and/or hybridize to sequences on the same strand of a target polynucleotide sequence. In some embodiments, one or two ribonucleic acids (e.g., guide RNAs) are complementary to and/or hybridize to sequences on the opposite strands of a target polynucleotide sequence. In some embodiments, the one or two ribonucleic acids (e.g., guide RNAs) are not complementary to and/or do not hybridize to sequences on the opposite strands of a target polynucleotide sequence. In some embodiments, the one or two ribonucleic acids (e.g., guide RNAs) are complementary to and/or hybridize to overlapping target motifs of a target polynucleotide sequence. In some embodiments, the one or two ribonucleic acids (e.g., guide RNAs) are complementary to and/or hybridize to offset target motifs of a target polynucleotide sequence.

In some embodiments, the target motif is a 17 to 23 nucleotide DNA sequence. In some embodiments, the target motif is at least 20 nucleotides in length. In some embodiments, the target motif is a 20-nucleotide DNA sequence. In some embodiments, the target motif is a 17 to 23-nucleotide DNA sequence and immediately precedes an NRG motif. In some aspects, the NRG motif is NGG or NAG. In some embodiments, the target motif is a 20-nucleotide DNA sequence and immediately precedes an NGG motif recognized by the Cas protein. In some embodiments, the target motif is a 20-nucleotide DNA sequence and immediately precedes an NAG motif recognized by the Cas protein. In some embodiments, the target motif is a 20-nucleotide DNA sequence beginning with G and immediately precedes an NGG motif recognized by the Cas protein. In some embodiments, the target motif is G(N)19NGG. In some embodiments, the target motif is (N)20NGG.

In some embodiments, the target motif is a 17 to 23-nucleotide DNA sequence and immediately precedes an NNGRRT motif. In some embodiments, the target motif is a 20 nucleotide DNA sequence and immediately precedes an NNGRRT motif. In some embodiments, the target motif is a 17 to 23-nucleotide DNA sequence and immediately precedes an NNNRRT motif. In some embodiments, the target motif is a 20 nucleotide DNA sequence and immediately precedes an NNNRRT motif. In some embodiments, the target motif is a 17 to 23-nucleotide DNA sequence and immediately precedes an NNAGAAW motif. In some embodiments, the target motif is a 20 nucleotide DNA sequence and immediately precedes an NNAGAAW motif. In some embodiments, the target motif is a 17 to 23-nucleotide DNA sequence and immediately precedes an NNNNGATT motif. In some embodiments, the target motif is a 20 nucleotide DNA sequence and immediately precedes an NNNNGATT motif. In some embodiments, the target motif is a 17 to 23-nucleotide DNA sequence and immediately precedes an NAAAAC motif. In some embodiments, the target motif is a 20 nucleotide DNA sequence and immediately precedes an NAAAAC motif. In some embodiments, the target motif is a 17 to 23-nucleotide DNA sequence having a 5' T-rich region (e.g., TTTN motif). In some embodiments, the target motif is a 20 nucleotide DNA sequence having a 5' T-rich region (e.g., TTTN motif).

In some embodiments, the target motif is a 17 to 23-nucleotide DNA sequence and immediately precedes an NRG motif (e.g., NGG or NAG) recognized by a *S. pyogenes* Cas9 protein. In some embodiments, the target motif is a 17 to 23-nucleotide DNA sequence and immediately precedes an NNGRRT motif recognized by a *S. aureus* Cas9 protein. In some embodiments, the target motif is a 17 to 23-nucleotide DNA sequence and immediately precedes an NNNRRT motif recognized by a *S. aureus* Cas9 protein. In some embodiments, the target motif is a 17 to 23-nucleotide DNA sequence and immediately precedes an NNAGAAW motif recognized by a *S. thermophilus* Cas9 protein. In some embodiments, the target motif is a 17 to 23-nucleotide DNA sequence and immediately precedes an NNNNGATT motif recognized by *N. meningitides* Cas9 protein. In some embodiments, the target motif is a 17 to 23-nucleotide DNA sequence and immediately precedes an NAAAAC motif recognized by *T. denticola* Cas9 protein. In some embodiments, the target motif is a 17 to 23-nucleotide DNA sequence having a 5' T-rich region (e.g., TTTN motif) recognized by *Acidaminococcus* or *Lachnospiraceae* Cpf1 protein.

In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. Those skilled in the art will appreciate that a variety of techniques can be used to select suitable target motifs for minimizing off-target effects (e.g., bioinformatics analyses). In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some aspects, the target polynucleotide sequence in a cell is altered to reduce or eliminate expression and/or activity of one or more critical immune genes in the cell using a genetic editing system (e.g., TALENs, CRISPR/Cas, etc.). In some embodiments, the present disclosure provides that the target polynucleotide sequence in a cell is altered to delete a contiguous stretch of genomic DNA (e.g., delete one or more critical immune genes) from one or both alleles of the cell (e.g., using a CRISPR/Cas system). In some embodiments, the target polynucleotide sequence in a cell is altered to insert a genetic mutation in one or both alleles of the cell (e.g., using a CRISPR/Cas system). In still other embodiments, the universal stem cells disclosed herein may be subject to complementary genome editing approaches (e.g., using a CRISPR/Cas system), whereby such stem cells are modified to both delete contiguous stretches of genomic DNA (e.g., critical immune genes) from one or both alleles of the cell, as well as to insert one or more tolerance-inducing factors, such as HLA-G or PD-L1, into one or both alleles of the cells to locally suppress the immune system and improve transplant engraftment.

The universal stem cells disclosed herein may be differentiated into relevant cell types to assess HLA expression, as well as the evaluation of immunogenicity of the universal stem cell lines, for example, in a pre-clinical humanized mouse model. For example, the universal stem cells disclosed herein may be incubated under appropriate conditions and differentiated into mesenchymal progenitors cells (MPCs), hypoimmunogenic cardiomyocytes, endothelial cells (ECs), macrophages, hepatocytes, beta cells (e.g., pancreatic beta cells), or neural progenitor cells (NPCs).

The universal stem cells and methods disclosed herein will have an enormous impact on regenerative medicine by leading the way to rigorously tested universal donor stem cell lines that could be grown up and differentiated into a very large numbers of cells, made widely available to all medical institutions, and used on demand to treat patients suffering from degenerative illnesses, and thereby make it unnecessary to use a patient's own cells on a case-by-case basis as a source for autologous transplantation. Moreover, as the resulting cell products will be protected from immune attack, they will represent a new form of treatment for autoimmune diseases such as MS (multiple sclerosis) and diabetes, where autologous cells would still be prone to immune attack. Immunoprivileged universal donor stem cell-derived cell products, however, will be protected from autoimmune rejection.

The universal stem cells disclosed herein may be used, for example, to diagnose, monitor, treat and/or cure the presence or progression of a disease or condition in a subject. As used herein, a "subject" means a human or animal. In certain embodiments, the subject is a human. In certain embodiments, the subject is an adolescent. In certain embodiments, the subject is treated in vivo, in vitro and/or in utero. In certain aspects, a subject in need of treatment in accordance with the methods disclosed herein has a condition or is suspected or at increased risk of developing such condition.

Figure 2A:
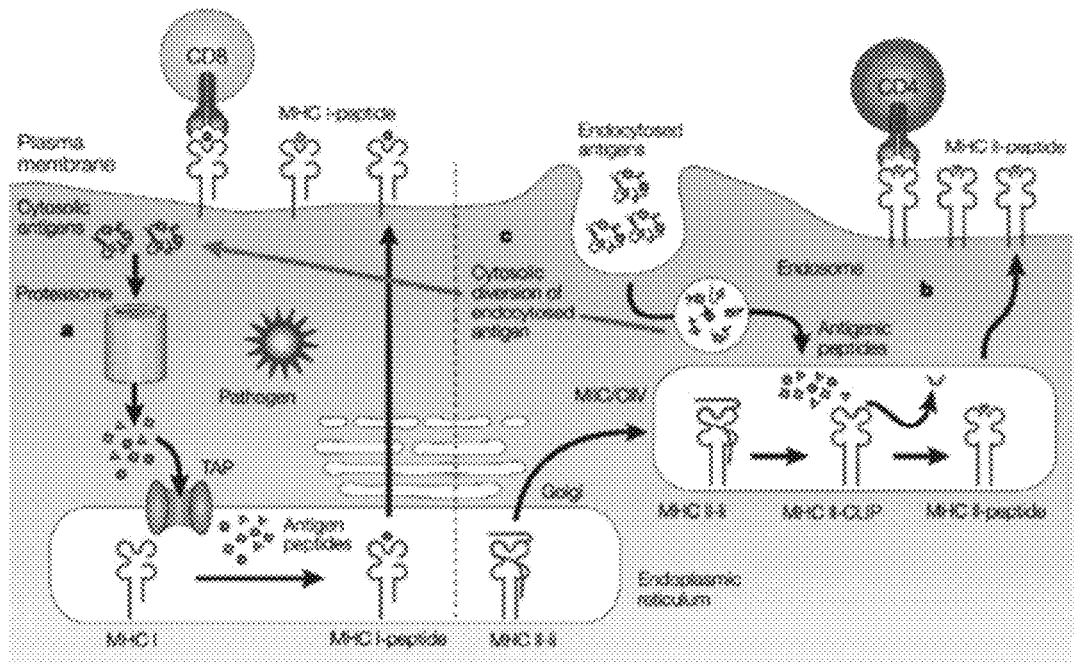
FIGS. 2A-2B graphically depict the HLA barrier in transplantation.
Figure 2B:
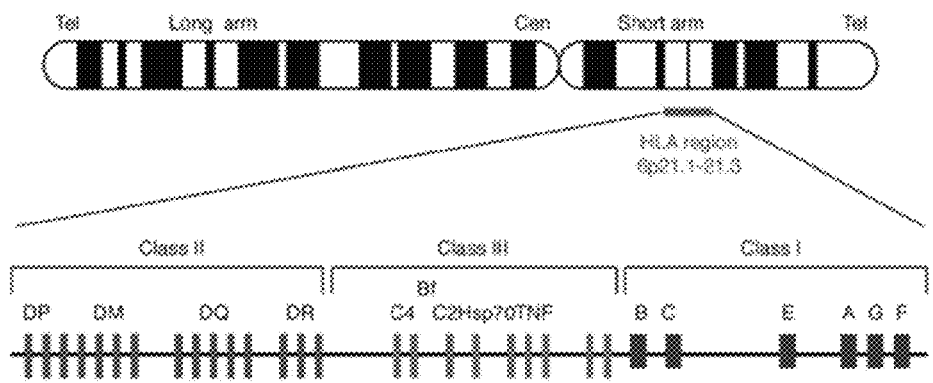
Figure 13:
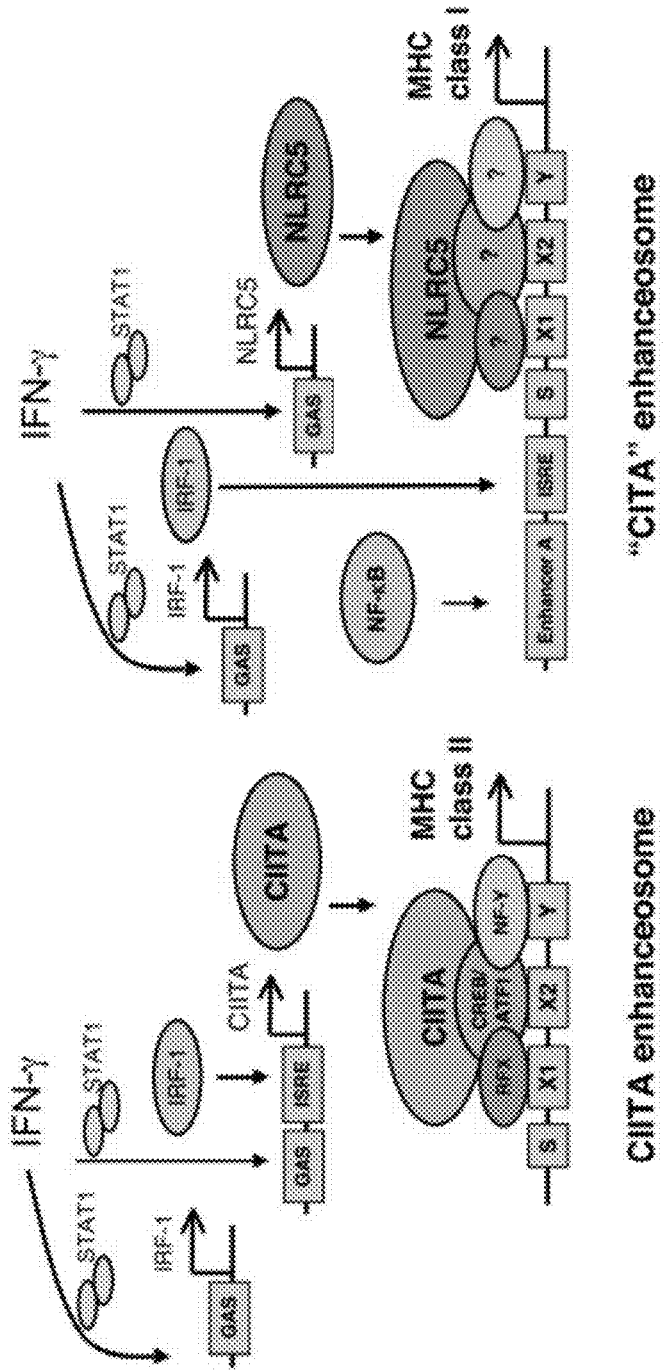
FIG. 13 illustrates a comparison of the MHC-II and MHC-I enhanceosomes.

As depicted in FIG. 2A, HLA represents an immunologic barrier to the successful transplantation of stem cells or differentiated stem cells in a subject. Disclosed herein are novel compositions, cells and related methods that are useful for overcoming the HLA immunologic barrier to transplantation. As illustrated in FIG. 2B, major histocompatibility complex (MHC) is a locus on human Chr. 6p21, which encodes a highly polymorphic gene family of surface molecules that define donor compatibility during organ transplantation. MHC class I (MHC-I) and MHC class II (MHC-II) play essential roles in the activation of adaptive immune responses by presenting antigens to T lymphocytes. A comparison of the MHC-II and MHC-I enhanceosomes is provided in FIG. 13. Humans have three classical MHC-Ia molecules (HLA-A, HLA-B, and HLA-C), which are vital to the detection and elimination of viruses, cancerous cells, and transplanted cells. In addition, there are three non-classical MHC-Ib molecules (HLA-E, HLA-F, and HLA-G), which have immune regulatory functions. While MHC's serve a vital cellular function, in certain contexts, such as cell-based transplantation therapies, they may also contribute to immune rejection. Provided herein are novel cells, compositions and methods that are useful for addressing such HLA-based immune rejection of transplanted cells.

Knock-Outs

In certain aspects, the inventions disclosed herein relate to genomic modifications of one or more targeted polynucleotide sequences of the stem cell genome that regulates the expression of MHC-I and/or MHC-II. In some aspects, a genetic editing system is used to modify one or more targeted polynucleotide sequences. In some aspects, a CRISPR/Cas system is used to delete the one or more targeted polynucleotide sequences. MHC-I molecules are composed of MHC-encoded heavy chains and the invariant subunit β2-microglobulin (B2M). Antigen-derived peptides are presented by MHC-I-B2M complexes at the cell surface to CD8 T cells carrying an antigen-specific T cell receptor. Peptides are mostly produced from the degradation of cytoplasmic proteins by a specialized proteasome or immunoproteasome, which is optimized to generate MHC class I peptides and contains several IFN-γ—inducible subunits. Unlike MHC-II, which is found mainly in antigen-presenting cells, MHC-Ia is ubiquitously expressed in almost all nucleated cells (Pamer, et al., Annu Rev Immunol (1998) 16:323-358.). Both MHC-I and MHC-II genes are highly inducible by IFN-γ stimulation.

The efficient removal of the HLA barrier can be accomplished by one or more of the following: (1) targeting the polymorphic HLA alleles (HLA-A, -B, -C) and MHC-II genes directly; (2) removal of B2M, which will prevent surface trafficking of all MHC-I molecules; and/or (3) deletion of components of the MHC enhanceosomes, such as NLRC5, RFX-5, -ANK, and -AP, IRF1, NF-Y, and CIITA that are critical for HLA expression.

In certain embodiments, HLA expression is interfered with. In some aspects, HLA expression is interfered with by targeting individual HLAs (e.g., knocking out expression of HLA-A, HLA-B and/or HLA-C), targeting transcriptional regulators of HLA expression (e.g., knocking out expression of NLRC5, CIITA, RFX5, RFXAP, RFXANK, NFY-A, NFY-B, NFY-C and/or IRF-1), blocking surface trafficking of MHC class I molecules (e.g., knocking out expression of B2M and/or TAP1), and/or targeting HLA-Razor.

In certain aspects, the stem cells disclosed herein do not express one or more human leukocyte antigens (e.g., HLA-A, HLA-B and/or HLA-C) corresponding to MHC-I and/or MHC-II and are thus characterized as being hypoimmunogenic. For example, in certain aspects, the stem cells disclosed herein have been modified such that the stem cell or a differentiated stem cell prepared therefrom do not express or exhibit reduced expression of one or more of the following MHC-I molecules: HLA-A, HLA-B and HLA-C. In some aspects, one or more of HLA-A, HLA-B and HLA-C may be "knocked-out" of a cell. A cell that has a knocked-out HLA-A gene, HLA-B gene, and/or HLA-C gene may exhibit reduced or eliminated expression of each knocked-out gene. See FIGS. 13A-J.

In some aspects, the present disclosure provides a stem cell (e.g., hypoimmunogenic stem cell) or population thereof comprising a genome in which the HLA-A gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 2-1418.

In certain aspects, the present disclosure provides a method for altering a target HLA-A sequence in a cell comprising contacting the HLA-A sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-A polynucleotide sequence, wherein the target HLA-A polynucleotide sequence is cleaved, and wherein the at least one ribonucleic acid or the at least one pair of ribonucleic acids is selected from the group consisting of SEQ ID NOs: 2-1418.

In some aspects, the present disclosure provides a stem cell (e.g., hypoimmunogenic stem cell) or population thereof comprising a genome in which the HLA-B gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 1419-3277.

In certain aspects, the present disclosure provides a method for altering a target HLA-B sequence in a cell comprising contacting the HLA-B sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-B polynucleotide sequence, wherein the target HLA-B polynucleotide sequence is cleaved, and wherein the at least one ribonucleic acid or the at least one pair of ribonucleic acids is selected from the group consisting of SEQ ID NOs: 1419-3277.

In some aspects, the present disclosure provides a stem cell (e.g., hypoimmunogenic stem cell) or population thereof comprising a genome in which the HLA-C gene has been edited to delete a contiguous stretch of genomic DNA, thereby reducing or eliminating surface expression of MHC class I molecules in the cell or population thereof. The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 3278-5183.

In certain aspects, the present disclosure provides a method for altering a target HLA-C sequence in a cell comprising contacting the HLA-C sequence with a clustered regularly interspaced short palindromic repeats-associated (Cas) protein and at least one ribonucleic acid or at least one pair of ribonucleic acids, wherein the ribonucleic acids direct Cas protein to and hybridize to a target motif of the target HLA-C polynucleotide sequence, wherein the target HLA-C polynucleotide sequence is cleaved, and wherein the at least one ribonucleic acid or the at least one pair of ribonucleic acids is selected from the group consisting of SEQ ID NOs: 3278-5183.

In certain embodiments, the expression of MHC-I or MHC-II is modulated by targeting and deleting a contiguous stretch of genomic DNA thereby reducing or eliminating expression of a target gene, for example, NLRC5. As used herein, the term "modulate" is used consistently with its use in the art, i.e., meaning to cause or facilitate a qualitative or quantitative change, alteration, or modification in a process, pathway, or phenomenon of interest. Without limitation, such change may be an increase, decrease, or change in relative strength or activity of different components or branches of the process, pathway, or phenomenon. In certain aspects, the target gene is NLRC5, CIITA, RFX5, RFXAP, RFXANK, NFY-A, NFY-B, NFY-C or IRF-1.

In certain aspects, the inventions disclosed herein modulate (e.g., reduce or eliminate) the expression of MHC-II genes by targeting and modulating (e.g., reducing or eliminating) Class II transactivator (CIITA) expression. In some aspects, the modulation occurs using a CRISPR/Cas system. CIITA is a member of the NLR or nucleotide binding domain (NBD) leucine-rich repeat (LRR) family of proteins and regulates the transcription of MHC-II by associating with the MHC enhanceosome. The expression of CIITA is induced in B cells and dendritic cells as a function of developmental stage and is inducible by IFN-γ in most cell types. Aside from CIITA, NLR proteins are localized in the cytoplasm and contribute to the innate immune response by recognizing microbial products and exogenous danger signals, leading to inflammation and/or cell death.

In some aspects, the present disclosure provides a stem cell (e.g., hypoimmunogenic stem cell) or population thereof comprising a genome in which the Class II transactivator (CIITA) gene has been edited to delete a contiguous stretch of genomic DNA, thereby reducing or eliminating surface expression of MHC class II molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 5184-36352.

The present invention contemplates genomically editing human cells to cleave CIITA gene sequences, as well as editing the genome of such cells to alter one or more additional target polynucleotide sequences (e.g., NLRC5 and/or B2M). It should be appreciated that cleaving a CIITA genomic sequence using one or more gRNAs or gRNA pairs described herein and a Cas protein could result in partial or complete deletion of the target CIITA genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the CIITA gene has been edited to delete a contiguous stretch of genomic DNA, thereby reducing or eliminating MHC Class II molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 5184-36352.

In some aspects, the invention provides a method for altering a target CIITA polynucleotide sequence in a cell comprising contacting the CIITA polynucleotide sequence with a clustered regularly interspaced short palindromic repeats-associated (Cas) protein and from one to two ribonucleic acids, wherein the ribonucleic acids direct Cas protein to and hybridize to a target motif of the target CIITA polynucleotide sequence, wherein the target CIITA polynucleotide sequence is cleaved, and wherein at least one of the one to two ribonucleic acids are selected from the group consisting of SEQ ID NOs: 5184-36352.

In some aspects, the invention provides a stem cell (e.g., hypoimmunogenic stem cell) or population thereof, each cell comprising a modified genome comprising: a genomic modification in which the CIITA gene has been edited to reduce or eliminate CIITA surface expression and/or activity in the cell by contacting the cell with a Cas protein or a nucleic acid encoding the Cas protein and at least one ribonucleic acid having a sequence selected from the group consisting of SEQ ID NOs: 5184-36352.

In some aspects, the invention provides a method for altering a target CIITA polynucleotide sequence in a cell comprising contacting the CIITA polynucleotide sequence with a clustered regularly interspaced short palindromic repeats-associated (Cas) protein and at least one ribonucleic acid, wherein the ribonucleic acid directs Cas protein to and hybridizes to a target motif of the target CIITA polynucleotide sequence, wherein the target CIITA polynucleotide sequence is cleaved, and wherein the at least one ribonucleic acid is selected from the group consisting of SEQ ID NOs: 5184-36352.

In certain aspects, the inventions disclosed herein modulate (e.g., reduce or eliminate) the expression of MHC-I genes by targeting and modulating (e.g., reducing or eliminating) expression of the NLR family, CARD domain containing 5/NOD27/CLR16.1 (NLRC5). In some aspects, the modulation occurs using a CRISPR/Cas system. NLRC5 is a critical regulator of MHC-I-mediated immune responses and, similar to CIITA, NLRC5 is highly inducible by IFN-γ and can translocate into the nucleus. NLRC5 activates the promoters of MHC-I genes and induces the transcription of MHC-I as well as related genes involved in MHC-I antigen presentation.

In some aspects, the present disclosure provides a stem cell (e.g., hypoimmunogenic stem cell) or population thereof comprising a genome in which the NLRC5 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 36353-81239.

The present invention contemplates genomically editing human cells to cleave NLRC5 gene sequences, as well as editing the genome of such cells to alter one or more additional target polynucleotide sequences (e.g., CIITA and/or B2M). It should be appreciated that cleaving a NLRC5 genomic sequence using one or more gRNAs or gRNA pairs described herein and a Cas protein could result in partial or complete deletion of the target NLRC5 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NLRC5 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 36353-81239.

In some aspects, the invention provides a method for altering a target NLRC5 polynucleotide sequence in a cell comprising contacting the NLRC5 polynucleotide sequence with a clustered regularly interspaced short palindromic repeats-associated (Cas) protein and from one to two ribonucleic acids, wherein the ribonucleic acids direct Cas protein to and hybridize to a target motif of the target NLRC5 polynucleotide sequence, wherein the target NLRC5 polynucleotide sequence is cleaved, and wherein at least one of the one to two ribonucleic acids are selected from the group consisting of SEQ ID NOs: 36353-81239.

In some aspects, the invention provides a stem cell (e.g., hypoimmunogenic stem cell) or population thereof, each cell comprising a modified genome comprising: a genomic modification in which the NLRC5 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 36353-81239.

In some aspects, the invention provides a method for altering a target NLRC5 polynucleotide sequence in a cell comprising contacting the NLRC5 polynucleotide sequence with a clustered regularly interspaced short palindromic repeats-associated (Cas) protein and at least one ribonucleic acid, wherein the ribonucleic acid directs Cas protein to and hybridizes to a target motif of the target NLRC5 polynucleotide sequence, wherein the target NLRC5 polynucleotide sequence is cleaved, and wherein the at least one ribonucleic acid is selected from the group consisting of SEQ ID NOs: 36353-81239.

In certain embodiments, the inventions disclosed herein modulate (e.g., reduce or eliminate) the expression of MHC-I genes by targeting and modulating (e.g., reducing or eliminating) expression of the accessory chain B2M. In some aspects, the modulation occurs using a CRISPR/Cas system. By modulating (e.g., reducing or deleting) expression of B2M, surface trafficking of MHC-I molecules is blocked and the cell rendered hypoimmunogenic.

In some aspects, the present disclosure provides a stem cell (e.g., hypoimmunogenic stem cell) or population thereof comprising a genome in which the 32-microglobulin (B2M) gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 81240-85644.

The present invention contemplates genomically editing human cells to cleave B2M gene sequences, as well as editing the genome of such cells to alter one or more additional target polynucleotide sequences (e.g., NLRC5 and/or CIITA). It should be appreciated that cleaving a B2M genomic sequence using one or more gRNAs or gRNA pairs described herein and a Cas protein could result in partial or complete deletion of the target B2M genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the B2M gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 81240-85644.

In some aspects, the invention provides a method for altering a target B2M polynucleotide sequence in a cell comprising contacting the B2M polynucleotide sequence with a clustered regularly interspaced short palindromic repeats-associated (Cas) protein and from one to two ribonucleic acids, wherein the ribonucleic acids direct Cas protein to and hybridize to a target motif of the target B2M polynucleotide sequence, wherein the target B2M polynucleotide sequence is cleaved, and wherein at least one of the one to two ribonucleic acids are selected from the group consisting of SEQ ID NOs: 81240-85644.

In some aspects, the invention provides a stem cell (e.g., hypoimmunogenic stem cell) or population thereof, each cell comprising a modified genome comprising: a genomic modification in which the B2M gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 81240-85644.

In some aspects, the invention provides a method for altering a target B2M polynucleotide sequence in a cell comprising contacting the B2M polynucleotide sequence with a clustered regularly interspaced short palindromic repeats-associated (Cas) protein and at least one ribonucleic acid, wherein the ribonucleic acid directs Cas protein to and hybridizes to a target motif of the target B2M polynucleotide sequence, wherein the target B2M polynucleotide sequence is cleaved, and wherein the at least one ribonucleic acid is selected from the group consisting of SEQ ID NOs: 81240-85644.

In certain aspects, the inventions disclosed herein modulate (e.g., reduce or eliminate) the expression of MHC-I genes by targeting and modulating (e.g., reducing or eliminating) expression of one or more of RFX5. In some aspects, the modulation occurs using a CRISPR/Cas system.

In some aspects, the present disclosure provides a stem cell (e.g., hypoimmunogenic stem cell) or population thereof comprising a genome in which the RFX5 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 85645-90115.

The present invention contemplates genomically editing human cells to cleave RFX5 gene sequences, as well as editing the genome of such cells to alter one or more additional target polynucleotide sequences. It should be appreciated that cleaving a RFX5 genomic sequence using one or more gRNAs or gRNA pairs described herein and a Cas protein could result in partial or complete deletion of the target RFX5 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFX5 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 85645-90115.

In some aspects, the invention provides a method for altering a target RFX5 polynucleotide sequence in a cell comprising contacting the RFX5 polynucleotide sequence with a clustered regularly interspaced short palindromic repeats-associated (Cas) protein and from one to two ribonucleic acids, wherein the ribonucleic acids direct Cas protein to and hybridize to a target motif of the target RFX5 polynucleotide sequence, wherein the target RFX5 polynucleotide sequence is cleaved, and wherein at least one of the one to two ribonucleic acids are selected from the group consisting of SEQ ID NOs: 85645-90115.

In some aspects, the invention provides a stem cell (e.g., hypoimmunogenic stem cell) or population thereof, each cell comprising a modified genome comprising: a genomic modification in which the RFX5 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 85645-90115.

In some aspects, the invention provides a method for altering a target RFX5 polynucleotide sequence in a cell comprising contacting the RFX5 polynucleotide sequence with a clustered regularly interspaced short palindromic repeats-associated (Cas) protein and at least one ribonucleic acid, wherein the ribonucleic acid directs Cas protein to and hybridizes to a target motif of the target RFX5 polynucleotide sequence, wherein the target RFX5 polynucleotide sequence is cleaved, and wherein the at least one ribonucleic acid is selected from the group consisting of SEQ ID NOs: 85645-90115.

In certain aspects, the inventions disclosed herein modulate (e.g., reduce or eliminate) the expression of MHC-I genes by targeting and modulating (e.g., reducing or eliminating) expression of one or more of RFXAP. In some aspects, the modulation occurs using a CRISPR/Cas system.

In some aspects, the present disclosure provides a stem cell (e.g., hypoimmunogenic stem cell) or population thereof comprising a genome in which the RFXAP gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 90116-95635.

The present invention contemplates genomically editing human cells to cleave RFXAP gene sequences, as well as editing the genome of such cells to alter one or more additional target polynucleotide sequences. It should be appreciated that cleaving a RFXAP genomic sequence using one or more gRNAs or gRNA pairs described herein and a Cas protein could result in partial or complete deletion of the target RFXAP genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFXAP gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 90116-95635.

In some aspects, the invention provides a method for altering a target RFXAP polynucleotide sequence in a cell comprising contacting the RFXAP polynucleotide sequence with a clustered regularly interspaced short palindromic repeats-associated (Cas) protein and from one to two ribonucleic acids, wherein the ribonucleic acids direct Cas protein to and hybridize to a target motif of the target RFXAP polynucleotide sequence, wherein the target RFXAP polynucleotide sequence is cleaved, and wherein at least one of the one to two ribonucleic acids are selected from the group consisting of SEQ ID NOs: 90116-95635.

In some aspects, the invention provides a stem cell (e.g., hypoimmunogenic stem cell) or population thereof, each cell comprising a modified genome comprising: a genomic modification in which the RFXAP gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 90116-95635.

In some aspects, the invention provides a method for altering a target RFXAP polynucleotide sequence in a cell comprising contacting the RFXAP polynucleotide sequence with a clustered regularly interspaced short palindromic repeats-associated (Cas) protein and at least one ribonucleic acid, wherein the ribonucleic acid directs Cas protein to and hybridizes to a target motif of the target RFXAP polynucleotide sequence, wherein the target RFXAP polynucleotide sequence is cleaved, and wherein the at least one ribonucleic acid is selected from the group consisting of SEQ ID NOs: 90116-95635.

In certain aspects, the inventions disclosed herein modulate (e.g., reduce or eliminate) the expression of MHC-I genes by targeting and modulating (e.g., reducing or eliminating) expression of one or more of RFXANK. In some aspects, the modulation occurs using a CRISPR/Cas system.

In some aspects, the present disclosure provides a stem cell (e.g., hypoimmunogenic stem cell) or population thereof comprising a genome in which the RFXANK gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 95636-102318.

The present invention contemplates genomically editing human cells to cleave RFXANK gene sequences, as well as editing the genome of such cells to alter one or more additional target polynucleotide sequences. It should be appreciated that cleaving a RFXANK genomic sequence using one or more gRNAs or gRNA pairs described herein and a Cas protein could result in partial or complete deletion of the target RFXANK genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the RFXAP gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 95636-102318.

In some aspects, the invention provides a method for altering a target RFXANK polynucleotide sequence in a cell comprising contacting the RFXANK polynucleotide sequence with a clustered regularly interspaced short palindromic repeats-associated (Cas) protein and from one to two ribonucleic acids, wherein the ribonucleic acids direct Cas protein to and hybridize to a target motif of the target RFXANK polynucleotide sequence, wherein the target RFXANK polynucleotide sequence is cleaved, and wherein at least one of the one to two ribonucleic acids are selected from the group consisting of SEQ ID NOs: 95636-102318.

In some aspects, the invention provides a stem cell (e.g., hypoimmunogenic stem cell) or population thereof, each cell comprising a modified genome comprising: a genomic modification in which the RFXANK gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 95636-102318.

In some aspects, the invention provides a method for altering a target RFXANK polynucleotide sequence in a cell comprising contacting the RFXANK polynucleotide sequence with a clustered regularly interspaced short palindromic repeats-associated (Cas) protein and at least one ribonucleic acid, wherein the ribonucleic acid directs Cas protein to and hybridizes to a target motif of the target RFXANK polynucleotide sequence, wherein the target RFXANK polynucleotide sequence is cleaved, and wherein the at least one ribonucleic acid is selected from the group consisting of SEQ ID NOs: 95636-102318.

In certain aspects, the inventions disclosed herein modulate (e.g., reduce or eliminate) the expression of MHC-I genes by targeting and modulating (e.g., reducing or eliminating) expression of one or more of NFY-A. In some aspects, the modulation occurs using a CRISPR/Cas system.

In some aspects, the present disclosure provides a stem cell (e.g., hypoimmunogenic stem cell) or population thereof comprising a genome in which the NFY-A gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 102319-121796.

The present invention contemplates genomically editing human cells to cleave NFY-A gene sequences, as well as editing the genome of such cells to alter one or more additional target polynucleotide sequences. It should be appreciated that cleaving a NFY-A genomic sequence using one or more gRNAs or gRNA pairs described herein and a Cas protein could result in partial or complete deletion of the target NFY-A genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-A gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 102319-121796.

In some aspects, the invention provides a method for altering a target NFY-A polynucleotide sequence in a cell comprising contacting the NFY-A polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-A polynucleotide sequence, wherein the target NFY-A polynucleotide sequence is cleaved, and wherein at least one of the one to two ribonucleic acids are selected from the group consisting of SEQ ID NOs: 102319-121796.

In some aspects, the invention provides a stem cell (e.g., hypoimmunogenic stem cell) or population thereof, each cell comprising a modified genome comprising: a genomic modification in which the NFY-A gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 102319-121796.

In some aspects, the invention provides a method for altering a target NFY-A polynucleotide sequence in a cell comprising contacting the NFY-A polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-A polynucleotide sequence, wherein the target NFY-A polynucleotide sequence is cleaved, and wherein the at least one ribonucleic acid is selected from the group consisting of SEQ ID NOs: 102319-121796.

In certain aspects, the inventions disclosed herein modulate (e.g., reduce or eliminate) the expression of MHC-I genes by targeting and modulating (e.g., reducing or eliminating) expression of one or more of NFY-B. In some aspects, the modulation occurs using a CRISPR/Cas system.

In some aspects, the present disclosure provides a stem cell (e.g., hypoimmunogenic stem cell) or population thereof comprising a genome in which the NFY-B gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 121797-135112.

The present invention contemplates genomically editing human cells to cleave NFY-B gene sequences, as well as editing the genome of such cells to alter one or more additional target polynucleotide sequences. It should be appreciated that cleaving a NFY-B genomic sequence using one or more gRNAs or gRNA pairs described herein and a Cas protein could result in partial or complete deletion of the target NFY-B genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-B gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 121797-135112.

In some aspects, the invention provides a method for altering a target NFY-B polynucleotide sequence in a cell comprising contacting the NFY-B polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-B polynucleotide sequence, wherein the target NFY-B polynucleotide sequence is cleaved, and wherein at least one of the one to two ribonucleic acids are selected from the group consisting of SEQ ID NOs: 121797-135112.

In some aspects, the invention provides a stem cell (e.g., hypoimmunogenic stem cell) or population thereof, each cell comprising a modified genome comprising: a genomic modification in which the NFY-B gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 121797-135112.

In some aspects, the invention provides a method for altering a target NFY-B polynucleotide sequence in a cell comprising contacting the NFY-B polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-B polynucleotide sequence, wherein the target NFY-B polynucleotide sequence is cleaved, and wherein the at least one ribonucleic acid is selected from the group consisting of SEQ ID NOs: 121797-135112.

In certain aspects, the inventions disclosed herein modulate (e.g., reduce or eliminate) the expression of MHC-I genes by targeting and modulating (e.g., reducing or eliminating) expression of one or more of NFY-C. In some aspects, the modulation occurs using a CRISPR/Cas system.

In some aspects, the present disclosure provides a stem cell (e.g., hypoimmunogenic stem cell) or population thereof comprising a genome in which the NFY-C gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 135113-176601.

The present invention contemplates genomically editing human cells to cleave NFY-C gene sequences, as well as editing the genome of such cells to alter one or more additional target polynucleotide sequences. It should be appreciated that cleaving a NFY-C genomic sequence using one or more gRNAs or gRNA pairs described herein and a Cas protein could result in partial or complete deletion of the target NFY-C genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the NFY-C gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 135113-176601.

In some aspects, the invention provides a method for altering a target NFY-C polynucleotide sequence in a cell comprising contacting the NFY-C polynucleotide sequence with a clustered regularly interspaced short palindromic repeats-associated (Cas) protein and from one to two ribonucleic acids, wherein the ribonucleic acids direct Cas protein to and hybridize to a target motif of the target NFY-C polynucleotide sequence, wherein the target NFY-C polynucleotide sequence is cleaved, and wherein at least one of the one to two ribonucleic acids are selected from the group consisting of SEQ ID NOs: 135113-176601.

In some aspects, the invention provides a stem cell (e.g., hypoimmunogenic stem cell) or population thereof, each cell comprising a modified genome comprising: a genomic modification in which the NFY-C gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 135113-176601.

In some aspects, the invention provides a method for altering a target NFY-C polynucleotide sequence in a cell comprising contacting the NFY-C polynucleotide sequence with a clustered regularly interspaced short palindromic repeats-associated (Cas) protein and at least one ribonucleic acid, wherein the ribonucleic acid directs Cas protein to and hybridizes to a target motif of the target NFY-C polynucleotide sequence, wherein the target NFY-C polynucleotide sequence is cleaved, and wherein the at least one ribonucleic acid is selected from the group consisting of SEQ ID NOs: 135113-176601.

In certain aspects, the inventions disclosed herein modulate (e.g., reduce or eliminate) the expression of MHC-I genes by targeting and modulating (e.g., reducing or eliminating) expression of one or more of IRF-1. In some aspects, the modulation occurs using a CRISPR/Cas system.

In some aspects, the present disclosure provides a stem cell (e.g., hypoimmunogenic stem cell) or population thereof comprising a genome in which the IRF-1 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 176602-182813.

The present invention contemplates genomically editing human cells to cleave IRF-1 gene sequences, as well as editing the genome of such cells to alter one or more additional target polynucleotide sequences. It should be appreciated that cleaving a IRF-1 genomic sequence using one or more gRNAs or gRNA pairs described herein and a Cas protein could result in partial or complete deletion of the target IRF-1 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the IRF-1 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 176602-182813.

In some aspects, the invention provides a method for altering a target IRF-1 polynucleotide sequence in a cell comprising contacting the IRF-1 polynucleotide sequence with a clustered regularly interspaced short palindromic repeats-associated (Cas) protein and from one to two ribonucleic acids, wherein the ribonucleic acids direct Cas protein to and hybridize to a target motif of the target IRF-1 polynucleotide sequence, wherein the target IRF-1 polynucleotide sequence is cleaved, and wherein at least one of the one to two ribonucleic acids are selected from the group consisting of SEQ ID NOs: 176602-182813.

In some aspects, the invention provides a stem cell (e.g., hypoimmunogenic stem cell) or population thereof, each cell comprising a modified genome comprising: a genomic modification in which the IRF-1 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 176602-182813.

In some aspects, the invention provides a method for altering a target IRF-1 polynucleotide sequence in a cell comprising contacting the IRF-1 polynucleotide sequence with a clustered regularly interspaced short palindromic repeats-associated (Cas) protein and at least one ribonucleic acid, wherein the ribonucleic acid directs Cas protein to and hybridizes to a target motif of the target IRF-1 polynucleotide sequence, wherein the target IRF-1 polynucleotide sequence is cleaved, and wherein the at least one ribonucleic acid is selected from the group consisting of SEQ ID NOs: 176602-182813.

In some aspects, the present disclosure provides a stem cell (e.g., hypoimmunogenic stem cell) or population thereof comprising a genome in which the TAP1 gene has been edited to delete a contiguous stretch of genomic DNA, thereby reducing or eliminating surface expression of MHC class I molecules in the cell or population thereof.

The contiguous stretch of genomic DNA can be deleted by contacting the cell or population thereof with a Cas protein or a nucleic acid encoding the Cas protein and at least one ribonucleic acid or at least one pair of ribonucleic acids selected from the group consisting of SEQ ID NOs: 182814-188371.

The present invention contemplates genomically editing human cells to cleave TAP1 gene sequences, as well as editing the genome of such cells to alter one or more additional target polynucleotide sequences. It should be appreciated that cleaving a TAP1 genomic sequence using one or more gRNAs or gRNA pairs described herein and a Cas protein could result in partial or complete deletion of the target TAP1 genomic sequence, depending on the number of gRNAs or gRNA pairs selected, as well as their targets.

In some aspects, the invention provides a stem cell (e.g., hypoimmunogenic stem cell) or population thereof, each cell comprising a modified genome comprising a genomic modification in which the TAP1 gene has been edited to delete a contiguous stretch of genomic DNA, thereby reducing or eliminating MHC Class I molecule surface expression and/or activity in the cell. In some embodiments, the contiguous stretch of genomic DNA has been deleted by contacting the cell with a Cas protein or a nucleic acid encoding the Cas protein and a pair of ribonucleic acids having sequences selected from the group consisting of SEQ ID NOs: 182814-188371.

In some aspects, the invention provides a method for altering a target TAP1 polynucleotide sequence in a cell comprising contacting the TAP1 polynucleotide sequence with a clustered regularly interspaced short palindromic repeats-associated (Cas) protein and from one to two ribonucleic acids, wherein the ribonucleic acids direct Cas protein to and hybridize to a target motif of the target TAP1 polynucleotide sequence, wherein the target TAP1 polynucleotide sequence is cleaved, and wherein at least one of the one to two ribonucleic acids are selected from the group consisting of SEQ ID NOs: 182814-188371.

In some aspects, the invention provides a stem cell (e.g., hypoimmunogenic stem cell) or population thereof, each cell comprising a modified genome comprising: a genomic modification in which the TAP1 gene has been edited to reduce or eliminate MHC Class I molecule surface expression and/or activity in the cell by contacting the cell with a Cas protein or a nucleic acid encoding the Cas protein and at least one ribonucleic acid having a sequence selected from the group consisting of SEQ ID NOs: 182814-188371.

In some aspects, the invention provides a method for altering a target TAP1 polynucleotide sequence in a cell comprising contacting the TAP1 polynucleotide sequence with a clustered regularly interspaced short palindromic repeats-associated (Cas) protein and at least one ribonucleic acid, wherein the ribonucleic acid directs Cas protein to and hybridizes to a target motif of the target TAP1 polynucleotide sequence, wherein the target TAP1 polynucleotide sequence is cleaved, and wherein the at least one ribonucleic acid is selected from the group consisting of SEQ ID NOs: 182814-188371.

Figure 21A:
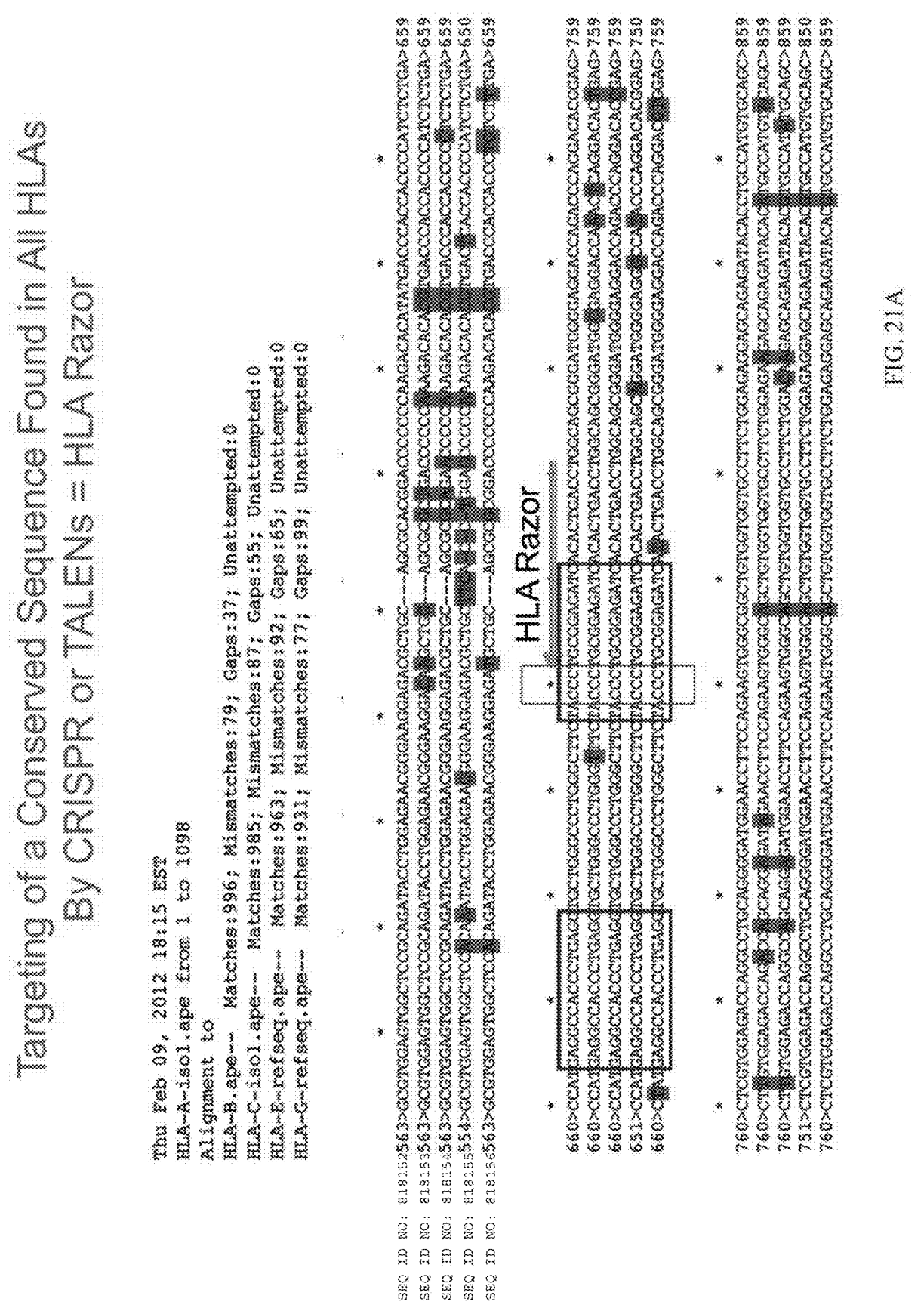
Figure 21B:
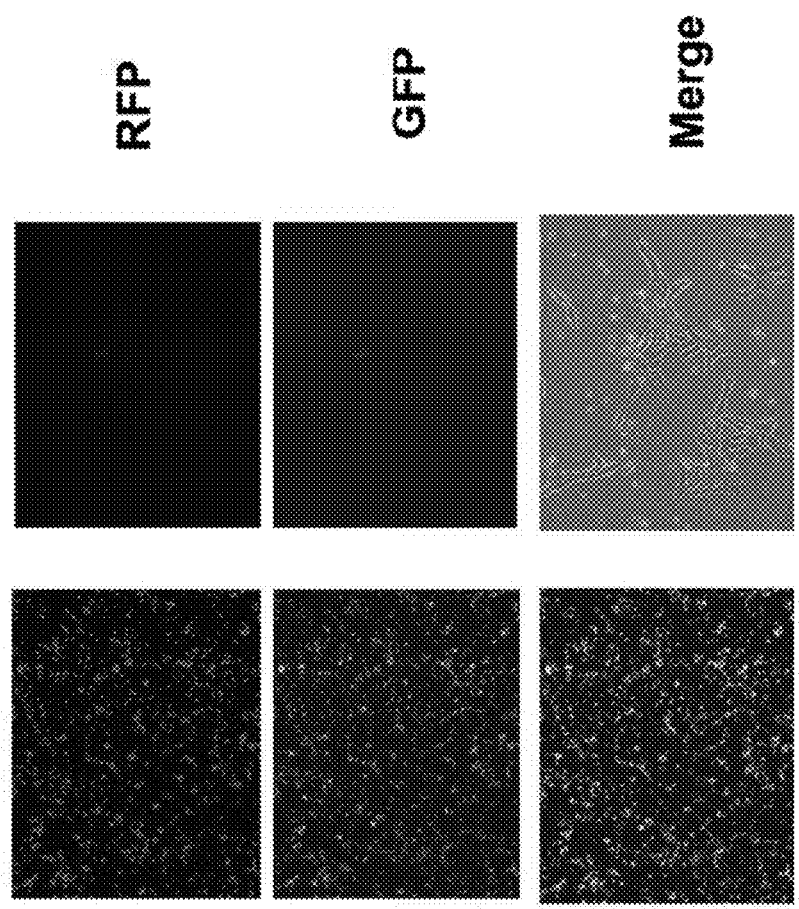

In certain embodiments, gRNAs that allow simultaneous deletion of all MHC class I alleles by targeting a conserved region in the HLA genes are identified as HLA Razors. In some aspects, the gRNAs are part of a CRISPR system. In alternative aspects, the gRNAs are part of a TALEN system. In one aspect, an HLA Razor targeting an identified conserved region in HLAs is depicted in FIG. 21A. In other aspects, multiple HLA Razors targeting identified conserved regions are utilized. It is generally understood that any guide that targets a conserved region in HLAs can act as an HLA Razor.

Knock-In

In certain embodiments, tolerogenic factors can be inserted or reinserted into genome-edited stem cell lines to create immune-privileged universal donor stem cell lines. In certain embodiments, the universal stem cells disclosed herein have been further modified to express one or more tolerogenic factors. Exemplary tolerogenic factors include, without limitation, one or more of HLA-C, HLA-E, HLA-F, HLA-G, PD-L1, CTLA-4-Ig, CD47, C1-inhibitor, and IL-35.

The present inventors have used genome editing systems, such as the CRISPR/Cas system, to facilitate the insertion of tolerogenic factors, such as the tolerogenic factors shown in Table 2 below, into a safe harbor locus, such as the AAVS1 locus, to actively inhibit immune rejection. As evidenced in FIGS. 11A-11C, the present inventors have successfully expressed tolerogenic factors, such as PD-L1 and HLA-G, from a safe harbor locus.

TABLE 2

Tolerogenic factors that can be (re)introduced into genome edited stem cell lines to create immune-privileged universal donor stem cell lines.

| Gene | Receptor | Target Cell |
| --- | --- | --- |
| HLA-G* | KIR2DL4 | NK cells |
| HLA-C* | KIR2DS1/L1 | NK cells |
| HLA-E* | NKG2A/C | NK cells |
| PD-L1 | PD-1 | T cells |
| CTLA4-Ig | CD28 | APC/T cells |
| CD47 | SIRPα | Macrophages |
| C1-inhibitor | Complement | |
| IL-35 | IL35R | T reg |

*in the form of a peptide-B2M-HLA fusion construct, when (re)introduced into a B2M$^{-/-}$ cell line In some aspects, the present disclosure provides a stem cell (e.g., hypoimmunogenic stem cell) or population thereof comprising a genome in which the stem cell genome has been modified to express HLA-G. In some aspects, the present disclosure provides a method for altering a stem cell genome to express HLA-G. In certain aspects at least one ribonucleic acid or at least one pair of ribonucleic acids may be utilized to facilitate the insertion of HLA-G into a stem cell line. In certain embodiments, the at least one ribonucleic acid or the at least one pair of ribonucleic acids is selected from the group consisting of SEQ ID NOs: 188372-189858.

In some aspects, the present disclosure provides a stem cell (e.g., hypoimmunogenic stem cell) or population thereof comprising a genome in which the stem cell genome has been modified to express HLA-C. In some aspects, the present disclosure provides a method for altering a stem cell genome to express HLA-C. In certain aspects at least one ribonucleic acid or at least one pair of ribonucleic acids may be utilized to facilitate the insertion of HLA-C into a stem cell line. In certain embodiments, the at least one ribonucleic acid or the at least one pair of ribonucleic acids is selected from the group consisting of SEQ ID NOs: 3278-5183.

In some aspects, the present disclosure provides a stem cell (e.g., hypoimmunogenic stem cell) or population thereof comprising a genome in which the stem cell genome has been modified to express HLA-E. In some aspects, the present disclosure provides a method for altering a stem cell genome to express HLA-E. In certain aspects at least one ribonucleic acid or at least one pair of ribonucleic acids may be utilized to facilitate the insertion of HLA-E into a stem cell line. In certain embodiments, the at least one ribonucleic acid or the at least one pair of ribonucleic acids is selected from the group consisting of SEQ ID NOs: 189859-193183.

In some aspects, the present disclosure provides a stem cell (e.g., hypoimmunogenic stem cell) or population thereof comprising a genome in which the stem cell genome has been modified to express PD-L1. In some aspects, the present disclosure provides a method for altering a stem cell genome to express PD-L1. In certain aspects at least one ribonucleic acid or at least one pair of ribonucleic acids may be utilized to facilitate the insertion of PD-L1 into a stem cell line. In certain embodiments, the at least one ribonucleic acid or the at least one pair of ribonucleic acids is selected from the group consisting of SEQ ID NOs: 193184-200783.

In some aspects, the present disclosure provides a stem cell (e.g., hypoimmunogenic stem cell) or population thereof comprising a genome in which the stem cell genome has been modified to express CD-47. In some aspects, the present disclosure provides a method for altering a stem cell genome to express CD-47. In certain aspects at least one ribonucleic acid or at least one pair of ribonucleic acids may be utilized to facilitate the insertion of CD-47 into a stem cell line. In certain embodiments, the at least one ribonucleic acid or the at least one pair of ribonucleic acids is selected from the group consisting of SEQ ID NOs: 200784-231885.

In some aspects, the present disclosure provides a stem cell (e.g., hypoimmunogenic stem cell) or population thereof comprising a genome in which the stem cell genome has been modified to express HLA-F. In some aspects, the present disclosure provides a method for altering a stem cell genome to express HLA-F. In certain aspects at least one ribonucleic acid or at least one pair of ribonucleic acids may be utilized to facilitate the insertion of HLA-F into a stem cell line. In certain embodiments, the at least one ribonucleic acid or the at least one pair of ribonucleic acids is selected from the group consisting of SEQ ID NOs: 688808-399754.

Other Target Modifications

In some embodiments, additional targets can be modified and/or deleted in universal cells, such as universal T cells, to improve their function and/or tailor them to a specific therapeutic approach.

In some aspects, genes encoding for co-stimulatory molecules/receptors that engage cytotoxic T cells can be deleted by genome editing (Table 3). Deletion of co-stimulatory molecules/receptors may occur to prevent autoimmunity. In other aspects, genes encoding for co-inhibitory molecules/receptors can be deleted by genome editing (Table 4). Deletion of co-inhibitory molecules/receptors may occur to prevent T cell inhibition by cancer cells, and may be useful in T cell-based cancer immunotherapy.

TABLE 3

Co-stimulatory molecules that will
be deleted to prevent autoimmunity
(e.g., to block interaction of
transplanted cells with T cells).

| Ligand on Cancer cells | Receptor on T cells |
|---|---|
| Ox40L | Ox40 |
| GITRL | GITR |
| 4-1BBL | 4-1BB |
| CD58 | CD2 |
| B7-1, -2 | CD28 |
| B2-2 | ICOS |
| CD70 | CD27 |
| LIGHT | HVEM |
| SLAM | SLAM |
| CD155, CD112 | CD226 |

TABLE 4

Co-inhibitory molecules/receptors
that will be deleted to prevent
T cell inhibition by cancer cells.
Useful in T cell-based cancer
immunotherapy

| Ligand on Cancer cells | Receptor on T cells |
|---|---|
| B7/H1PD-L1 | PD1 |
| B7-1/B7-2 | CTLA4 |
| MHC | LAG3 |
| CD155, CD112, CD113 | TIGIT |
| Galectin 9 | TIM3 |
| B7-1 | B7-H1/PD-L1 |
| PD-L2 | PD-1 |
| B7-H3 | TLT-2 |
| CD153 | CD30 |
| VISTA | ? |
| HVEM | CD160 |
| HVEM | BTLA |
| Collagen | LAIR1 |
| CD48 | 2B4/CD244 |

In some aspects, the present disclosure provides a stem cell or population thereof comprising a genome in which the OX40 gene has been edited to modify (e.g., delete) a contiguous stretch of genomic DNA. In certain aspects, the present disclosure provides a method for altering a target OX40 sequence in a cell. The contiguous stretch of genomic DNA can be modified (e.g., deleted) by contacting the cell or population thereof with a Cas protein or a nucleic acid encoding the Cas protein and at least one ribonucleic acid or at least one pair of ribonucleic acids selected from the group consisting of SEQ ID NOs: 231886-234210.

In some aspects, the present disclosure provides a stem cell or population thereof comprising a genome in which the GITR gene has been edited to modify a contiguous stretch of genomic DNA. In certain aspects, the present disclosure provides a method for altering a target GITR sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 234211-236445.

In some aspects, the present disclosure provides a stem cell or population thereof comprising a genome in which the 4-1BB gene has been edited to modify a contiguous stretch of genomic DNA. In certain aspects, the present disclosure provides a method for altering a target 4-1BB sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 234211-236445.

In some aspects, the present disclosure provides a stem cell or population thereof comprising a genome in which the CD28 gene has been edited to modify a contiguous stretch of genomic DNA. In certain aspects, the present disclosure provides a method for altering a target CD28 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 252807-274181.

In some aspects, the present disclosure provides a stem cell or population thereof comprising a genome in which the B7-1 gene has been edited to modify a contiguous stretch of genomic DNA. In certain aspects, the present disclosure provides a method for altering a target B7-1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 274182-295529.

In some aspects, the present disclosure provides a stem cell or population thereof comprising a genome in which the B7-2 gene has been edited to modify a contiguous stretch of genomic DNA. In certain aspects, the present disclosure provides a method for altering a target B7-2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 295530-324177.

In some aspects, the present disclosure provides a stem cell or population thereof comprising a genome in which the ICOS gene has been edited to modify a contiguous stretch of genomic DNA. In certain aspects, the present disclosure provides a method for altering a target ICOS sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 324178-339974.

In some aspects, the present disclosure provides a stem cell or population thereof comprising a genome in which the CD27 gene has been edited to modify a contiguous stretch of genomic DNA. In certain aspects, the present disclosure provides a method for altering a target CD27 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 339975-344266.

In some aspects, the present disclosure provides a stem cell or population thereof comprising a genome in which the HVEM gene has been edited to modify a contiguous stretch of genomic DNA. In certain aspects, the present disclosure provides a method for altering a target HVEM sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 344267-350722.

In some aspects, the present disclosure provides a stem cell or population thereof comprising a genome in which the SLAM gene has been edited to modify a contiguous stretch of genomic DNA. In certain aspects, the present disclosure provides a method for altering a target SLAM sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 350723-353590.

In some aspects, the present disclosure provides a stem cell or population thereof comprising a genome in which the CD226 gene has been edited to modify a contiguous stretch of genomic DNA. In certain aspects, the present disclosure provides a method for altering a target CD226 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 353591-416840.

In some aspects, the present disclosure provides a stem cell or population thereof comprising a genome in which the PD1 gene has been edited to modify a contiguous stretch of genomic DNA. In certain aspects, the present disclosure provides a method for altering a target PD1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 196-531 and 4047-9101 in U.S. application Ser. No. 15/083,021, which is incorporated herein by reference.

In some aspects, the present disclosure provides a stem cell or population thereof comprising a genome in which the CTLA4 gene has been edited to modify a contiguous stretch of genomic DNA. In certain aspects, the present disclosure provides a method for altering a target CTLA4 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 1-195 and 797-4046 in U.S. application Ser. No. 15/083,021, which is incorporated herein by reference.

In some aspects, the present disclosure provides a stem cell or population thereof comprising a genome in which the LAG3 gene has been edited to modify a contiguous stretch of genomic DNA. In certain aspects, the present disclosure provides a method for altering a target LAG3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 416841-421195.

In some aspects, the present disclosure provides a stem cell or population thereof comprising a genome in which the TIGIT gene has been edited to modify a contiguous stretch of genomic DNA. In certain aspects, the present disclosure provides a method for altering a target TIGIT sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 421196-432039.

In some aspects, the present disclosure provides a stem cell or population thereof comprising a genome in which the TIM3 gene has been edited to modify a contiguous stretch of genomic DNA. In certain aspects, the present disclosure provides a method for altering a target TIM3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 432040-447610.

In some aspects, the present disclosure provides a stem cell or population thereof comprising a genome in which the CD160 gene has been edited to modify a contiguous stretch of genomic DNA. In certain aspects, the present disclosure provides a method for altering a target CD160 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 447611-459294.

In some aspects, the present disclosure provides a stem cell or population thereof comprising a genome in which the BTLA gene has been edited to modify a contiguous stretch of genomic DNA. In certain aspects, the present disclosure provides a method for altering a target BTLA sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 459295-482454.

In some aspects, the present disclosure provides a stem cell or population thereof comprising a genome in which the CD244 gene has been edited to modify a contiguous stretch of genomic DNA. In certain aspects, the present disclosure provides a method for altering a target CD244 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 482455-504169.

In some aspects, the present disclosure provides a stem cell or population thereof comprising a genome in which the CD244 gene has been edited to modify a contiguous stretch of genomic DNA. In certain aspects, the present disclosure provides a method for altering a target CD244 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 482455-504169.

In some aspects, the present disclosure provides a stem cell or population thereof comprising a genome in which the CD30 gene has been edited to modify a contiguous stretch of genomic DNA. In certain aspects, the present disclosure provides a method for altering a target CD30 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 699755-731993.

In some aspects, the present disclosure provides a stem cell or population thereof comprising a genome in which the TLT gene has been edited to modify a contiguous stretch of genomic DNA. In certain aspects, the present disclosure provides a method for altering a target TLT sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 731994-739957.

In some aspects, the present disclosure provides a stem cell or population thereof comprising a genome in which the VISTA gene has been edited to modify a contiguous stretch of genomic DNA. In certain aspects, the present disclosure provides a method for altering a target VISTA sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 739958-757515.

In some aspects, the present disclosure provides a stem cell or population thereof comprising a genome in which the B7-H3 gene has been edited to modify a contiguous stretch of genomic DNA. In certain aspects, the present disclosure provides a method for altering a target B7-H3 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 757516-777888.

In some aspects, the present disclosure provides a stem cell or population thereof comprising a genome in which the PD-L2 gene has been edited to modify a contiguous stretch of genomic DNA. In certain aspects, the present disclosure provides a method for altering a target PD-L2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 777889-817976.

In some embodiments, lymphocyte adhesion is blocked to prevent autoimmunity. In certain aspects, target genes can be edited by genome editing to block lymphocyte adhesion (Table 5).

TABLE 5

Blocking lymphocyte adhesion to prevent autoimmunity.

| Ligand on Cancer cells | Receptor on T cells |
| --- | --- |
| ICAM-1, ICAM-2 | LFA-1 |
| CD58/LFA-3 | CD2 |
| CD-SIGN | ICAM-3 |

In some aspects, the present disclosure provides a stem cell or population thereof comprising a genome in which the LFA-1 gene has been edited to modify a contiguous stretch of genomic DNA. In certain aspects, the present disclosure provides a method for altering a target LFA-1 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 504170-526670.

In some aspects, the present disclosure provides a stem cell or population thereof comprising a genome in which the CD2 gene has been edited to modify a contiguous stretch of genomic DNA. In certain aspects, the present disclosure provides a method for altering a target CD2 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 526671-536704.

In some aspects, the present disclosure provides a stem cell or population thereof comprising a genome in which the CD58 gene has been edited to modify a contiguous stretch of genomic DNA. In certain aspects, the present disclosure provides a method for altering a target CD58 sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 536705-570967.

In some embodiments, genes encoding for T cell receptors can be deleted by genome editing. Deletion of T cell receptor genes may occur to prevent autoimmune attack in T cell therapy. In some aspects, the gene encoding the T cell receptor is a T cell receptor alpha locus (TCRA), or a homolog, ortholog, or variant thereof (Gene ID: 5133, also known as IMD7, TCRD, TRA @, TRAC, and referred to herein as TCRa, TCRA, TCRalpha, and the like). In some aspects, the gene encoding the T cell receptor is a T cell receptor alpha locus (TCRB), or a homolog, ortholog, or variant thereof (Gene ID: 6957, also known as TCRB; TRB @, and referred to herein as TCRb, TCRB, TCRbeta, and the like). In some aspects, the T cell receptor gene is modified by genome editing as described in U.S. application Ser. No. 15/083,021 and PCT Application No. PCT/US2016/024554, both of which are incorporated herein by reference.

In some aspects, the present disclosure provides a stem cell or population thereof comprising a genome in which the TRAC gene has been edited to modify a contiguous stretch of genomic DNA. In certain aspects, the present disclosure provides a method for altering a target TRAC sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 532-609 and 9102-9797, as described in U.S. application Ser. No. 15/083,021, incorporated herein by reference.

In some aspects, the present disclosure provides a stem cell or population thereof comprising a genome in which the TRBC gene has been edited to modify a contiguous stretch of genomic DNA. In certain aspects, the present disclosure provides a method for altering a target TRBC sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of sequences numbered 610-765 and 9798-10573, as described in U.S. application Ser. No. 15/083,021 and incorporated herein by reference.

In some embodiments, genes involved in regulatory T cell (T reg) function can be deleted by genome editing (Table 6). Deletion of genes involved in regulatory T cell (T reg) function may occur to break tolerance in T cell therapy.

TABLE 6

Deletion of genes involved
in regulatory T cell
(T reg) function to break
tolerance in T cell therapy.

| Gene | Function |
| --- | --- |
| FOXP3 | T reg development |
| HELIOS | T reg maintenance |
| ST2 | IL-33 receptor |

In some aspects, the present disclosure provides a stem cell or population thereof comprising a genome in which the FOXP3 gene has been edited to modify (e.g., delete) a contiguous stretch of genomic DNA. In certain aspects, the present disclosure provides a method for altering a target FOXP3 sequence in a cell. The contiguous stretch of genomic DNA can be modified (e.g., deleted) by contacting the cell or population thereof with a Cas protein or a nucleic acid encoding the Cas protein and at least one ribonucleic acid or at least one pair of ribonucleic acids selected from the group consisting of SEQ ID NOs: 570968-584068.

In some aspects, the present disclosure provides a stem cell or population thereof comprising a genome in which the HELIOS gene has been edited to modify a contiguous stretch of genomic DNA. In certain aspects, the present disclosure provides a method for altering a target HELIOS sequence in a cell. The contiguous stretch of genomic DNA can be modified by contacting the cell or population thereof with a Cas protein or a nucleic acid encoding the Cas protein and at least one ribonucleic acid or at least one pair of ribonucleic acids selected from the group consisting of SEQ ID NOs: 683033-688807.

The capacity of the CRISPR/Cas system for multiplexing also allows the generation of disease-specific universal donor cell lines that harbor one or more genomic alterations that will improve their applicability to treat a certain disease or condition. A list of potential diseases that can be addressed can be found in Table 7.

TABLE 7

Additional targets that can be modified
using the CRISPR/Cas system in order to
generate universal donor cell lines tailored
to a specific disease or application.

| Gene | Disease |
| --- | --- |
| TCR | T cell therapy |
| PD-1 | T cell therapy |
| CTLA4 | T cell therapy |
| LAG-3 | T cell therapy |
| TIGIT | T cell therapy |
| TIM3 | T cell therapy |

TABLE 7-continued

Additional targets that can be modified
using the CRISPR/Cas system in order to
generate universal donor cell lines tailored
to a specific disease or application.

| Gene | Disease |
| --- | --- |
| CCR5 | HIV resistance |
| PCSK9 | Cardiovascular disease |
| APOC3 | Cardiovascular disease |

It is to be understood that the inventions disclosed herein are not limited in their application to the details set forth in the description or as exemplified. The invention encompasses other embodiments and is capable of being practiced or carried out in various ways. Also, it is to be understood that the phraseology and terminology employed herein is for the purpose of description and should not be regarded as limiting.

While certain compositions, methods and assays of the present invention have been described with specificity in accordance with certain embodiments, the following examples serve only to illustrate the methods and compositions of the invention and are not intended to limit the same.

The articles "a" and "an" as used herein in the specification and in the claims, unless clearly indicated to the contrary, should be understood to include the plural referents. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or the entire group members are present in, employed in, or otherwise relevant to a given product or process. Furthermore, it is to be understood that the invention encompasses all variations, combinations, and permutations in which one or more limitations, elements, clauses, descriptive terms, etc., from one or more of the listed claims is introduced into another claim dependent on the same base claim (or, as relevant, any other claim) unless otherwise indicated or unless it would be evident to one of ordinary skill in the art that a contradiction or inconsistency would arise. Where elements are presented as lists, (e.g., in Markush group or similar format) it is to be understood that each subgroup of the elements is also disclosed, and any element(s) can be removed from the group. It should be understood that, in general, where the invention, or aspects of the invention, is/are referred to as comprising particular elements, features, etc., certain embodiments of the invention or aspects of the invention consist, or consist essentially of, such elements, features, etc. For purposes of simplicity those embodiments have not in every case been specifically set forth in so many words herein. It should also be understood that any embodiment or aspect of the invention can be explicitly excluded from the claims, regardless of whether the specific exclusion is recited in the specification. The publications and other reference materials referenced herein to describe the background of the invention and to provide additional detail regarding its practice are hereby incorporated by reference.

Examples

Cell Lines

The inventors have targeted various genes in a variety of cell lines. The various cell lines utilized include HuES8, HuES9, BJ-RiPSCs, Thp1, Jurkat, Primary T cells and HEK293T cells (FIG. 27). HuES8 and HuES9 are human ES cell lines. BJ-RiPSC is an iPSC line.

Knock-Out of HLA-A, HLA-B, and HLA-C

Figure 14A:
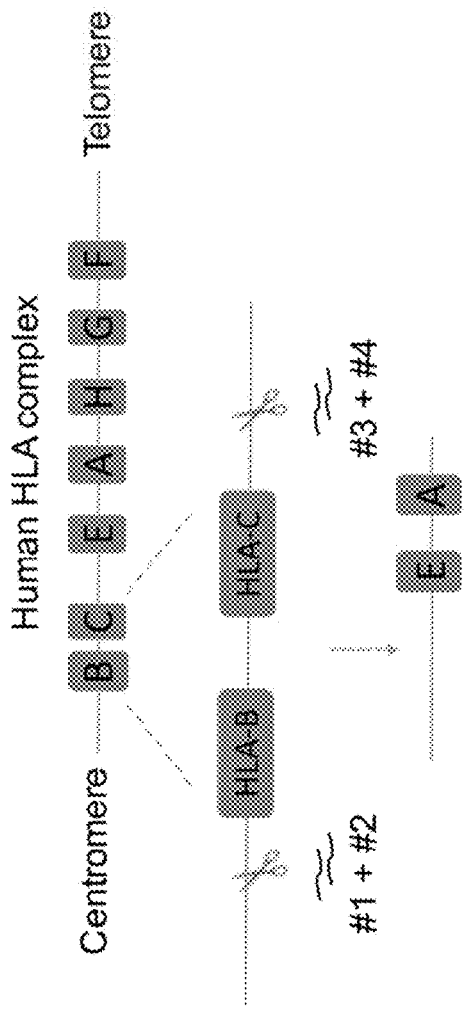

Knock-out targeting of HLAs was examined. Initially, an HLA-B and HLA-C knock-out strategy was examined. Two short guide RNAs (sgRNAs) were designed upstream of the HLA-B locus and downstream of HLA-C, which allowed for excision of the HLA-B and HLA-C genes (FIG. 14A). sgRNA #1 and sgRNA #2 target the HLA-B upstream region, and sgRNA #3 and sgRNA #4 target the HLA-C downstream region.

Figure 14C:
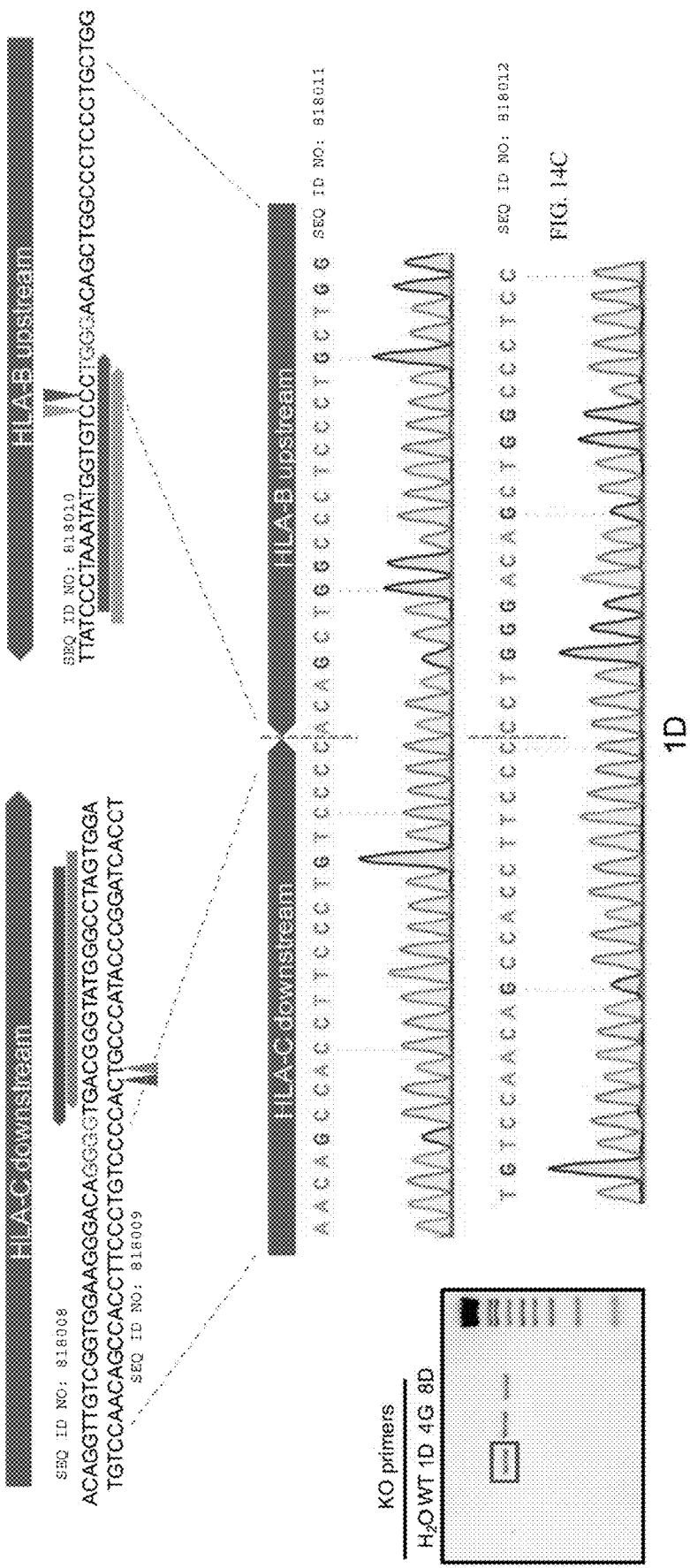

PCR screening was performed and confirmed that clone 1D was a homozygous knock-out clone. A schematic showing the PCR verification strategy for successful deletion of HLA-B and HLA-C is shown in FIG. 13B. Two pairs of wild-type (WT) primers were designed flanking each cutting site, with predicted amplicons sizes of 545 bp and 472 bp. Clone 1D was identified as a homozygous knock-out clone by the presence of ~680 pb PCR band generated with KO primers and the absence of bands using the two different sets of WT primers (FIG. 14B). In addition, genomic DNA was isolated from the indicated targeted HuES8 clones. Sequencing results of the clone 1D PCR product demonstrated successful deletion of HLA-B and HLA-C genes in HuES9 (FIG. 14C).

Figure 14D:
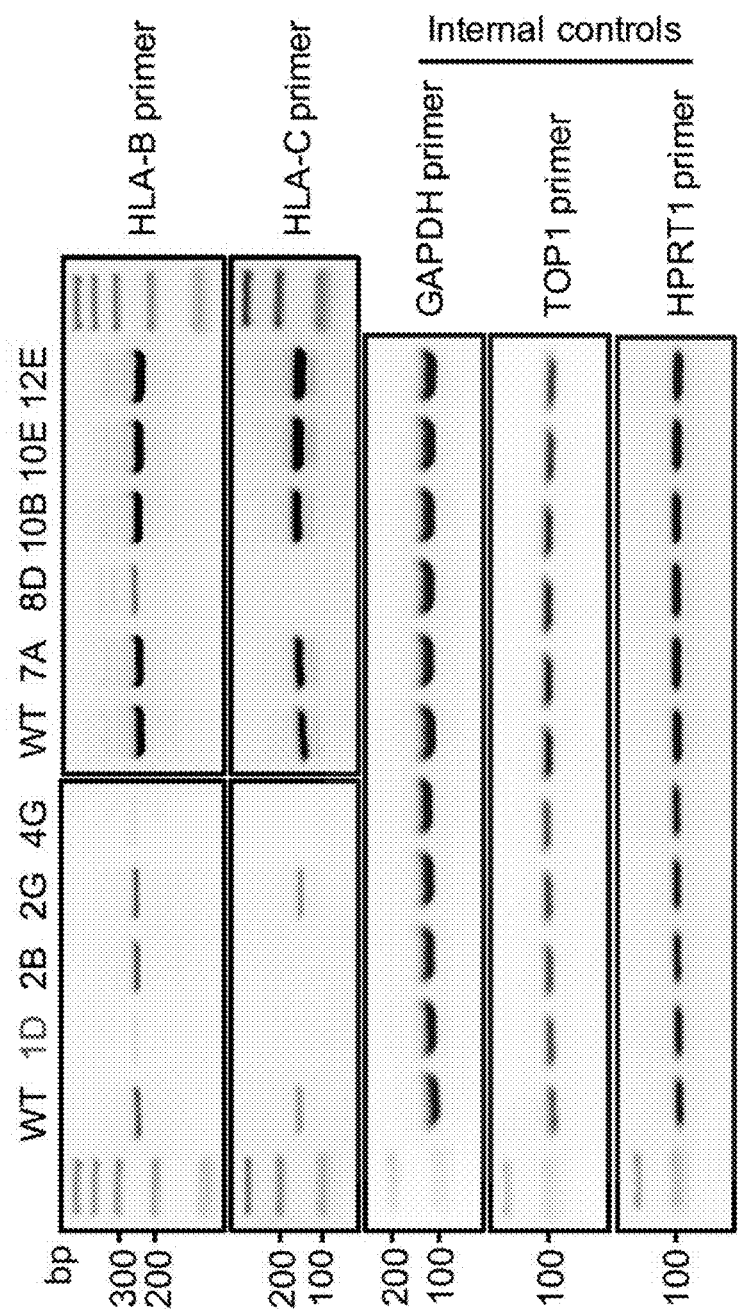
Figure 14E:
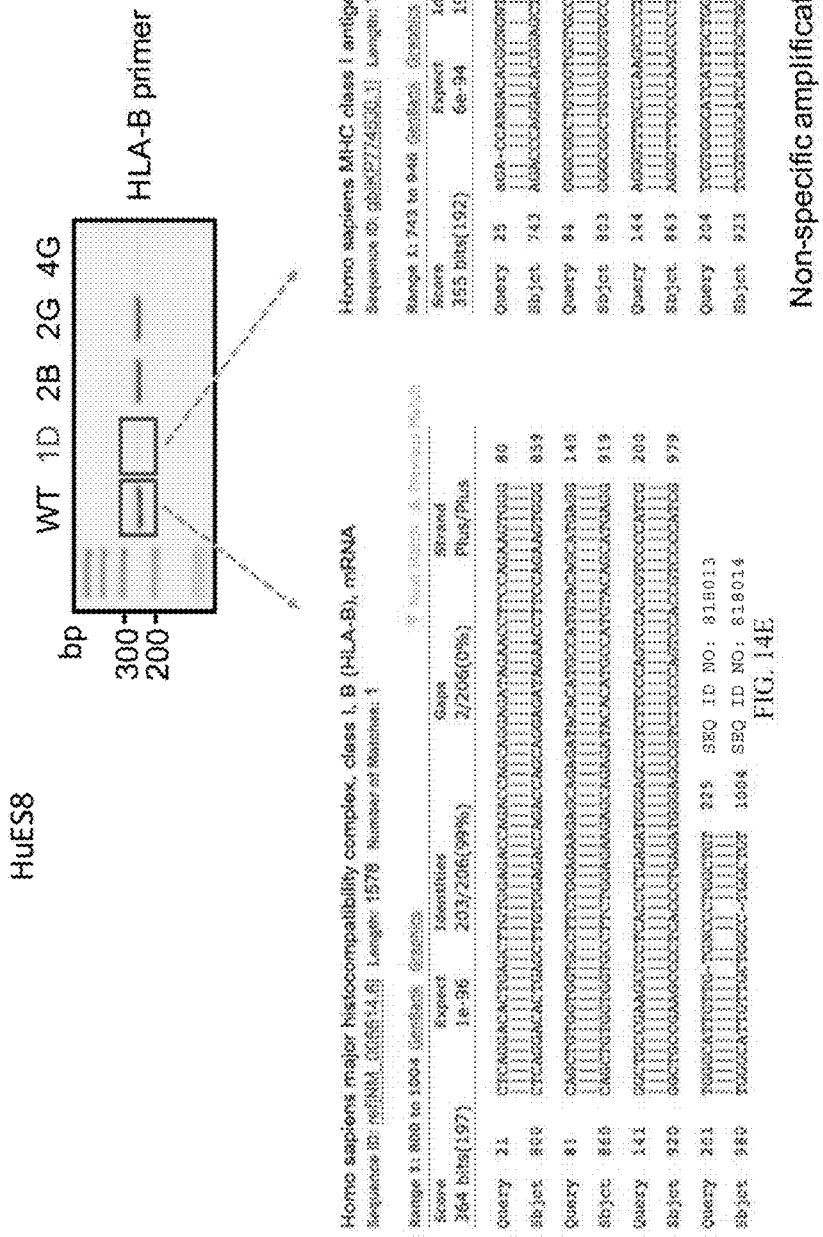
Figure 14F:
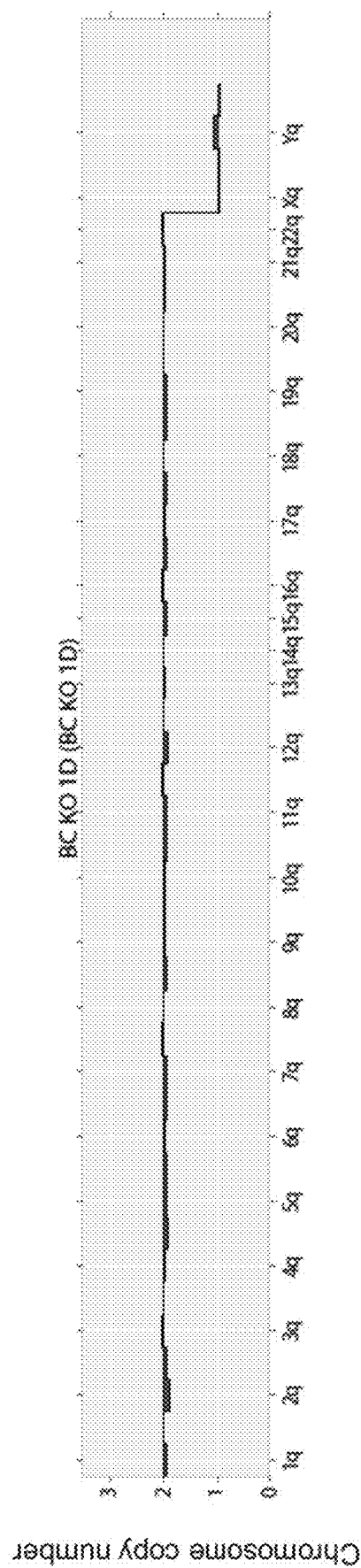

Further, RT-PCR with HLA-B and HLA-C specific primers demonstrated the mRNA expression of HLA-B and HLA-C in clone 1D was eliminated (FIG. 14D). GAPDH, TOP1 and HPRT1 were used as internal controls. WT and clone 1D RT-PCR products amplified with HLA-B primers were sequenced and identified as HLA-B and HLA-A mRNAs, respectively using BLAST (FIG. 14E). These results demonstrated that in the absence of the HLA-B gene, the HLA-B specific primers will amplify HLA-A mRNA in HuES8 clone 1D. HuES8 clone 1D displays a normal karyotype as assessed by NanoString nCounter set (FIG. 14F).

Figure 14G:
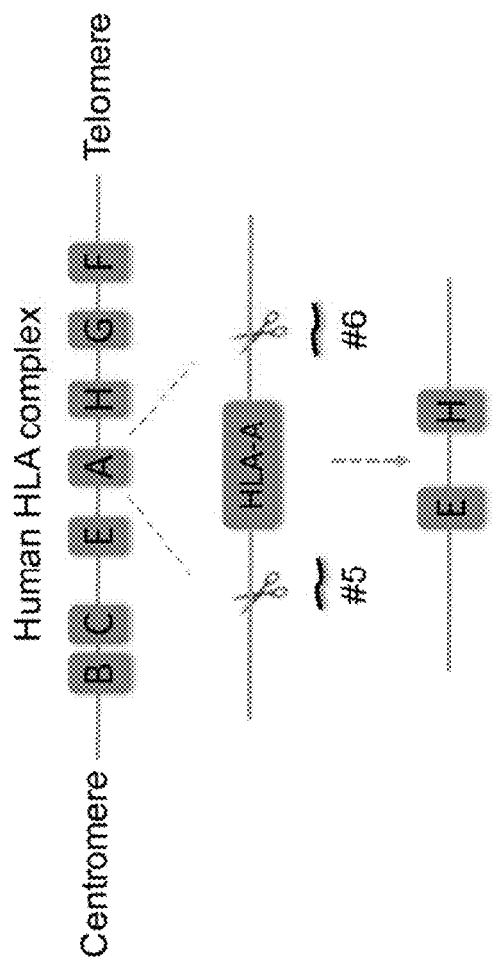
Figure 14H:
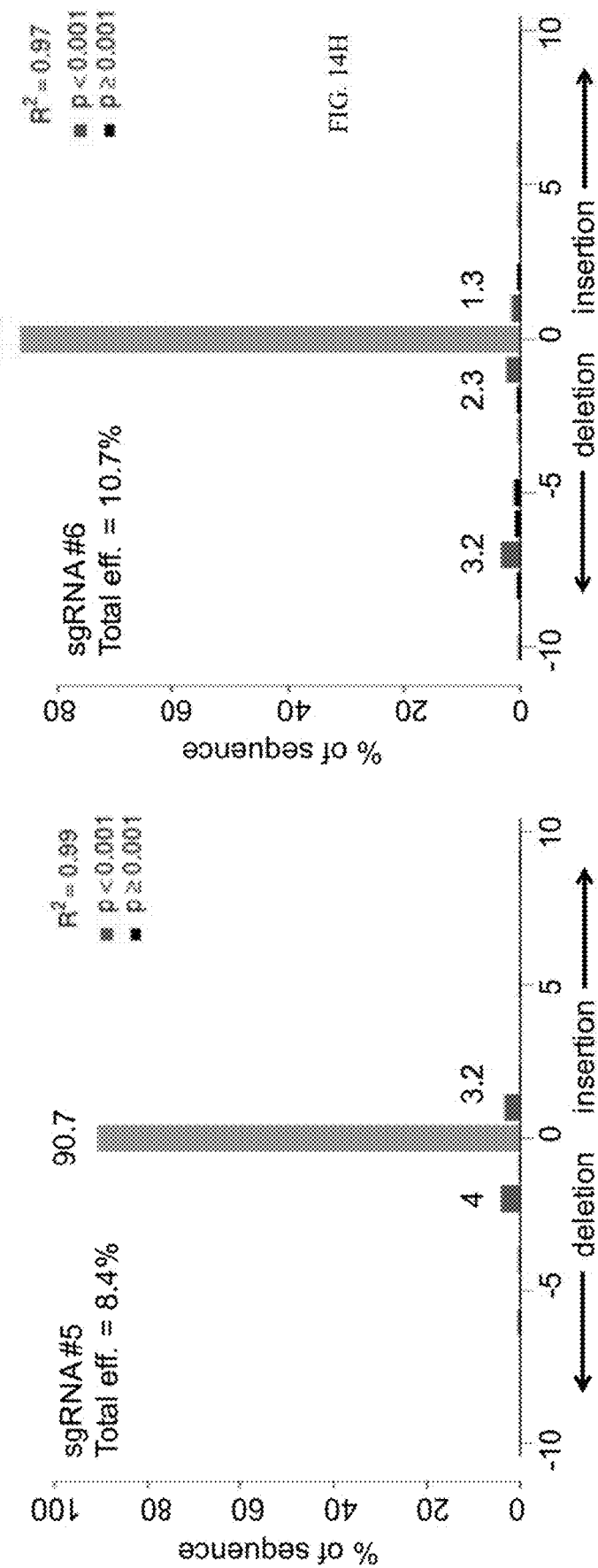

A schematic demonstrating an HLA-A knockout strategy using the dual sgRNA approach is provided in FIG. 14G. The schematic shows the position of the two sgRNAs (#5 and #6) that were designed to bind upstream and downstream of HLA-A. The on-target cutting efficiency of sgRNA #5 and #6 was determined in 293T cells using TIDE (FIG. 14H).

Figure 14J:
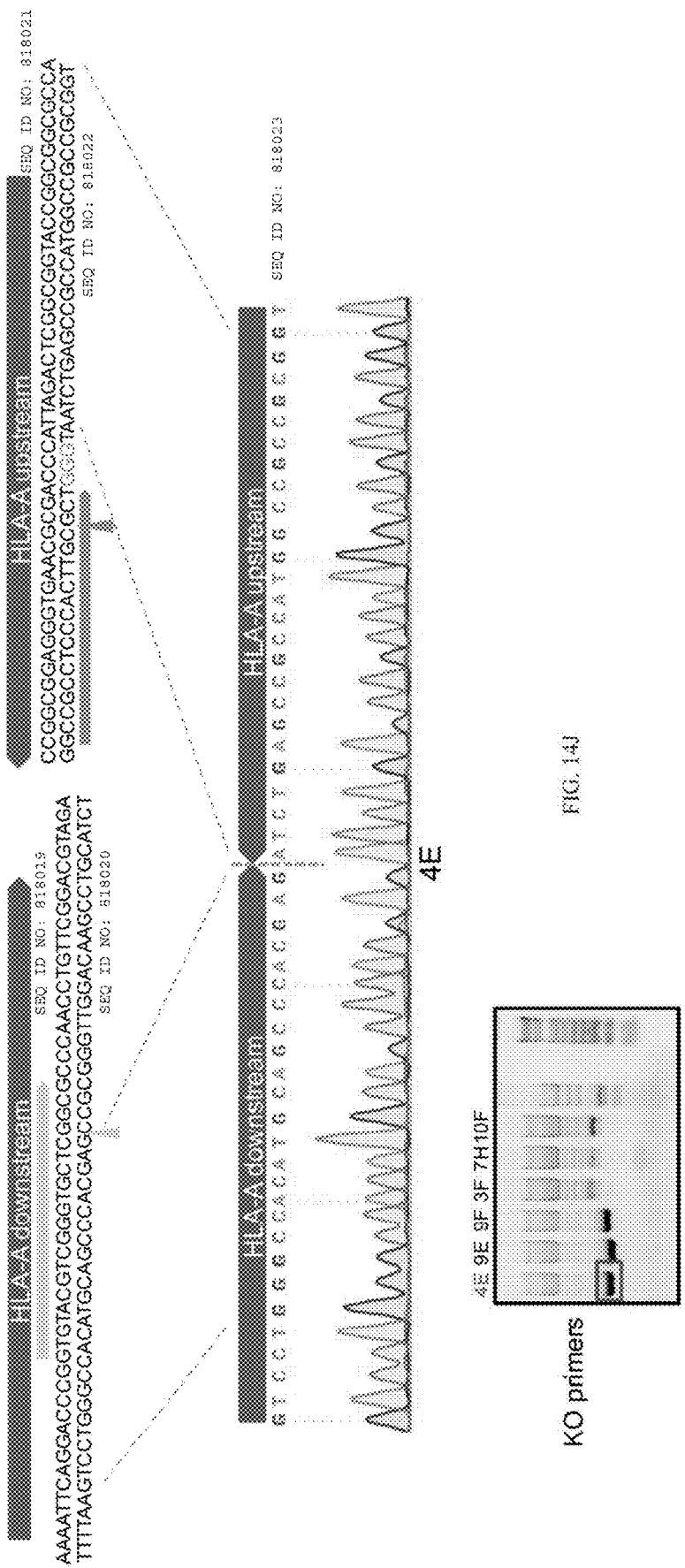

PCR screening confirmed that clone 4E was a heterozygous HLA-A knockout clone (FIG. 14I). The PCR screening strategy confirmed deletion of HLA-A in HuES8. KO primers were designed with one primer annealing upstream and one primer annealing downstream of the cutting sites. Upon HLA-A deletion, the resulting amplicon was observed as 220 bp on a 2% agarose gel. Two pairs of WT primers were designed flanking each cutting site, with predicted amplicon sizes of 589 bp and 571 bp. Clone 4E was identified as a heterozygous clone due to the presence of bands generated with KO primers and WT primers amplified from genomic DNA (FIG. 14I). Sequencing of the PCR product amplified from the genomic DNA of clone 4E using KO primers demonstrated successful deletion of HLA-A in HuES8 (FIG. 14J).

Knock-Out of Transcriptional Regulators

Figures 3A, 3B:
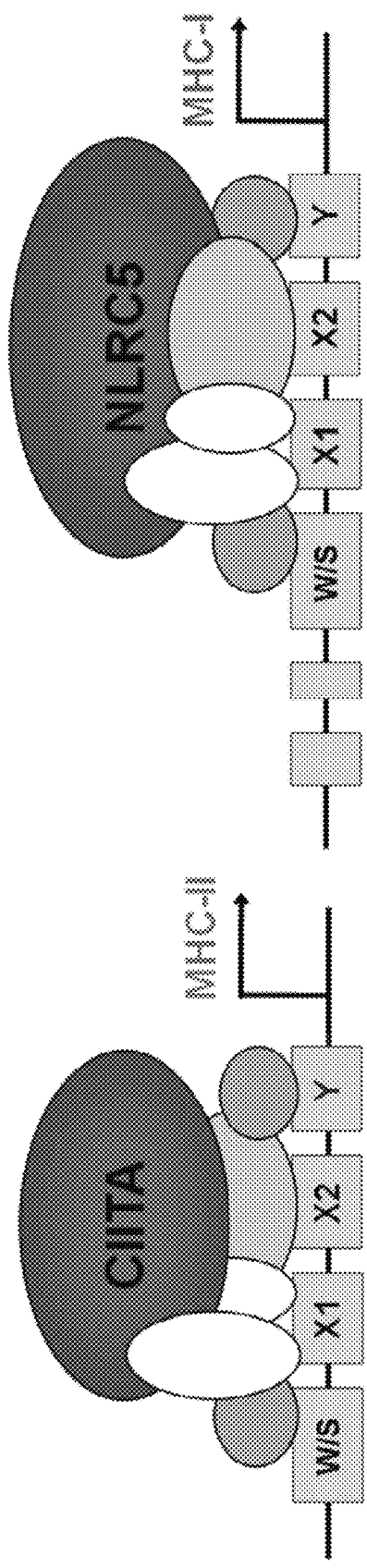
FIGS. 3A-3B illustrate targeting of transcriptional regulators of antigen presentation.
Figure 4:
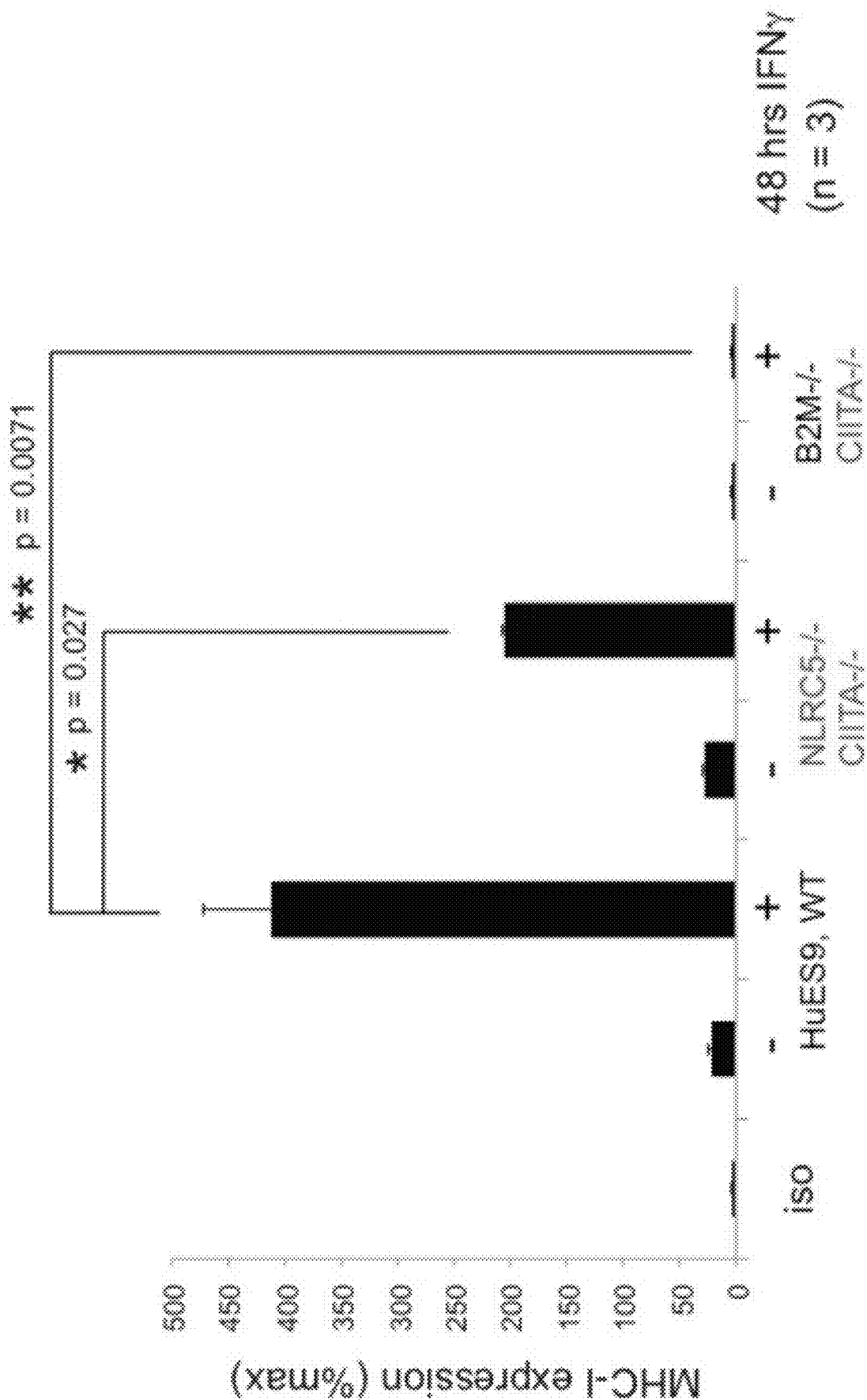
FIG. 4 illustrates MHC-I expression in WT HuES9 and the indicated modified mutant cell lines. Cells were stimulated for 48 hrs. with IFNγ and MHC-I expression was assessed by FACS.

As illustrated in FIGS. 3A-3B, in certain aspects, the inventions disclosed herein target the transcriptional regulators of antigen presentation (e.g., CIITA and/or NLRC5). The inventors have discovered that targeting and/or modulating the expression of such transcriptional regulators of antigen presentation provides a means to efficiently modulate (e.g., reduce or eliminate) the expression of the three classical MHC-Ia molecules, HLA-A, HLA-B, and HLA-C, and thereby produce hypoimmunogenic universal stem cell lines that are useful for cell replacement therapy. As evidenced in FIG. 4, the present inventors have demonstrated that such genome-edited cells are characterized by reduced MHC-I expression relative to the WT HuES9 cells, as assessed by FACS. Reduced or eliminated MHC-I surface expression was observed in those stem cells in which the expression of NLRC5, CIITA and B2M was modulated using the CRISPR/Cas system. In particular, FIG. 4 evidences low basal MHC-I expression in stem cells which can be increased by IFN-γ, that an approximately 50% reduction of MHC-I surface expression was observed in the IFN-γ-treated NLRC5$^{-/-}$ stem cells and that a complete loss of MHC-I surface expression was observed in the B2M$^{-/-}$ stem cells.

Figures 5A, 5B, 5C:
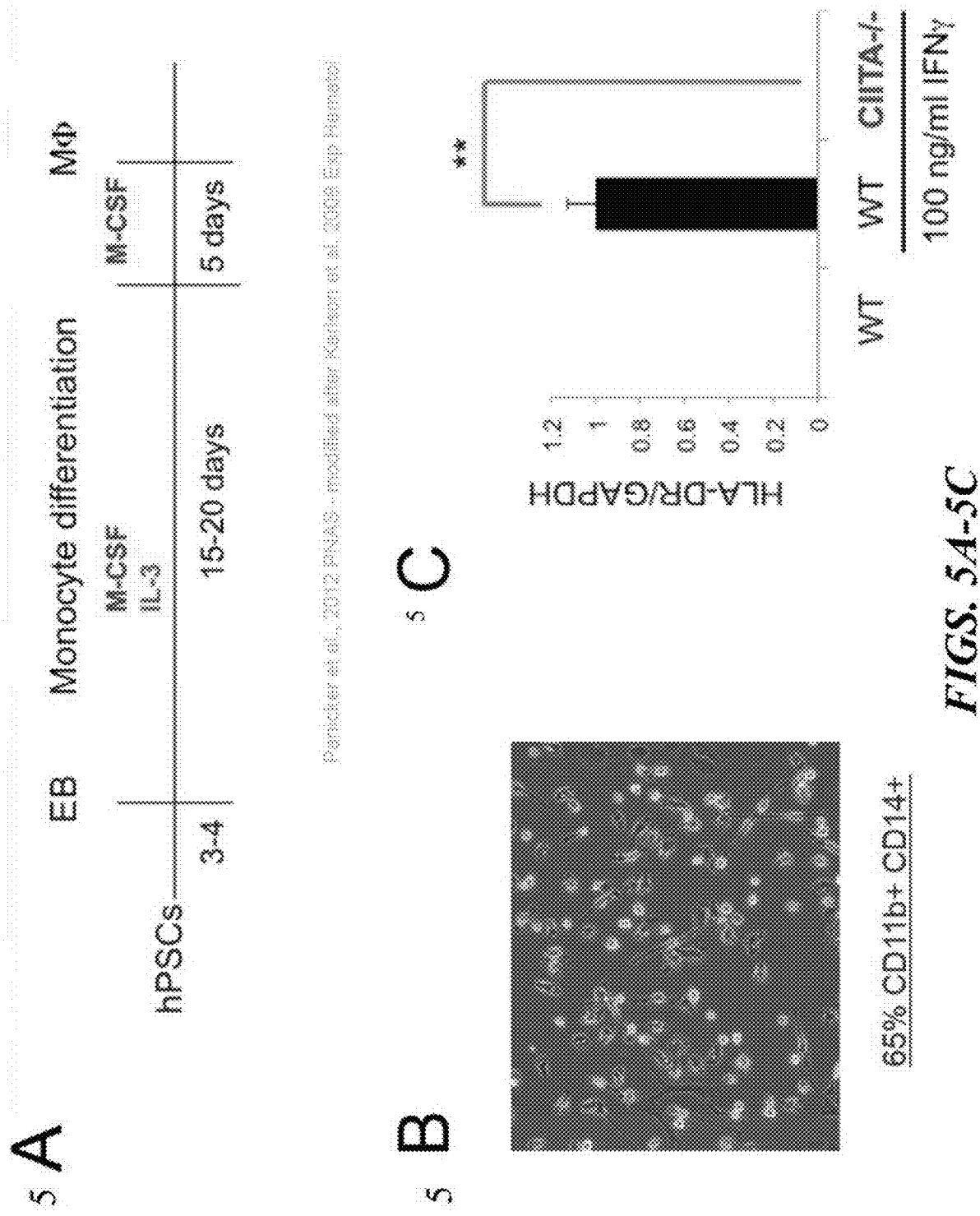
FIGS. 5A-5C illustrate that CIITA-deficient stem cell-derived macrophage lack MHC-II expression.
Figures 10A, 10B:
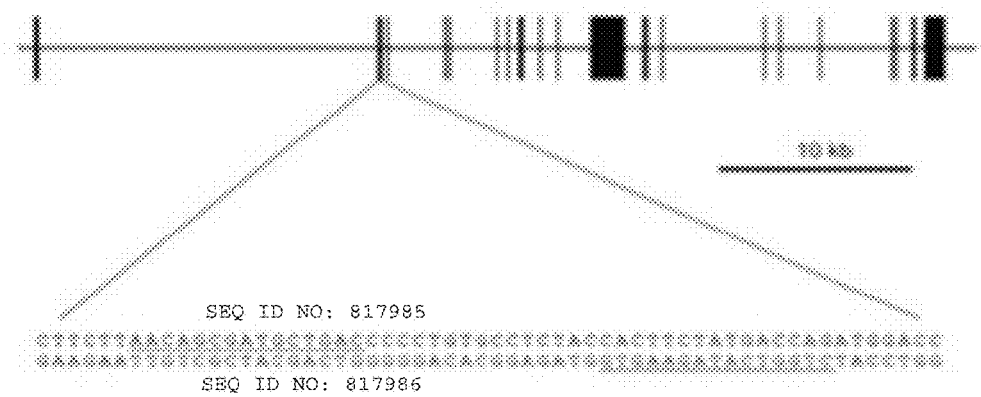
FIGS. 10A-10B illustrate targeting of the first coding exon of the CITTA gene.

Similar results were observed on MHC-II expression following modulation of the expression of CIITA. The present inventors differentiated the genome-edited CIITA$^{-/-}$ stem cell line into macrophage, which are antigen presenting cells. As depicted in FIG. 5C, the CIITA-deficient stem cell-derived macrophage lacked MHC-II expression, thus clearly showcasing the expected phenotype. In particular, by targeting the first coding exon of the CIITA gene (FIGS. 10A-10B), the foregoing results evidence that MHC-II expression can be efficiently abrogated.

Figure 6:
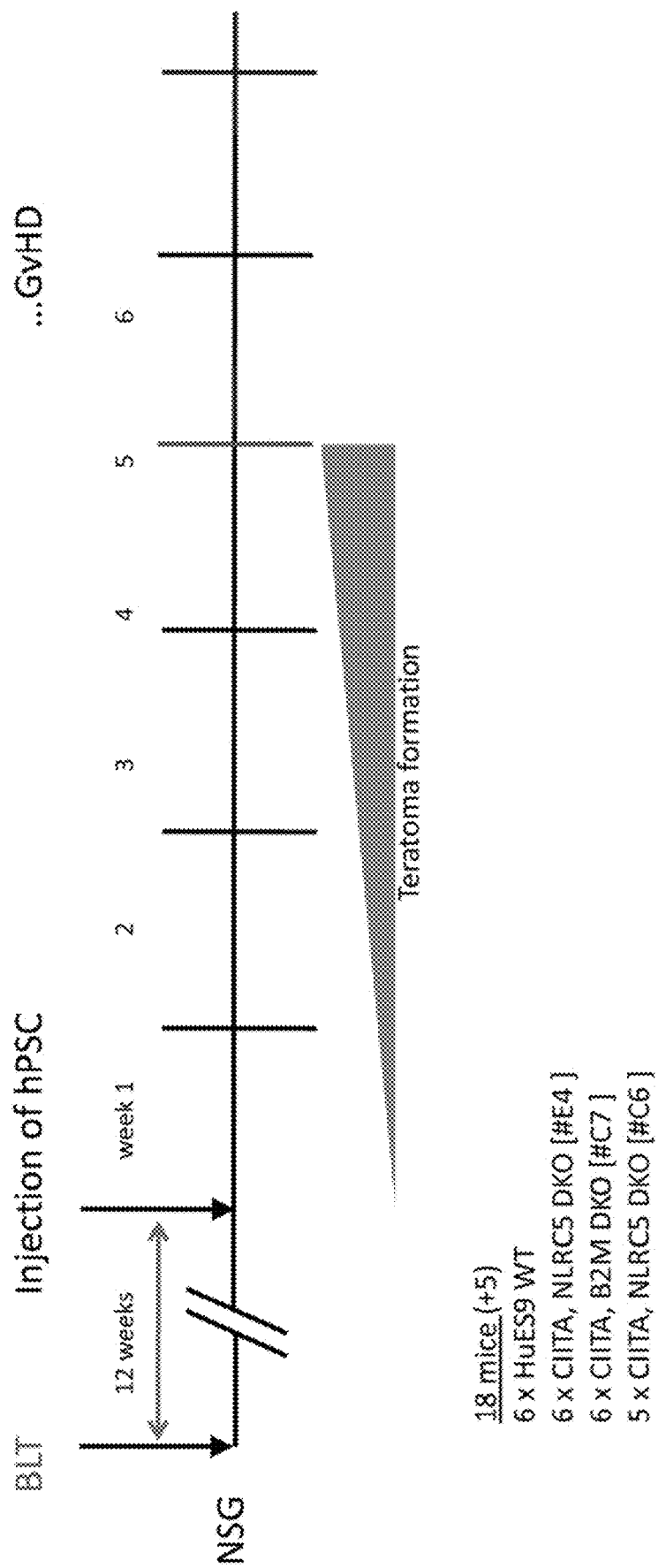
FIG. 6 illustrates a time line of the teratoma rejection study disclosed herein in which humanized NSG mice—BLT mice are given 3 months to fully reconstitute a human immune system before injection of the indicated genome-edited stem cell lines.
Figure 7:
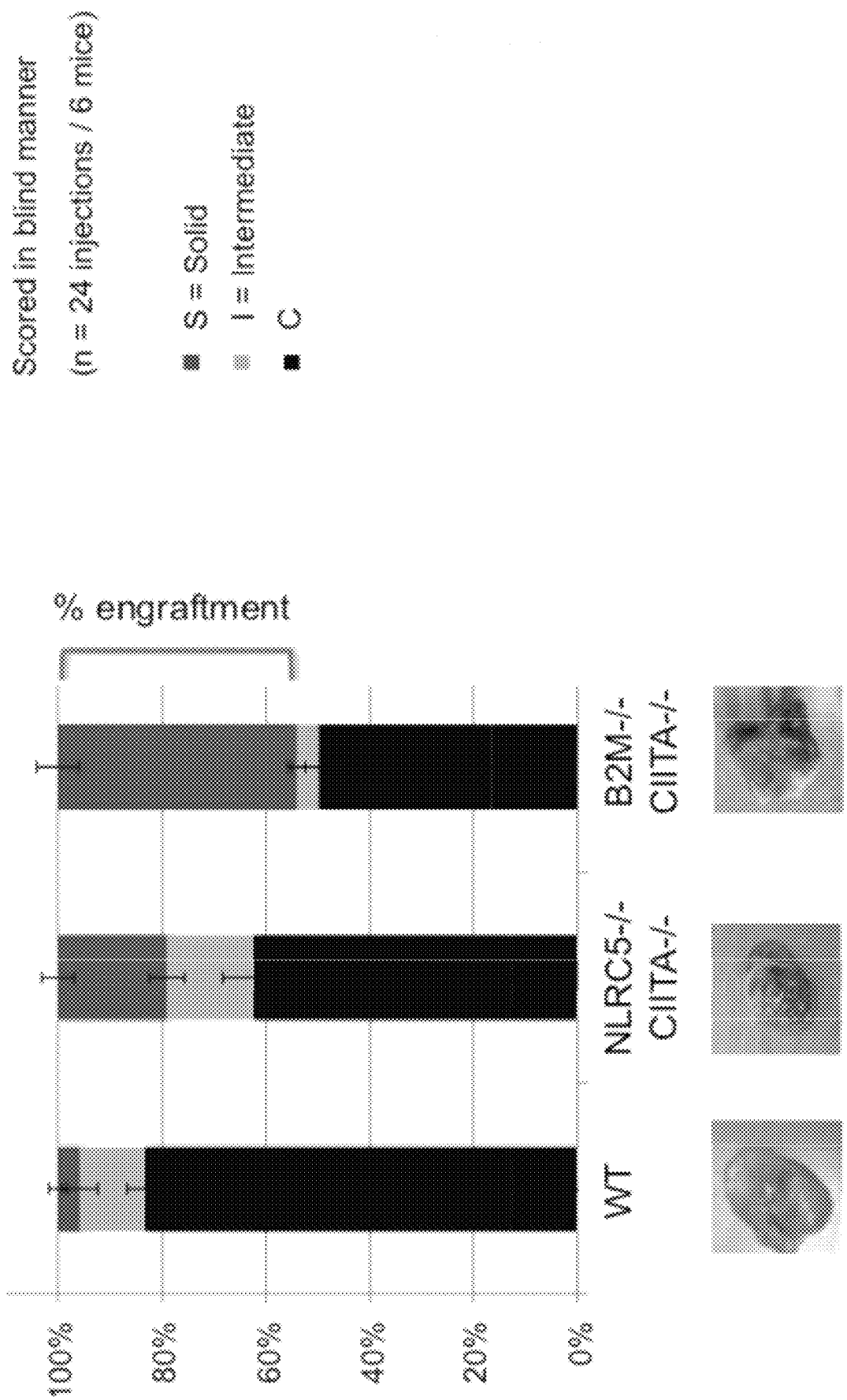
FIG. 7 demonstrates improved engraftment of genome-edited stem cells in humanized mice. Illustrated are the quantification of teratoma type observed following the teratoma rejection study depicted in FIG. 6. Upon review of the morphology of the teratoma samples, a clear phenotype that correlates with the levels of MHC-I expression was observed.
Figures 9A, 9B, 9C, 9D:
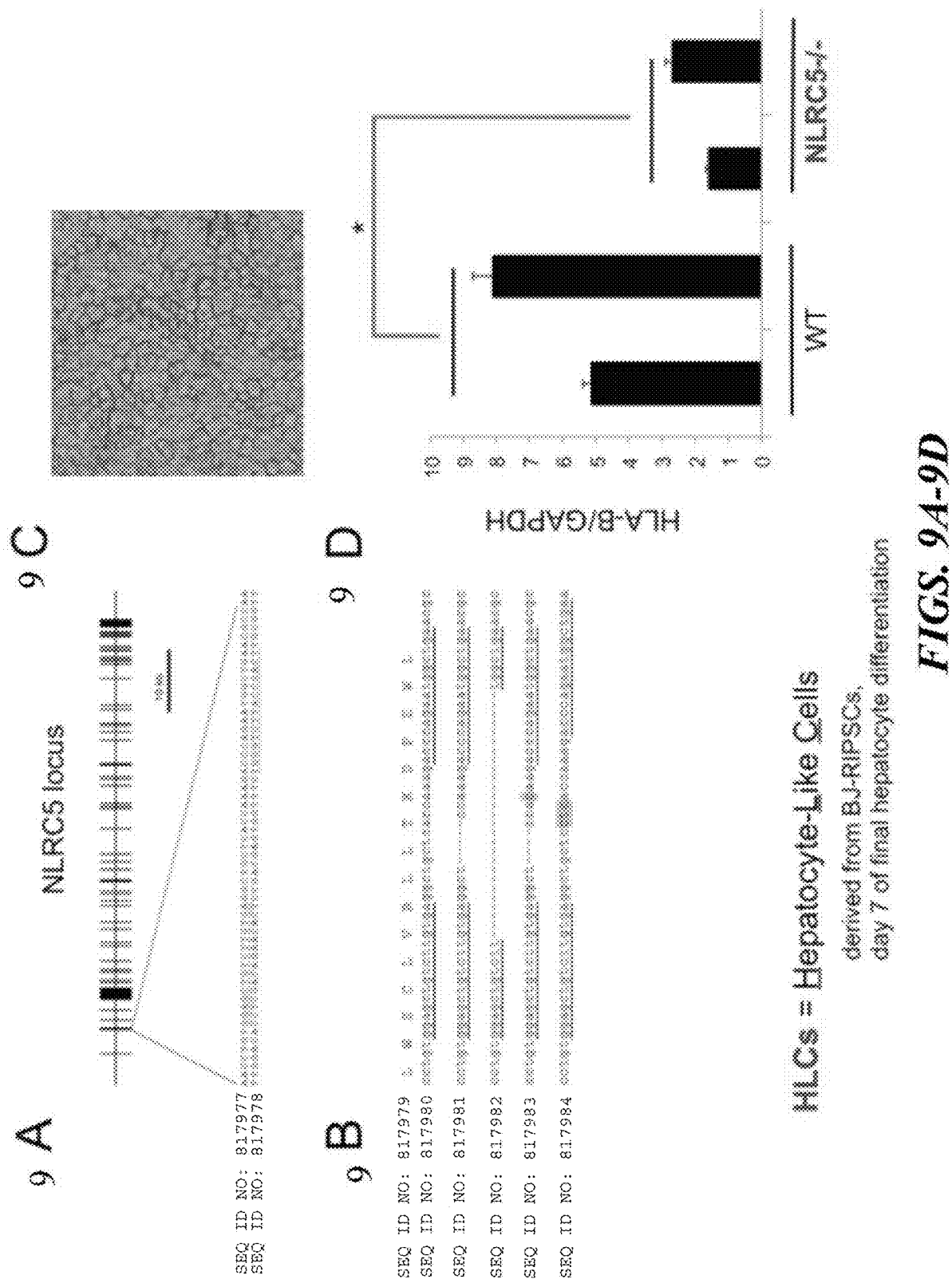
FIGS. 9A-9D demonstrate that the deletion of NLRC5 using TALENs results in reduced MHC-I expression in induced pluripotent stem cell-derived hepatocyte-like cells (HLCs).

The functional consequences of reduced HLA expression in the genome-edited cells were next evaluated in a humanized mouse model that was prepared by reconstituting an immunocompromised mice model with a human immune system (FIG. 6). As illustrated in Table 1 below, a comparable number of teratomas formed in all cases, irrespective of the genotype and the whole colony had to be sacrificed. Similarly, no differences in the failure rates of teratoma formation was observed. The inventors looked more closely at the overall morphology of the teratoma samples and a clear cut phenotype that correlates with the levels of MHC-I expression was identified. NLRC5, reduced, B2M absent MHC-I on the surface. FIG. 7 illustrates the quantification of the resulting teratoma types. FIGS. 8A-8C further demonstrate CD8+ T cell proliferation in wild-type cells and suggests immune rejection of the wild-type teratomas and improved engraftment of the genome-edited cells in the humanized mouse model.

TABLE 1

| | Genotype | #tumors (injections) |
|---|---|---|
| p42 | WT | 21 (24) |
| E4 | NLRC5-/-CIITA-/- | 21 (24) |
| C7 | B2M-/-CIITA-/- | 20 (24) |
| C6 | NLRC5-/-CIITA-/- | 18 (20) |

The foregoing results therefore demonstrate successful targeting of NLRC5, CIITA and B2M in HuES9 and BJ RiPSCs and further evidence that genome-edited cells can be differentiated into a variety of different cell types that are characterized by reduced HLA expression.

The inventors have used both a TALENs system and a CRISPR/Cas system to facilitate the targeting of transcriptional regulators of HLA expression (i.e., the MHC enhanceosome). TALEN-induced CIITA and NLRC5 mutations in BJ-RIPSCs and HuES9 are illustrated in FIGS. 15A-D. In addition, NLRC5 and CIITA can also be targeted utilizing CRISPRs to achieve a reduction in MHC class I expression and complete loss of MHC class II expression, respectively.

Figure 16B:
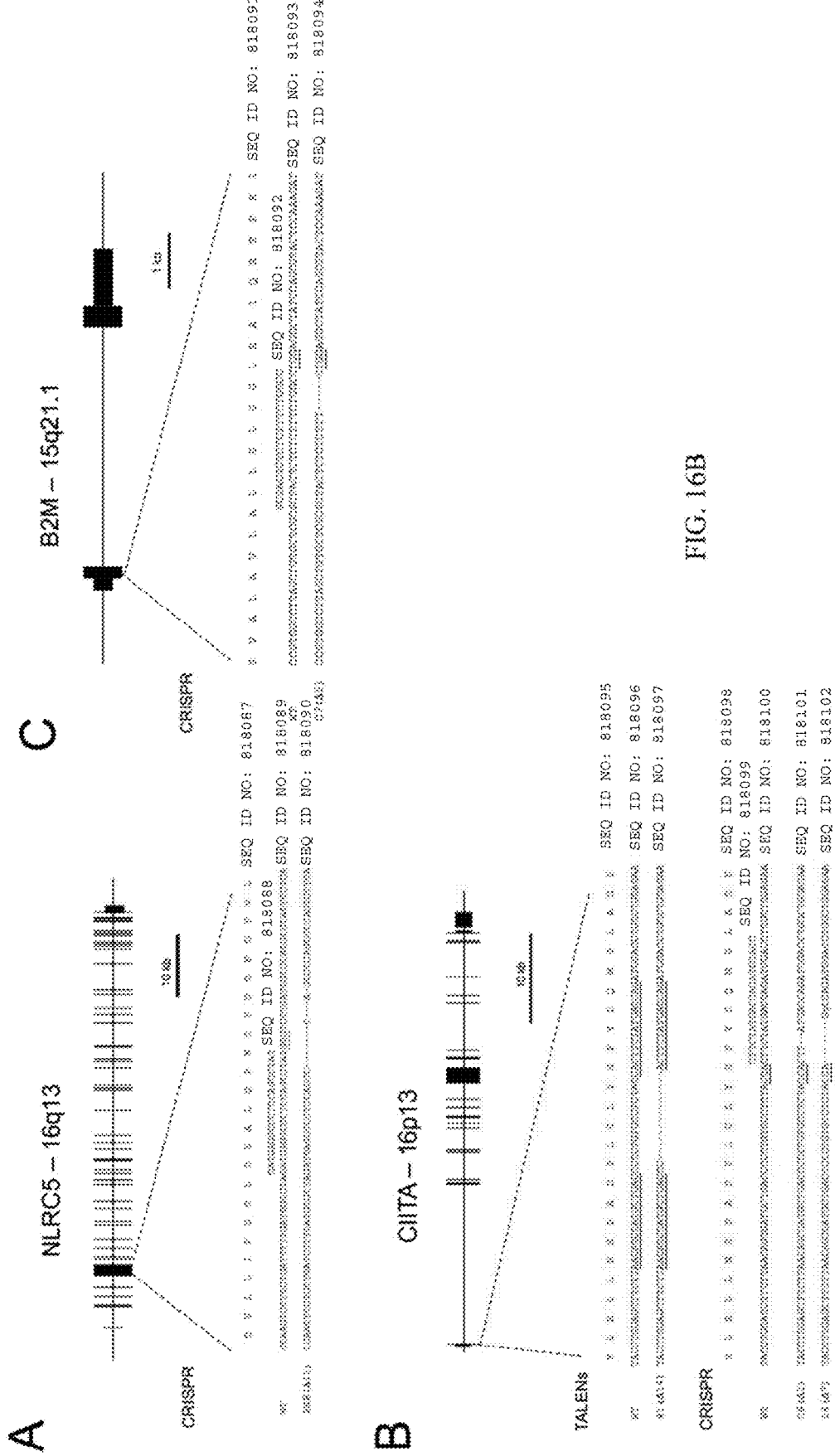
Figure 16C:
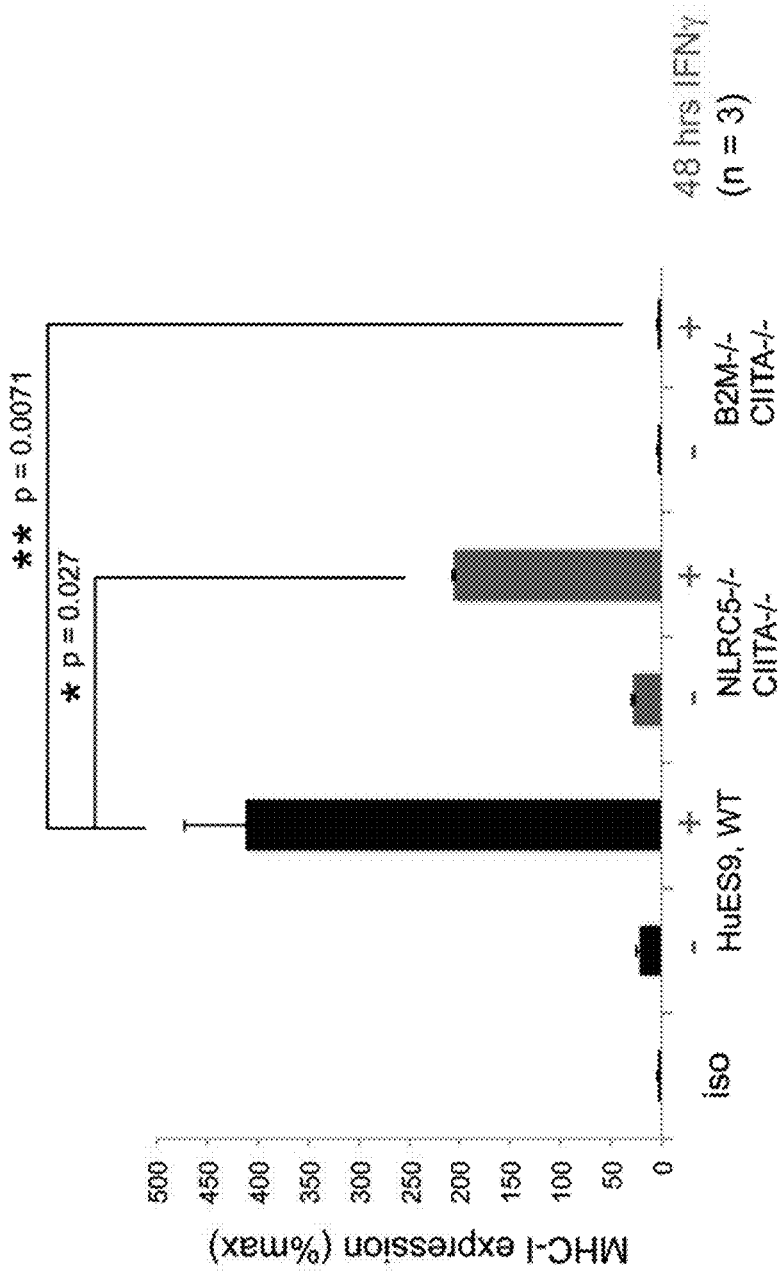

NLRC5 was targeted in Thp1 cells using CRISPR and it was demonstrated that MHC-I expression in NLRC5−/− Thp1 cells was reduced (FIG. 16A). Examples of CRISPR and/or TALENs systems targeting NLRC5, CIITA and B2M are provided in FIG. 16B. Reduced MHC class I expression in HuES9 was shown following targeting with NLRC5 or B2M CRISPRs. For example, about 50% reduction was shown in IFNγ-treated NLRC5−/− cells and complete loss of MHC-I surface expression was shown in B2M−/− cells (FIG. 16C).

Figure 16D:
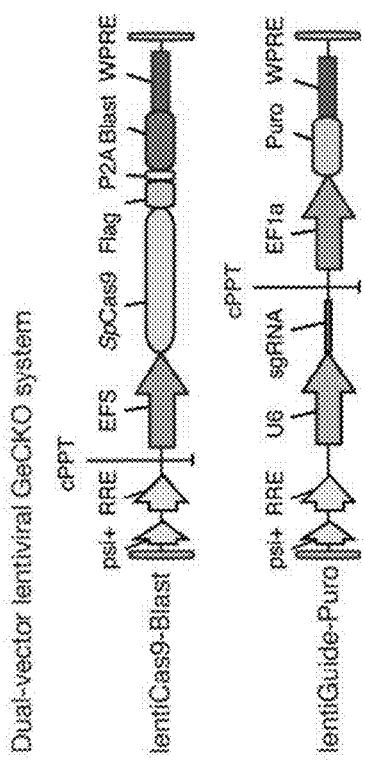
Figure 16F:
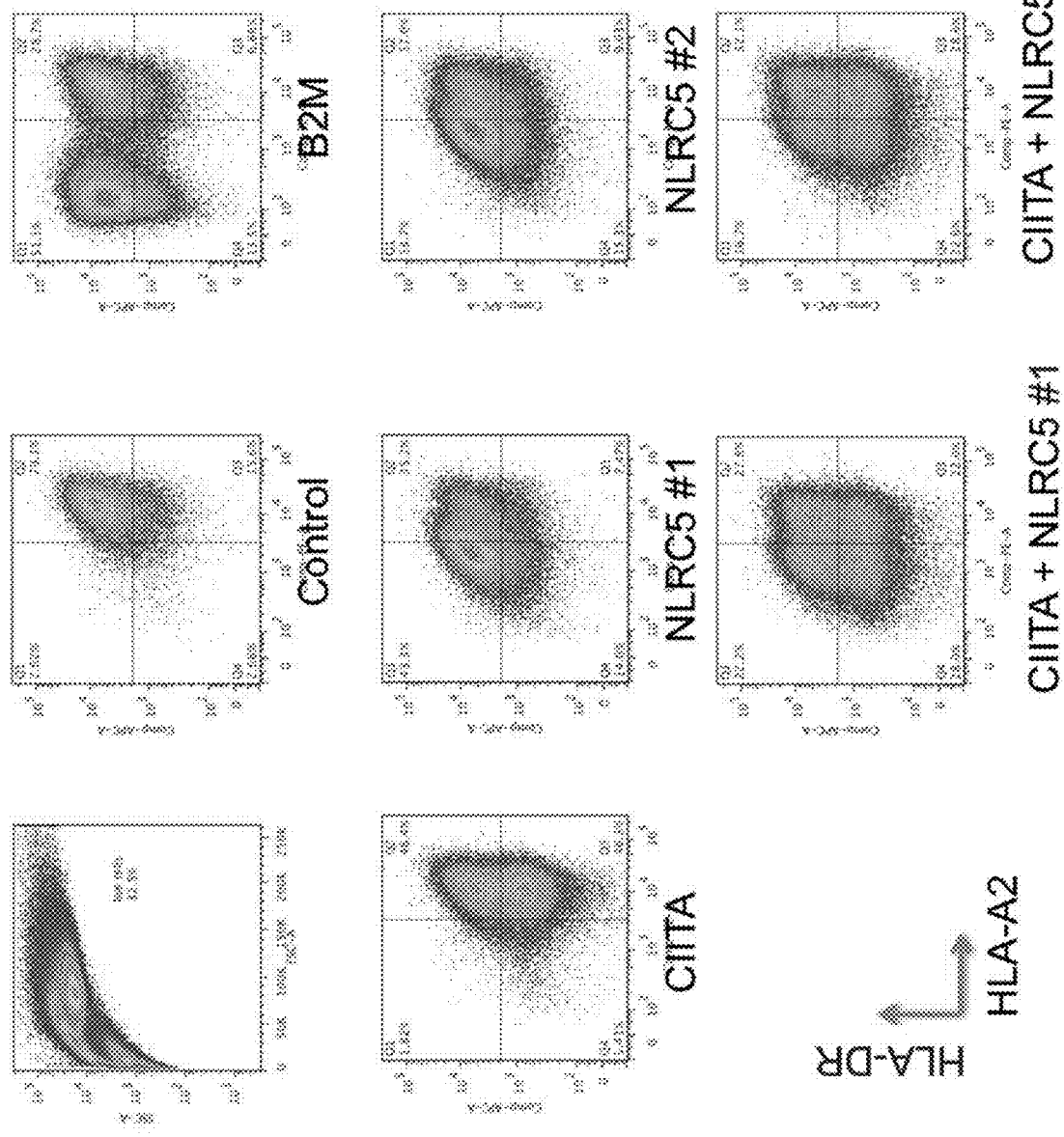
Figure 16G:
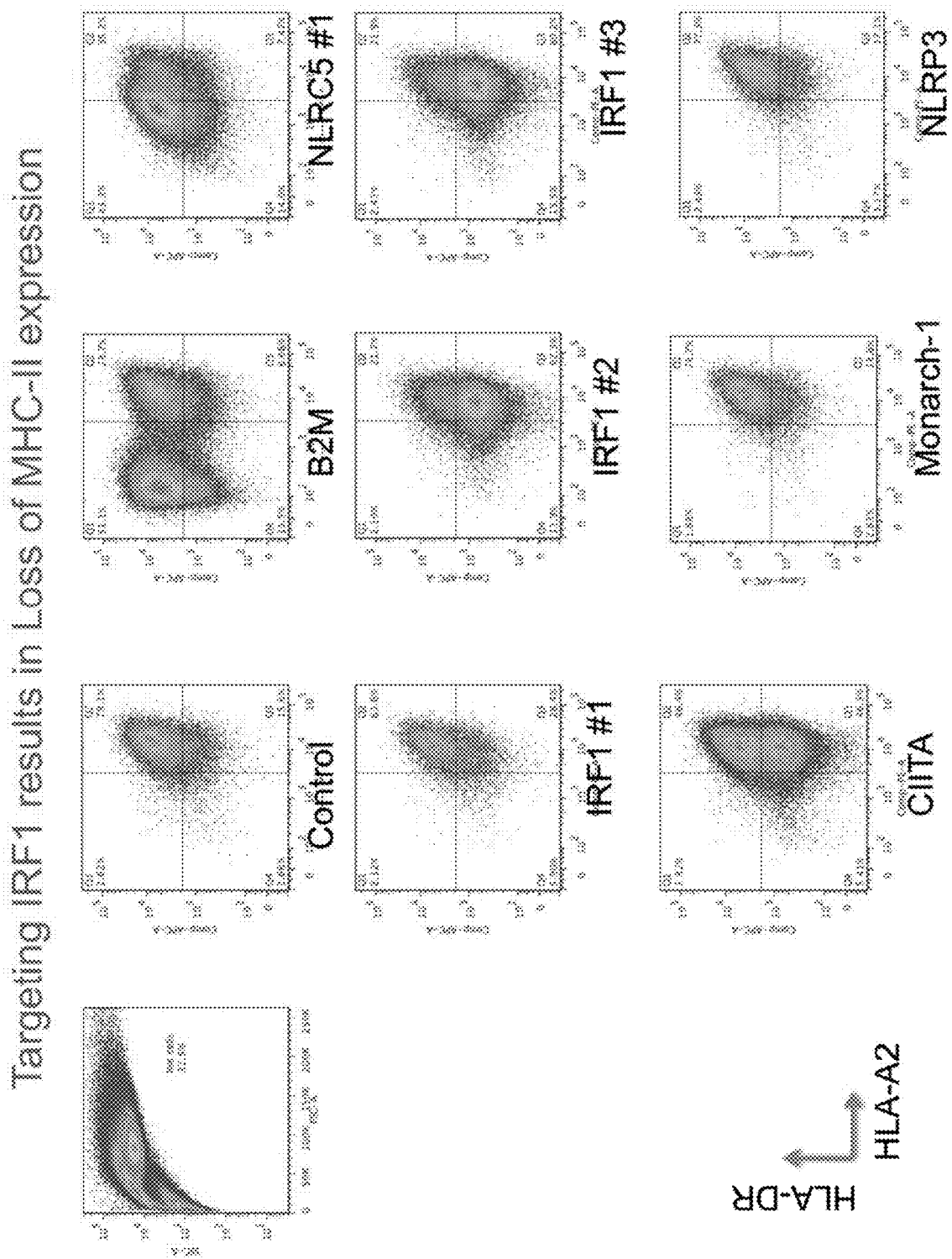

A lentiviral transduction of Thp-1 was conducted using a two component (e.g., dual vector) system (FIG. 16D). The two component system included Lenti-Cas9-Blasticidin and Lenti-Guide-puro. Examples of the different CRISPRs used for the lentiviral transduction of Thp-1 are provided in FIG. 16E. Thp-1 was transduced with lentivirus encoding NLRC5 and CIITA. A B2M CRISPR was used as a positive control. All of the cells were stimulated ON with 50U IFNγ to boost HLA expression (HLA-A2 was 1:200 and HLA-DR was 1:100). It was demonstrated that CIITA and NLRC5 act independently on MHC-II and MHC-I, respectively (FIG. 16F). At ten days post CRISPR transduction, when the Thp1 cells were all stimulated ON with 50U IFNγ (HLA-A2 is 1:200 and HLA-DR is 1:100), it was demonstrated that targeting IRF1 results in a loss of MHC-II expression (FIG. 16G).

Figure 17A:
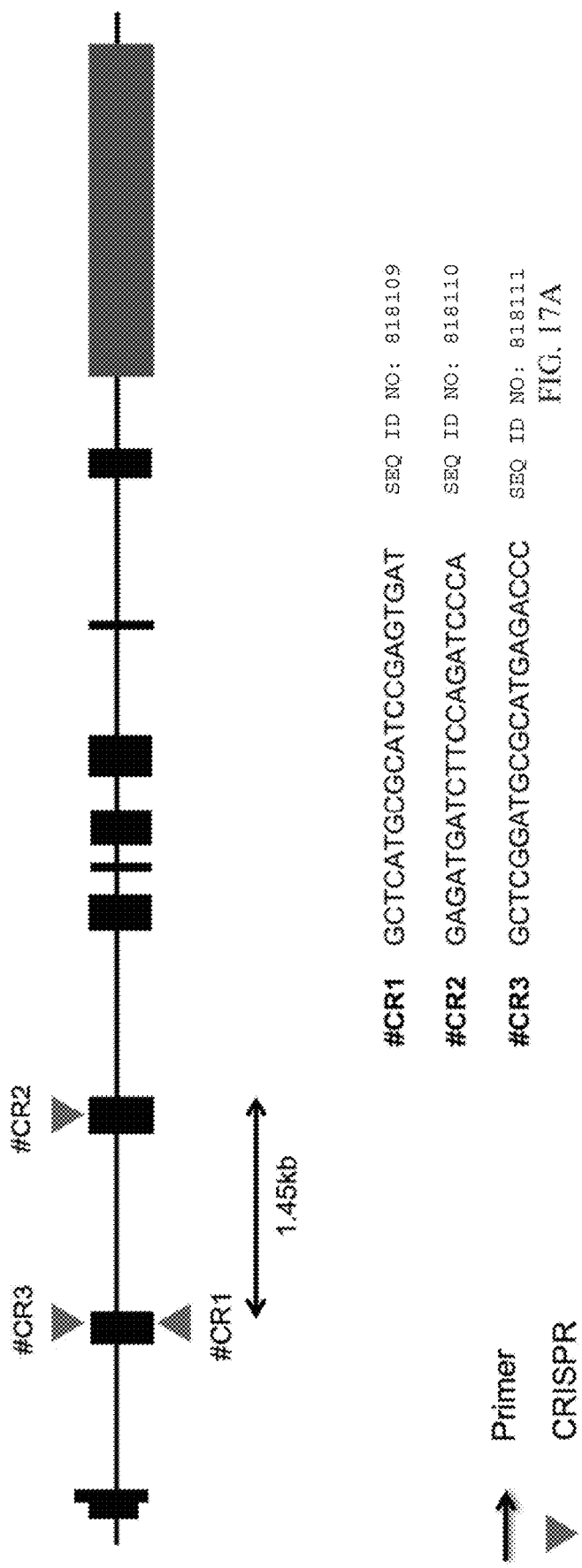
Figure 17B:
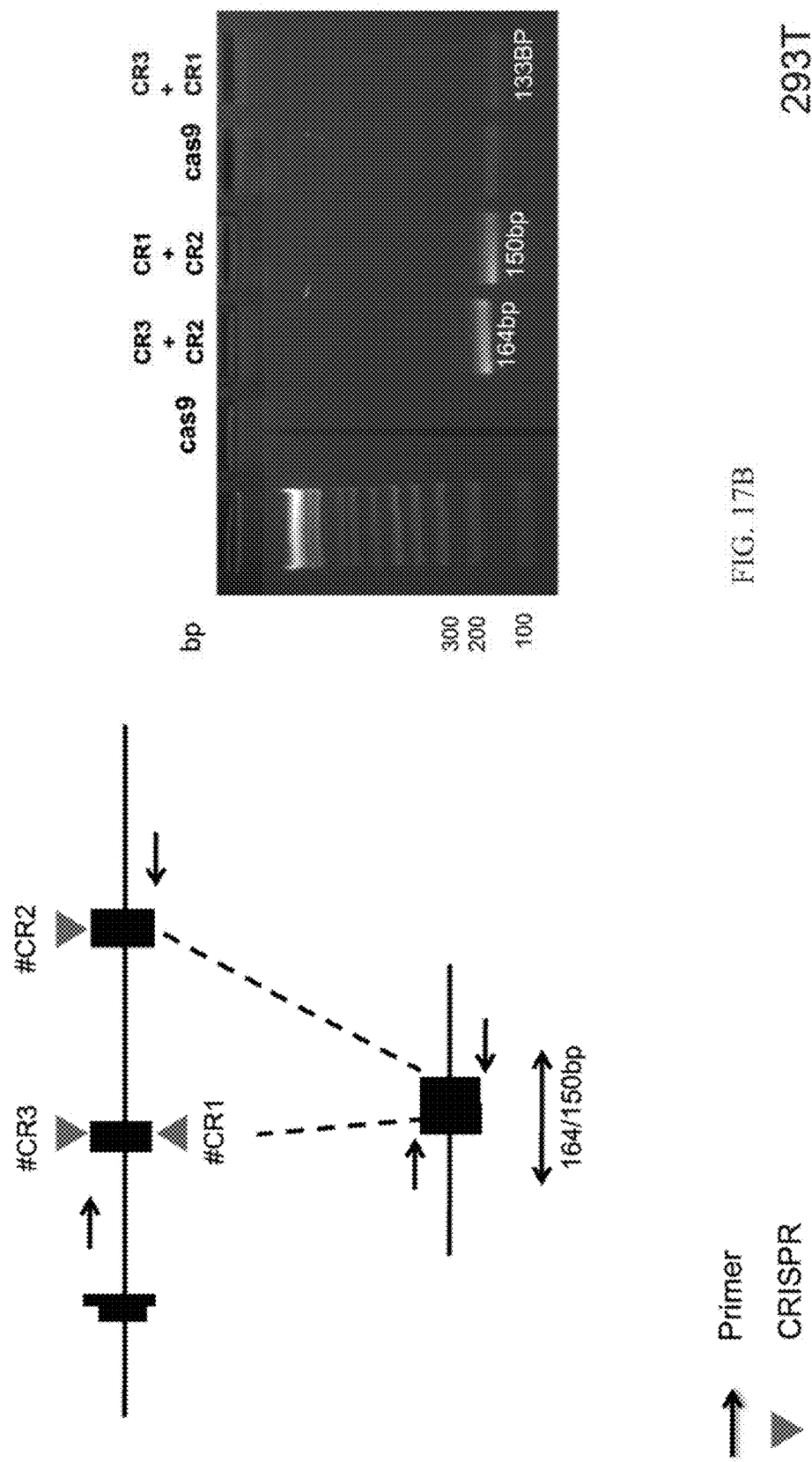
Figure 17C:
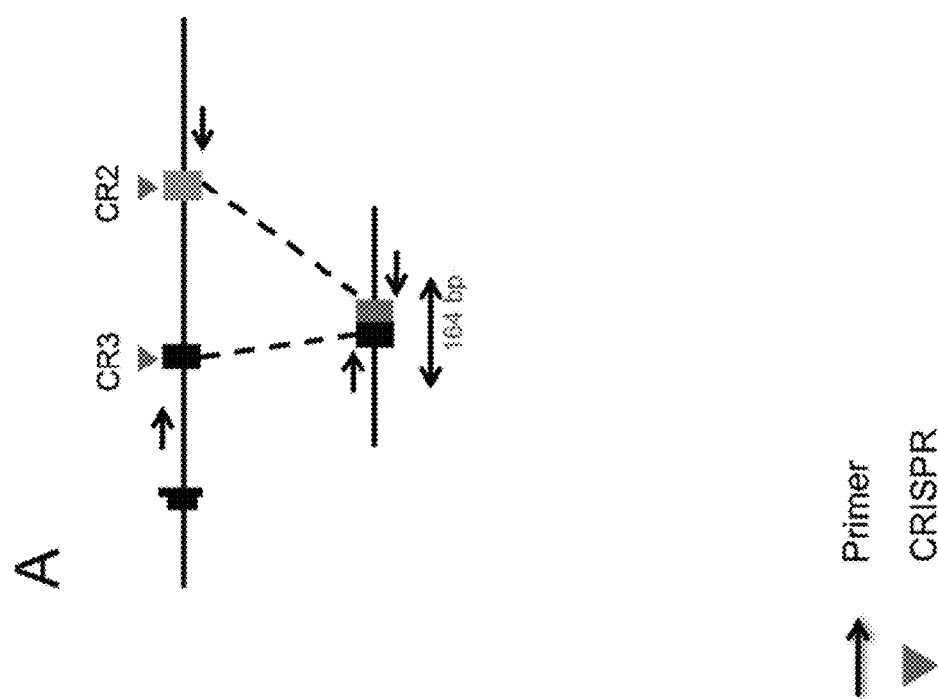
Figure 17D:
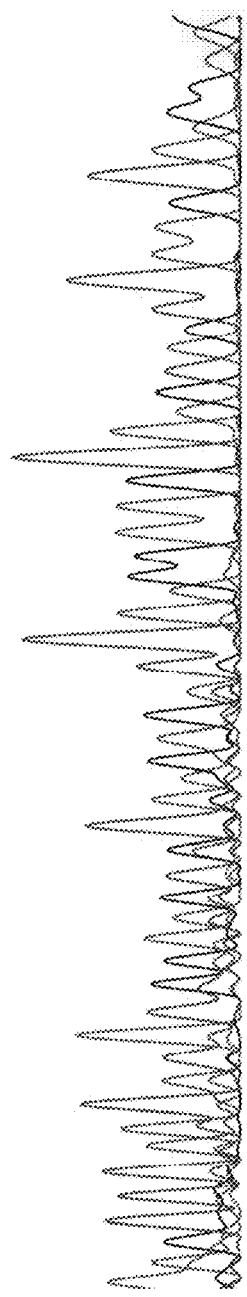
Figure 17E:
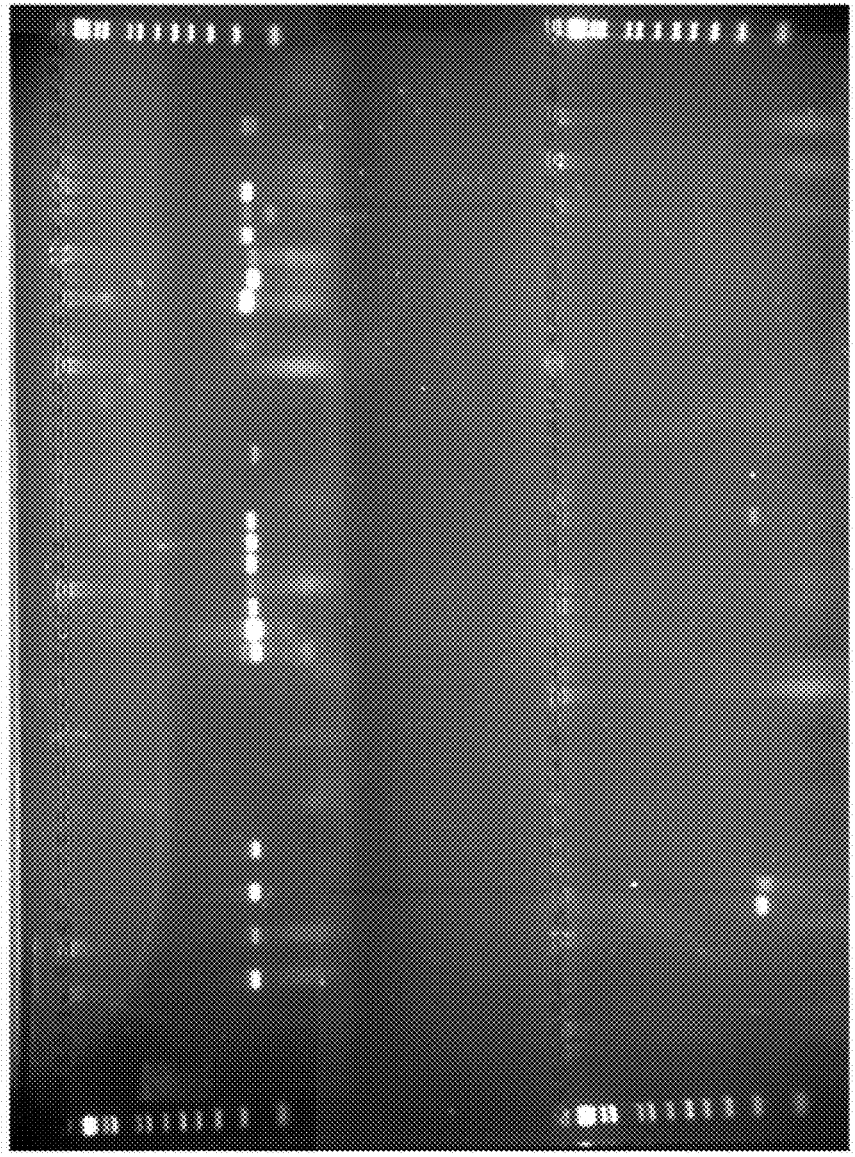

The inventors further examined targeting of IRF1 and the resultant reduced MHC class I expression in human pluripotent stem cells (HuES9) and Thp-1 cells. A schematic demonstrating a dual CRISPR strategy for targeting the IRF1 locus is provided in FIG. 17A. Testing of different IRF1 guide combinations was conducted (FIG. 17B) and a 'dual guide strategy' for the targeted deletion of IRF1 was identified (FIG. 17C). After the dual guide strategy for the targeted deletion of IRF1 was applied, a sequence confirmation of IRF1 CRISPR induced deletion was provided (FIG. 17D), followed by screening of IRF-1 targeted HuES9 cells (FIG. 17E). The presence of the PCR bands suggests successful targeting using the dual CRISPR strategy.

Figure 17F:
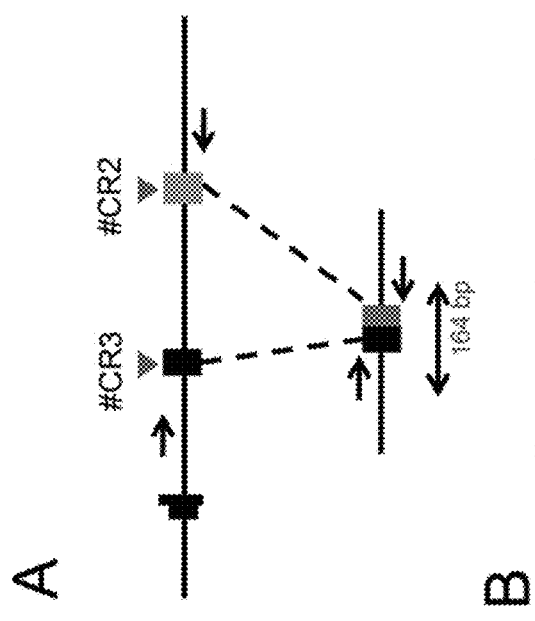
Figure 17H:
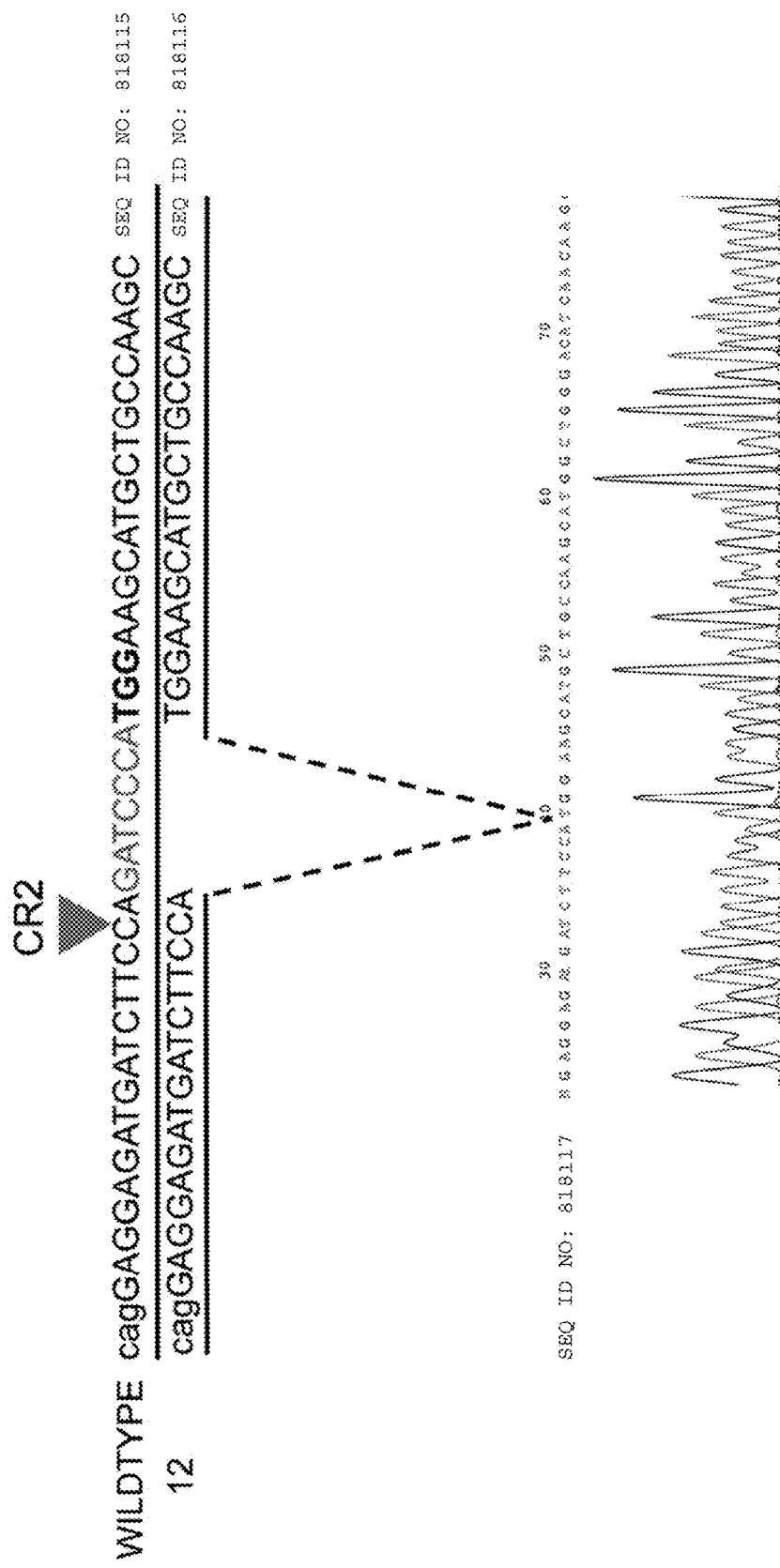
Figure 17I:
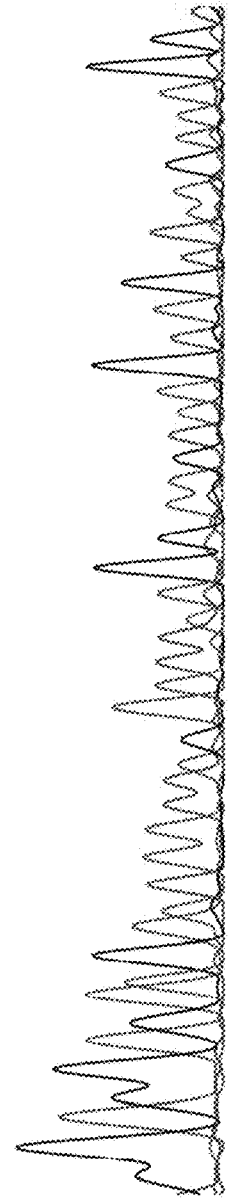
Figure 17J:
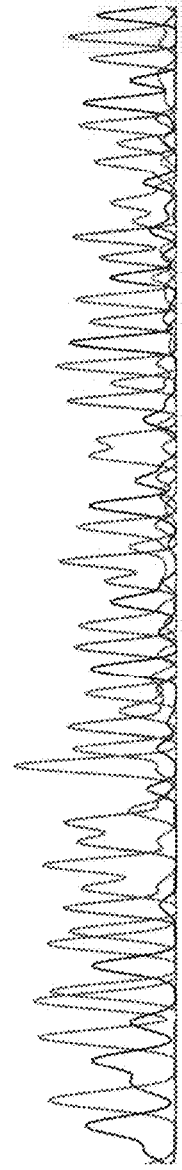
Figure 17K:
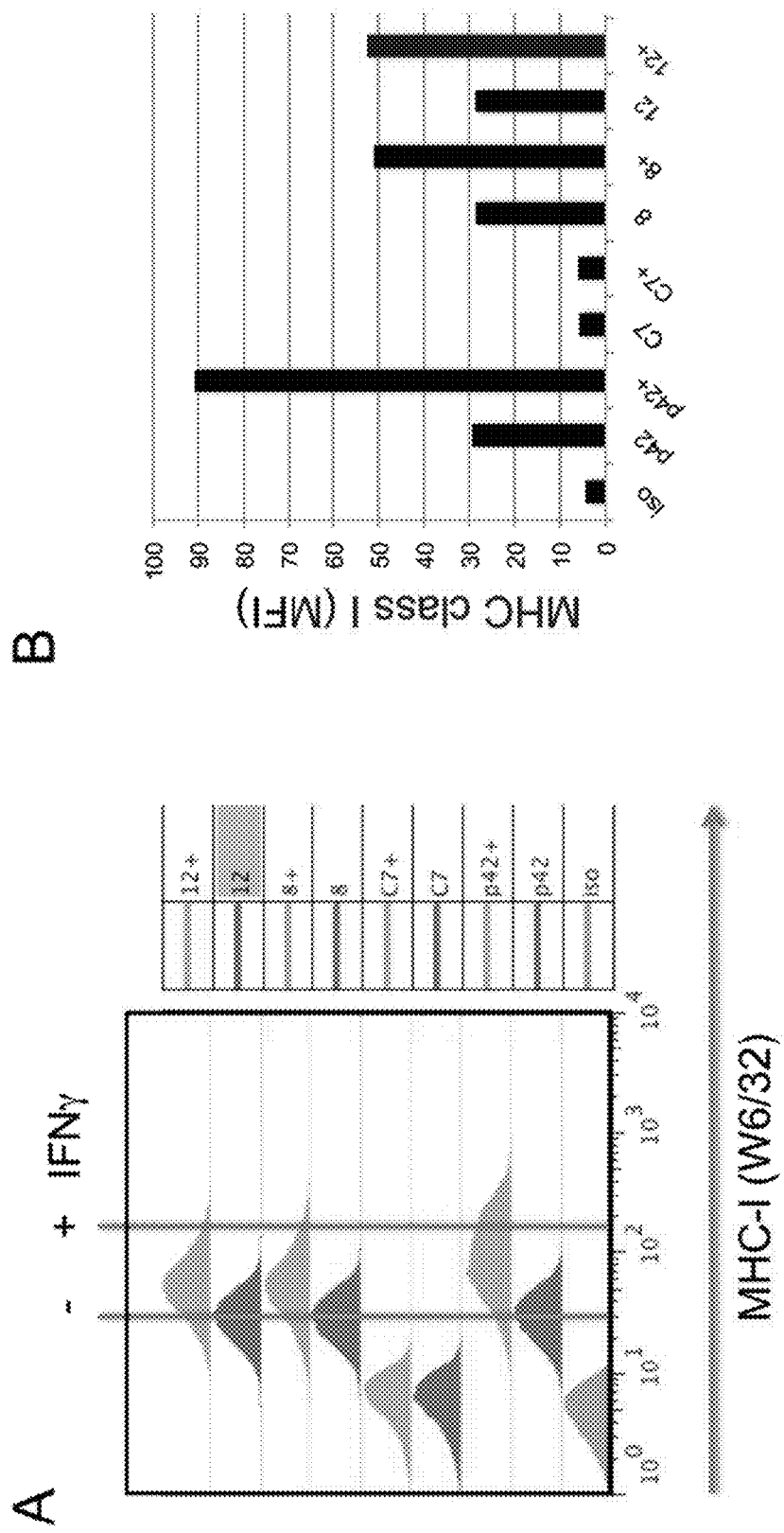

The inventors then reconfirmed (FIG. 17F) and genotyped (FIG. 17G) the IRF1 clones. Sequencing confirmed IRF1 CRISPR induced deletion in clone 12 (FIG. 17H), clone 17 (FIG. 17I) and clone 21 (FIG. 17J). The IRF1−/− HuES9 clones exhibited impaired MHC class I induction following IFNγ treatment for 48 hours (FIG. 17K).

Figure 18A:
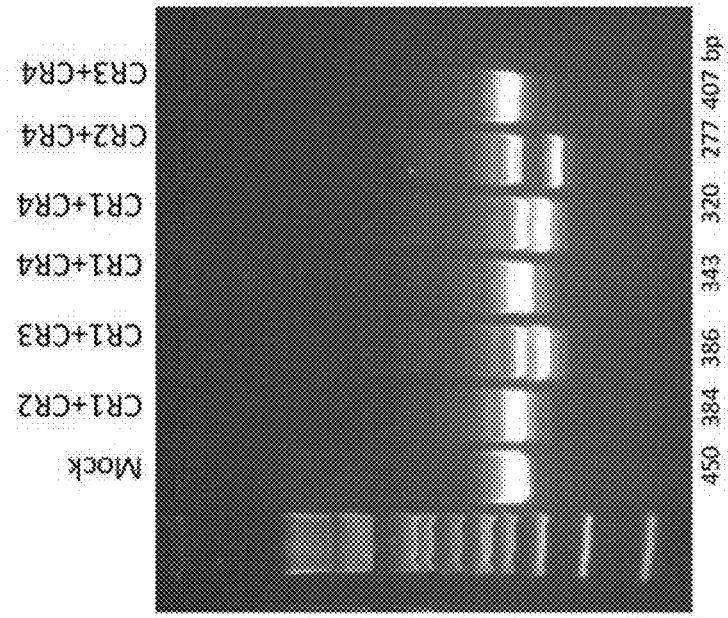
Figure 18B:
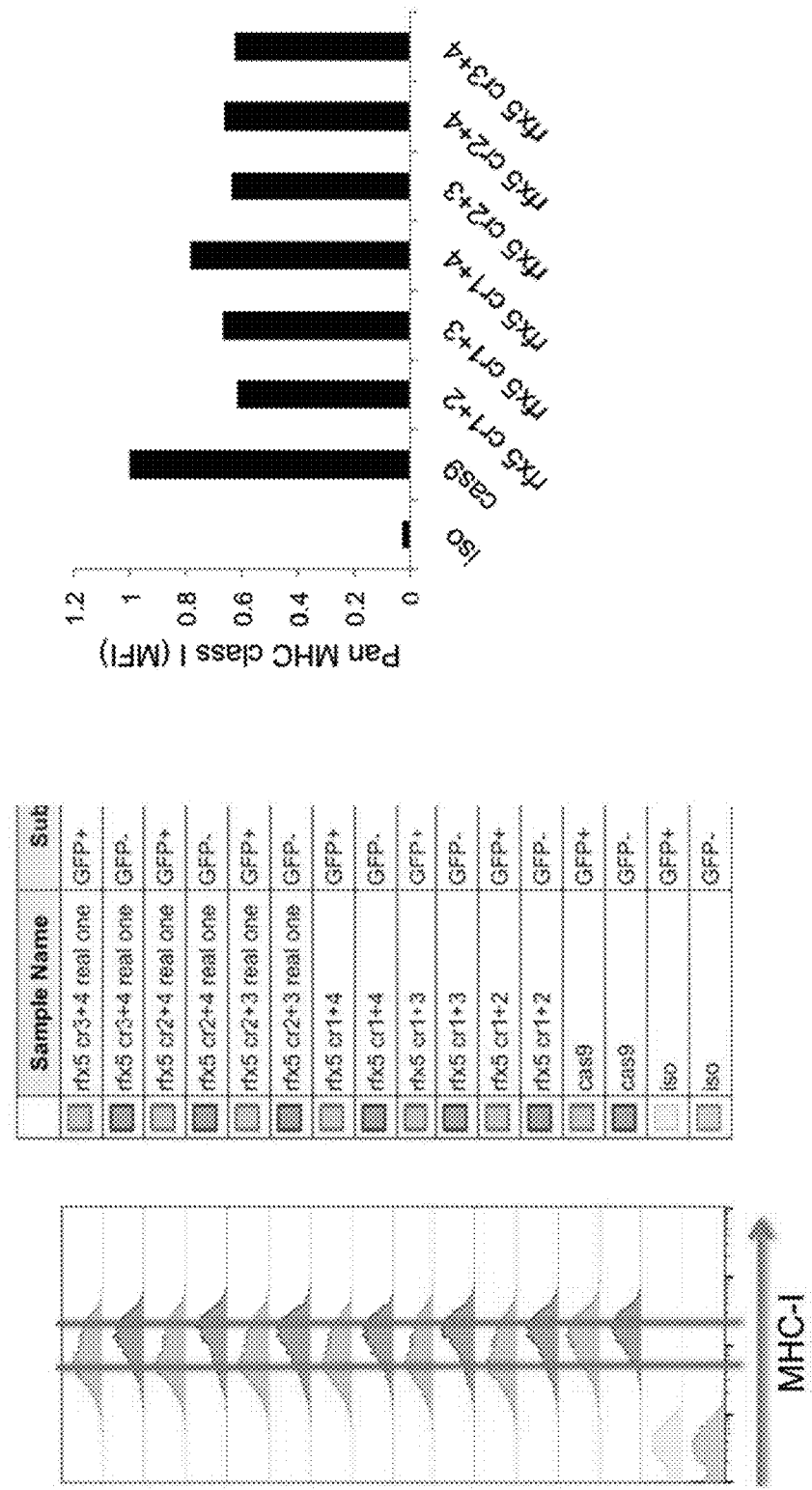
Figure 18C:
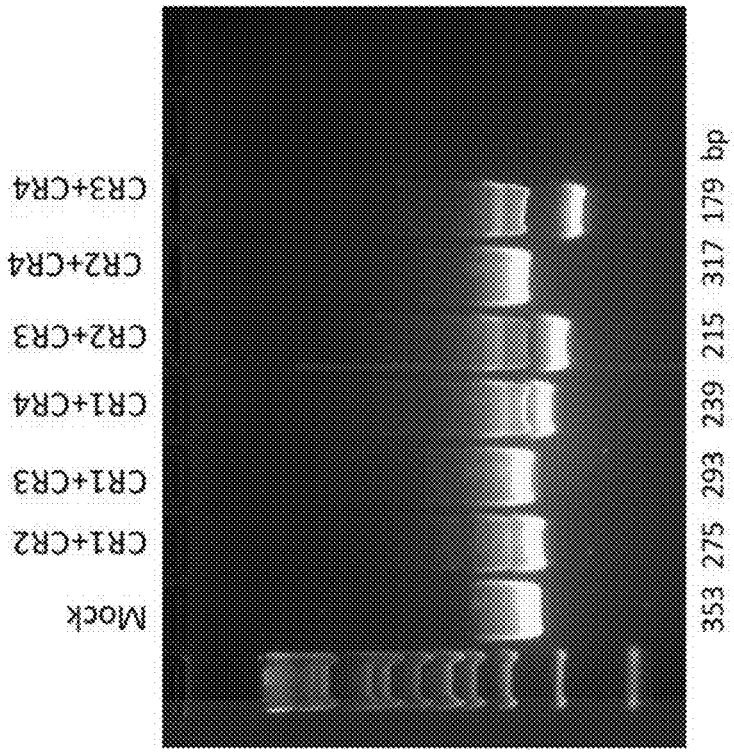
Figure 18D:
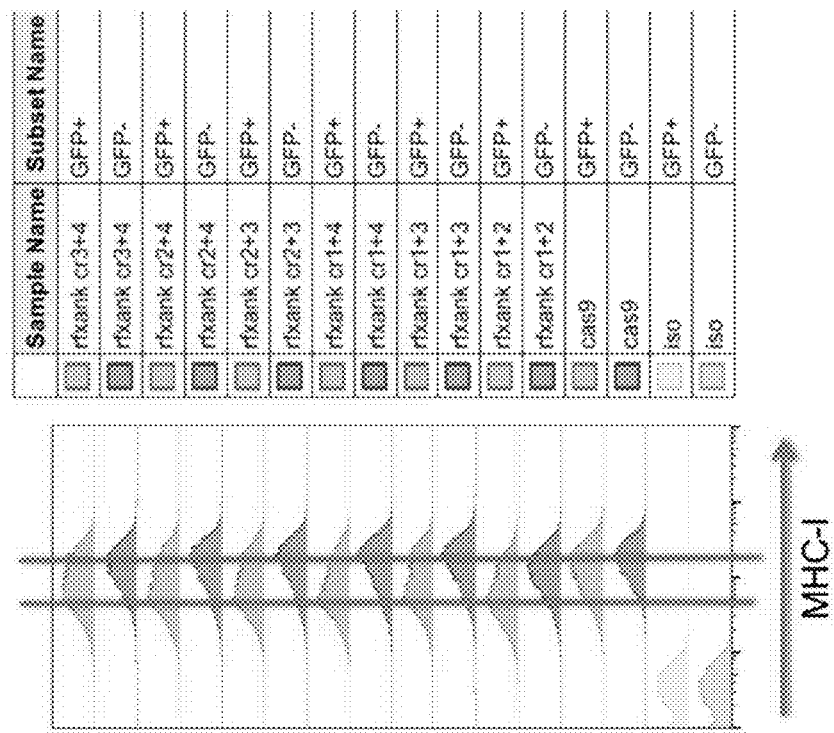
Figure 18E:
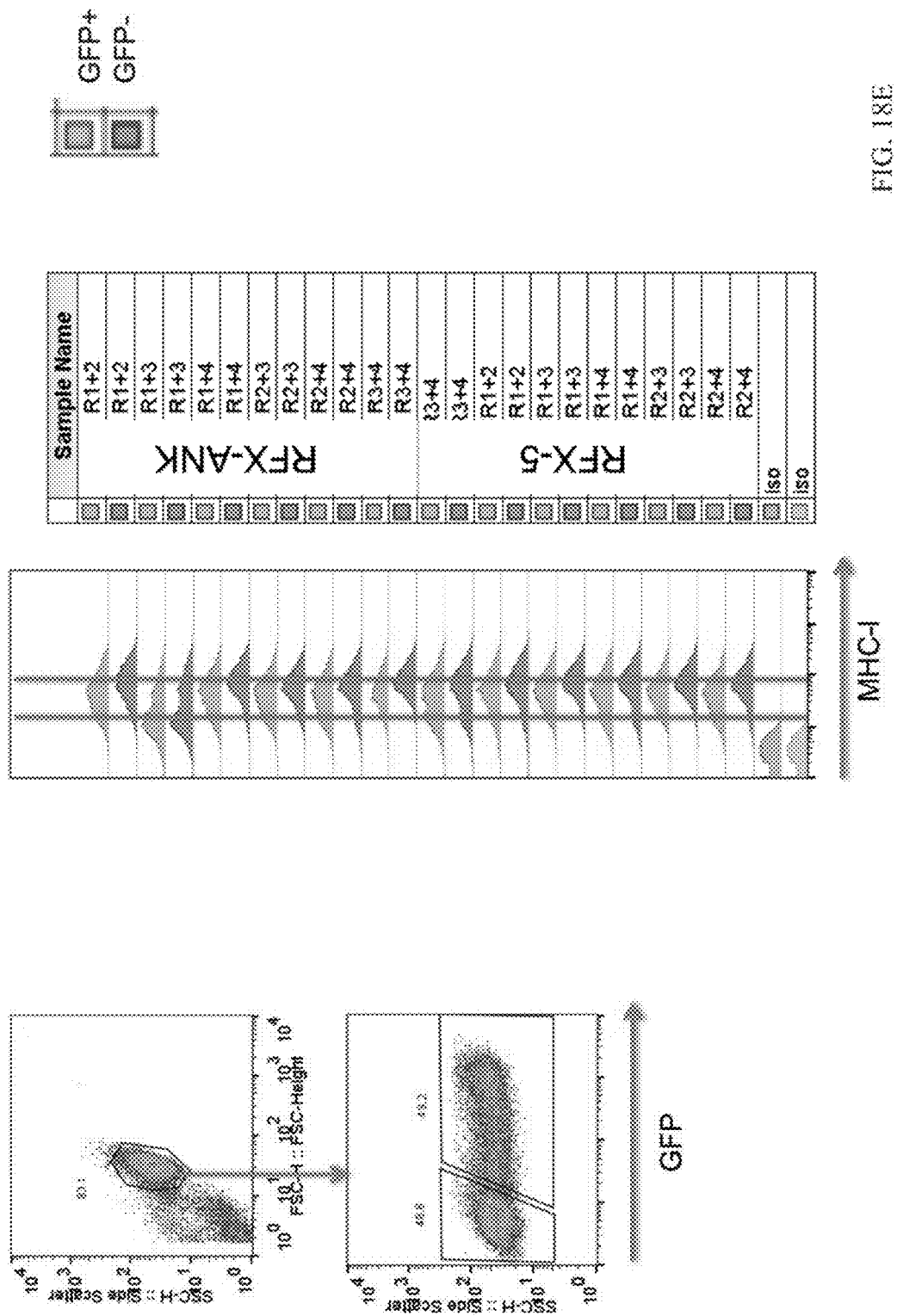
Figure 18F:
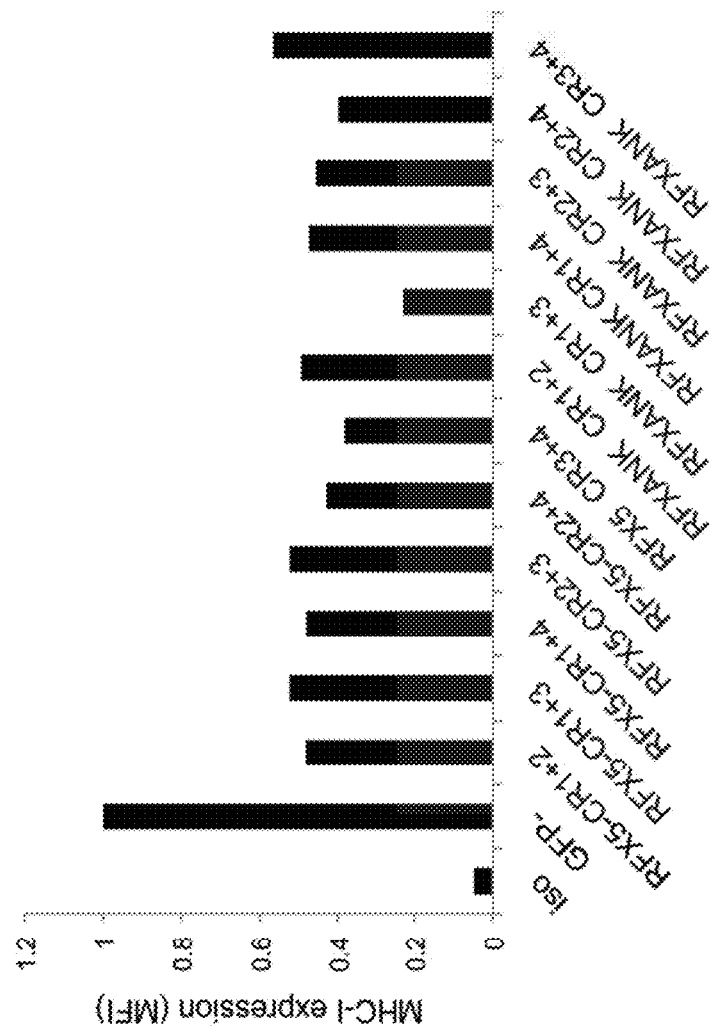
Figure 18G:
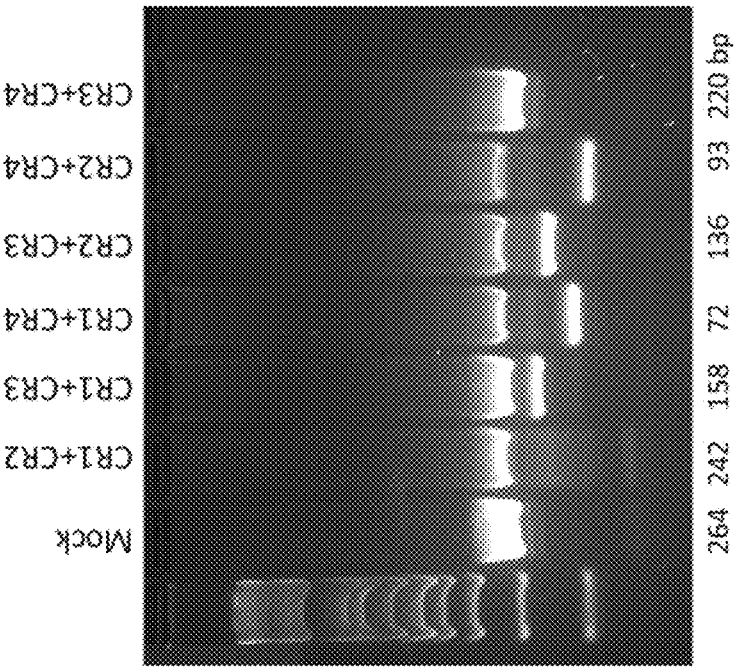
Figure 19A:
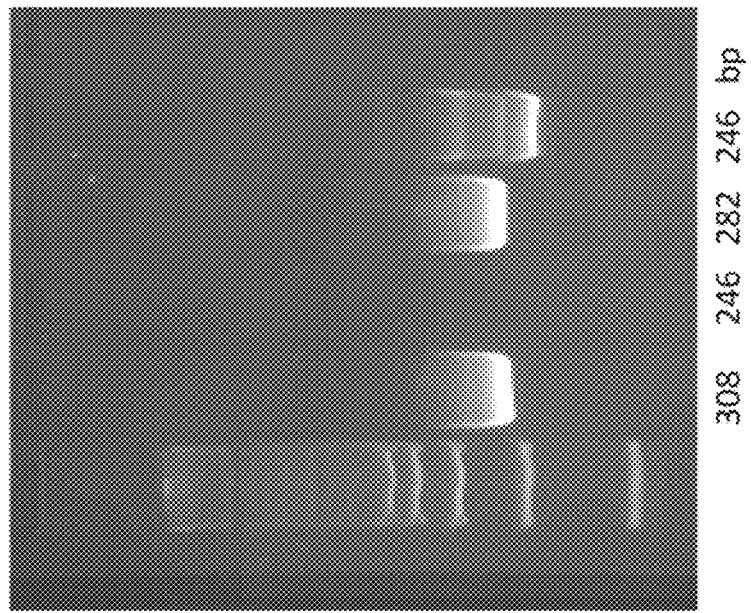
Figure 19C:
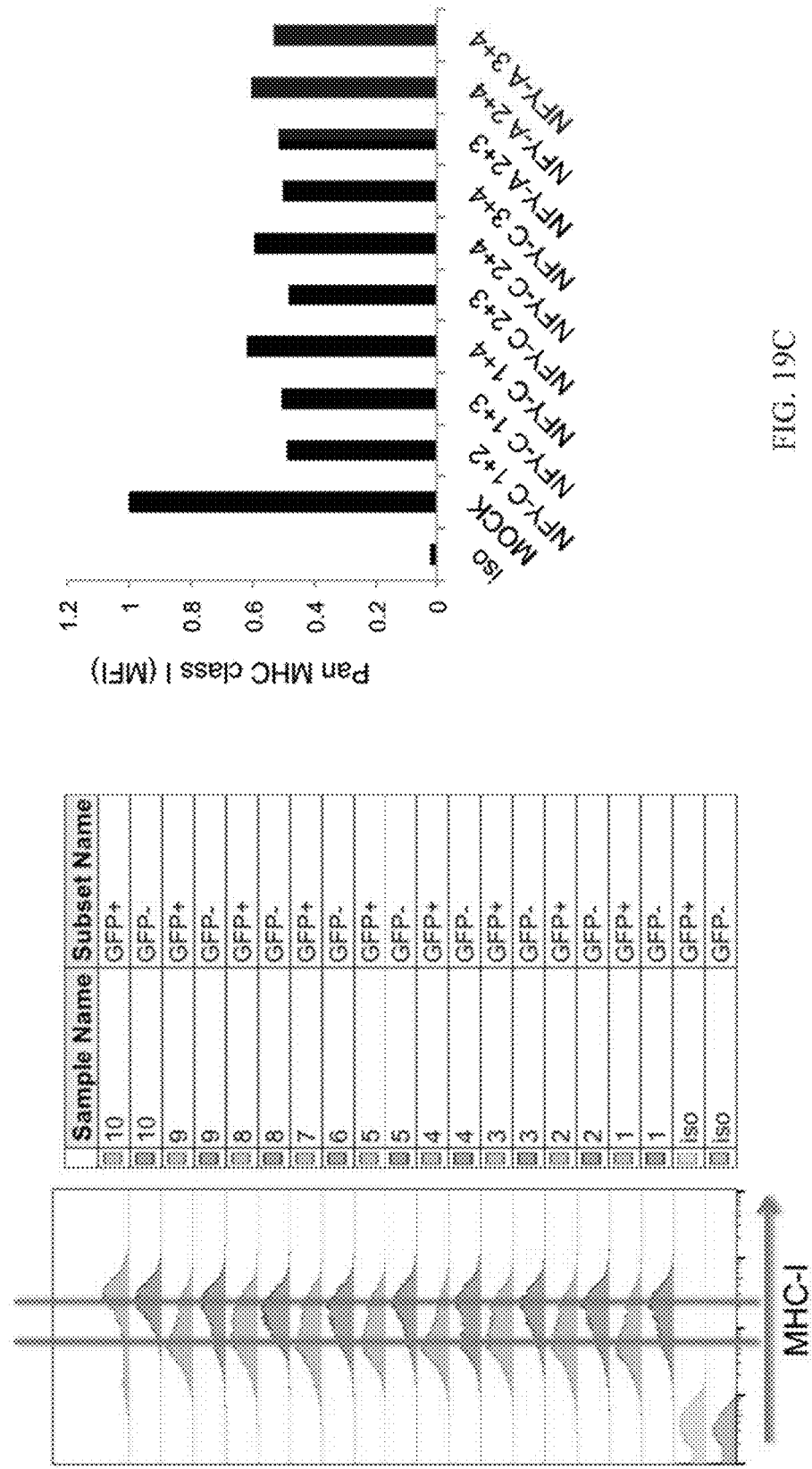
Figure 19D:
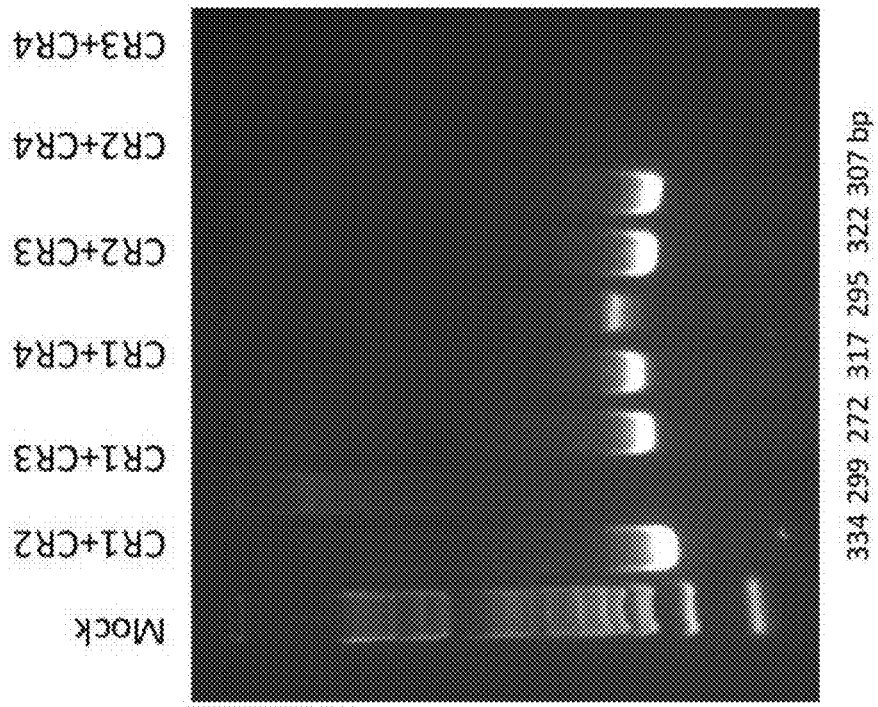

The inventors also examined targeting of additional enhanceosome components. The impact on MHC-I expression by targeting additional enhanceosome components in 293T cells was examined, but it is expected that the targeting of these additional enhanceosome components will also affect MHC-II levels in cells that actually express it, e.g., Thp1 cells or other APCs. For example, the inventors examined CRISPR targeting of RFX5 (FIG. 18A), RFX-ANK (FIG. 18C) and RFX-AP (FIG. 18G) in 293T cells using a dual guide strategy. The targeting results demonstrated reduced MHC class I expression of RFX5 (FIG. 18B, FIGS. 18E-18F), RFK-ANK (FIG. 18D, FIGS. 18E-F) and RFK-AP (FIG. 18H). The inventors also examined CRISPR dual guide targeting of NFY-A (FIG. 19A), NFY-B (FIG. 19D) and NFY-C (FIG. 19B) in 293T cells. The targeting results demonstrated reduced MHC class I expression of NFY-A (FIG. 19C), NFY-B (FIG. 19E) and NFY-C (FIG. 19C).

Blocking Surface Trafficking of MHC Class I

Figure 31:
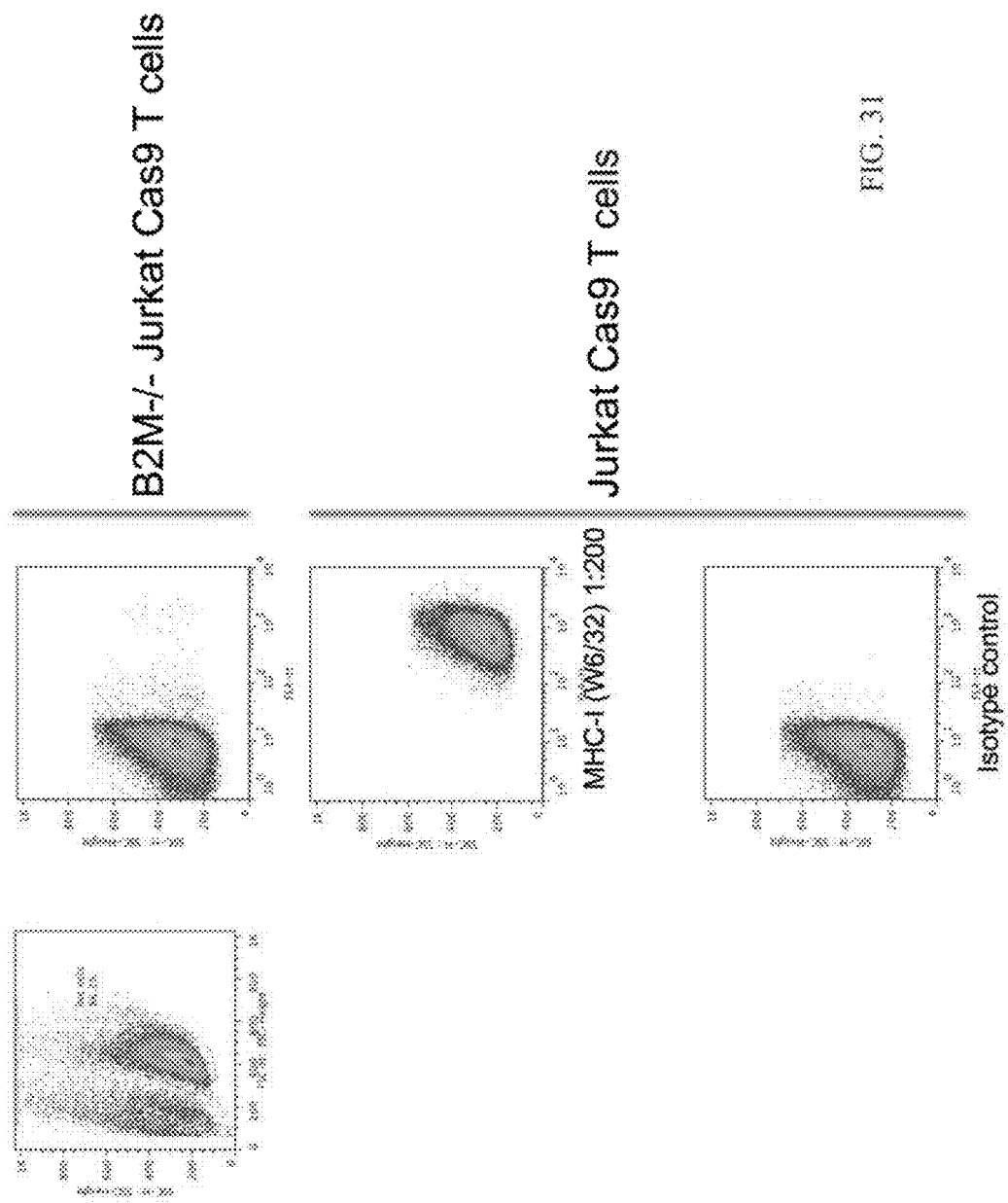
FIG. 31 shows loss of MHC class I surface expression in B2M−/− Jurkat Cas9 T cells. The B2M−/− Jurkat Cas9 T cells are compared to Jurkat Cas9 T cells that do not include a knock out of B2M.
Figures 32A, 32B, 32C, 32D, 32E, 32F, 32G, 32H:
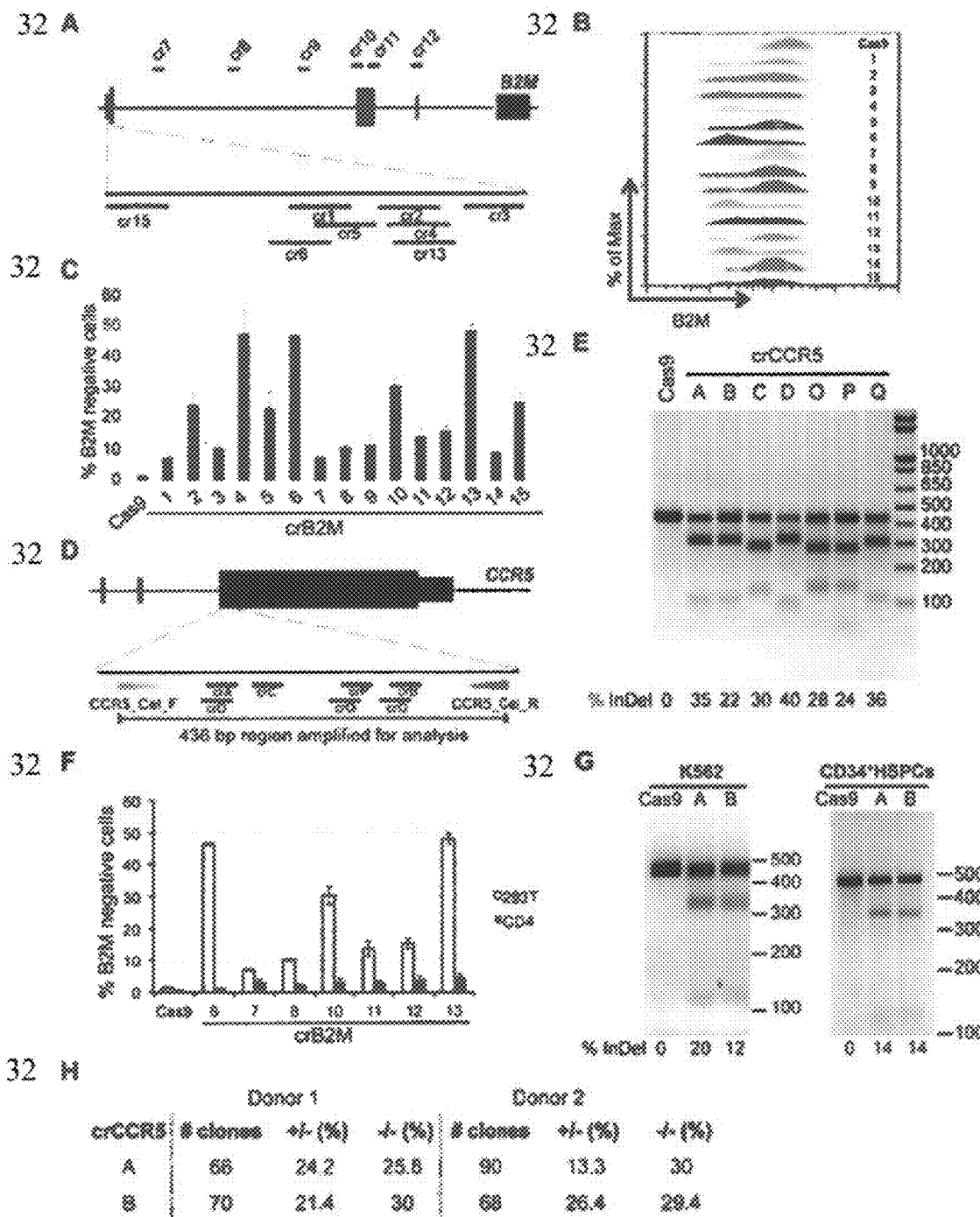
FIGS. 32A-32H demonstrate targeting clinically relevant loci in human cells using CRISPR/Cas9.
Figures 34A, 34B, 34C, 34D, 34E:
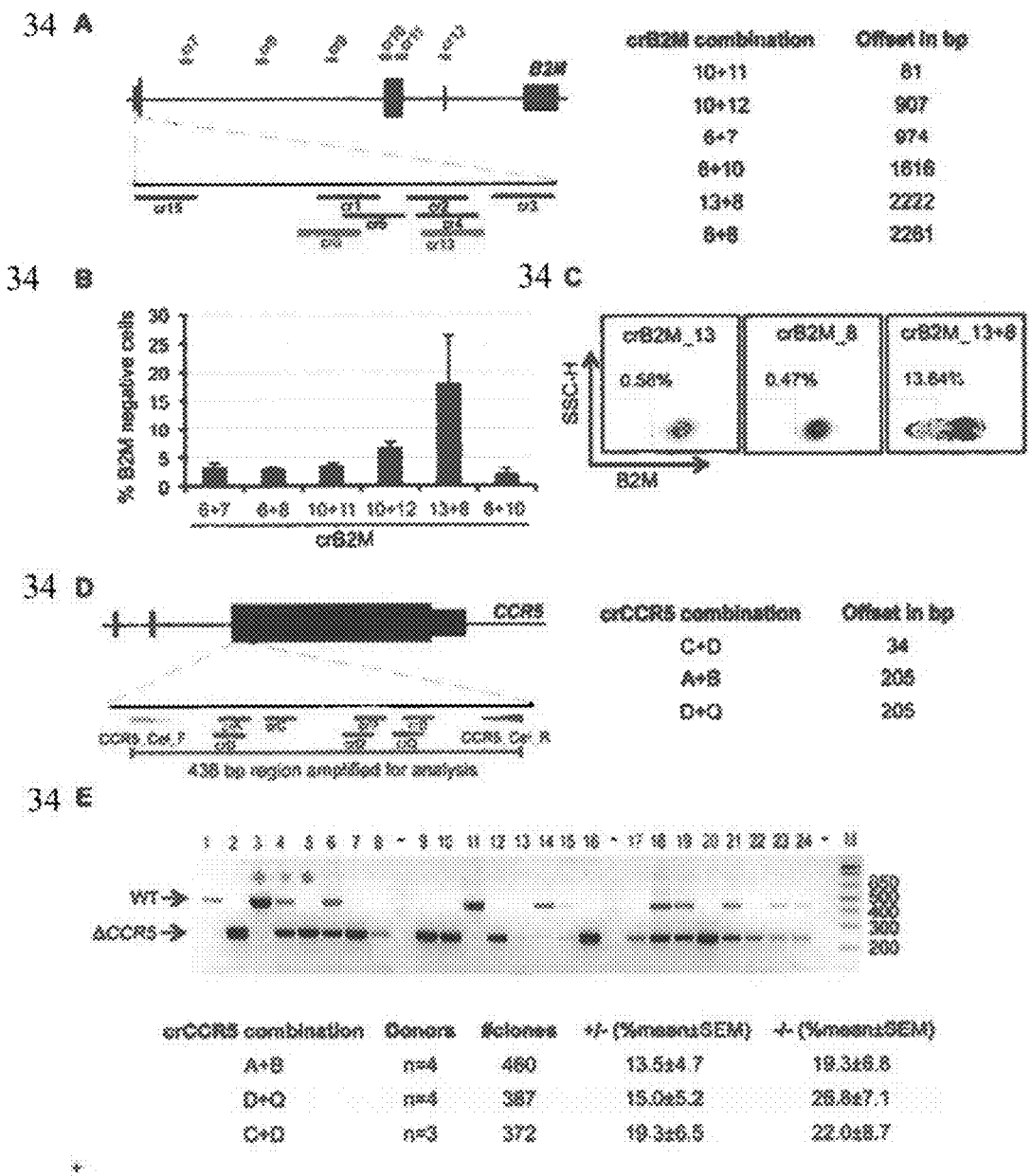
FIGS. 34A-34E depict a dual gRNA approach for CRISPR/Cas9 genome editing in primary human hematopoietic stem and effector cells.
Figure 36:
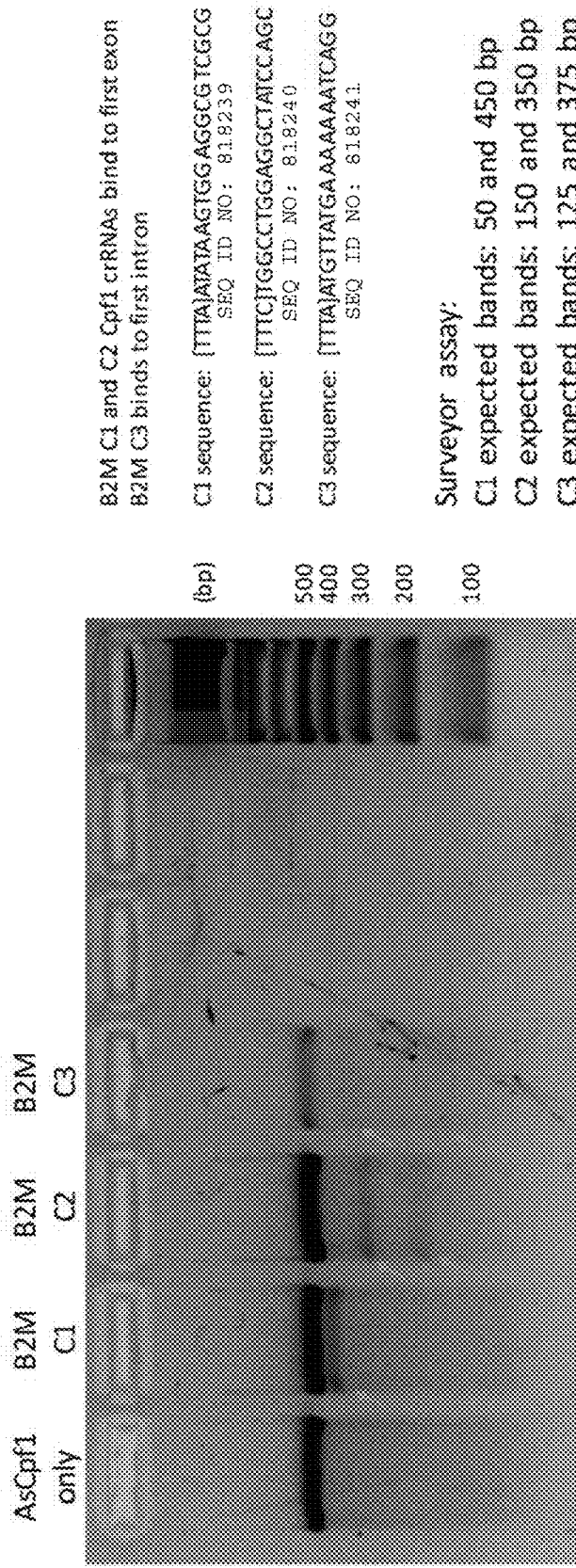
FIG. 36 demonstrates B2M deletion efficiencies of selected guides in 293T cells. Arrows on the Surveyor assays show nuclease cleavage bonds.
Figure 37:
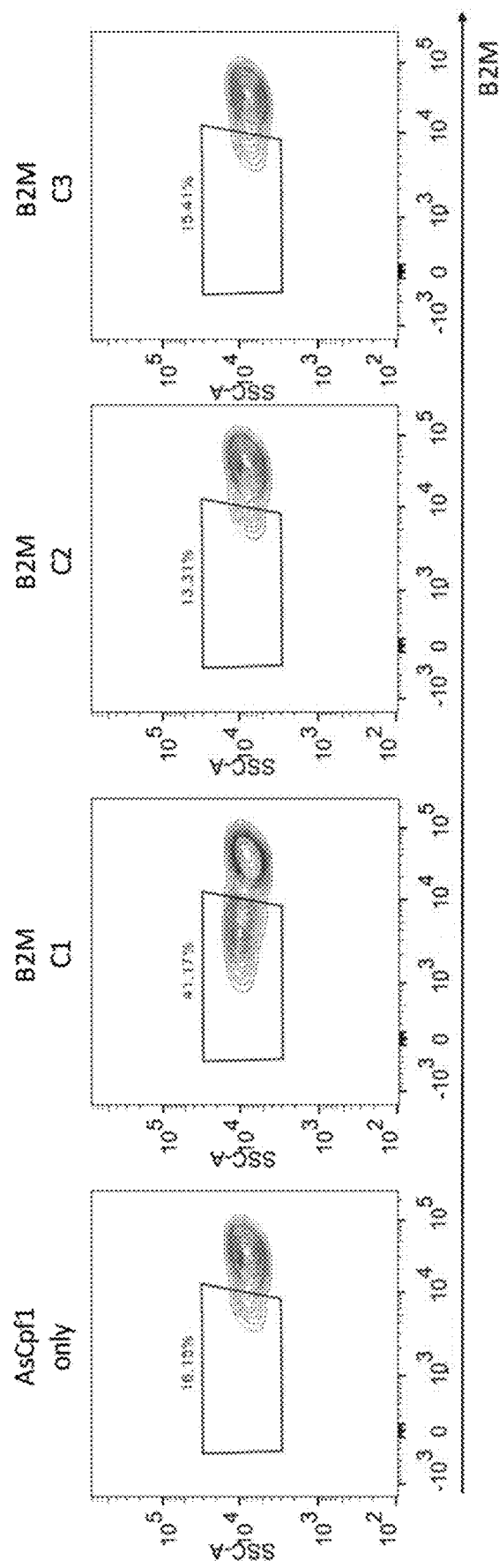
FIG. 37 demonstrates a comparison of B2M surface expression in 293T cells when transfected with AsCpf1 and guide crB2M.
Figure 38:
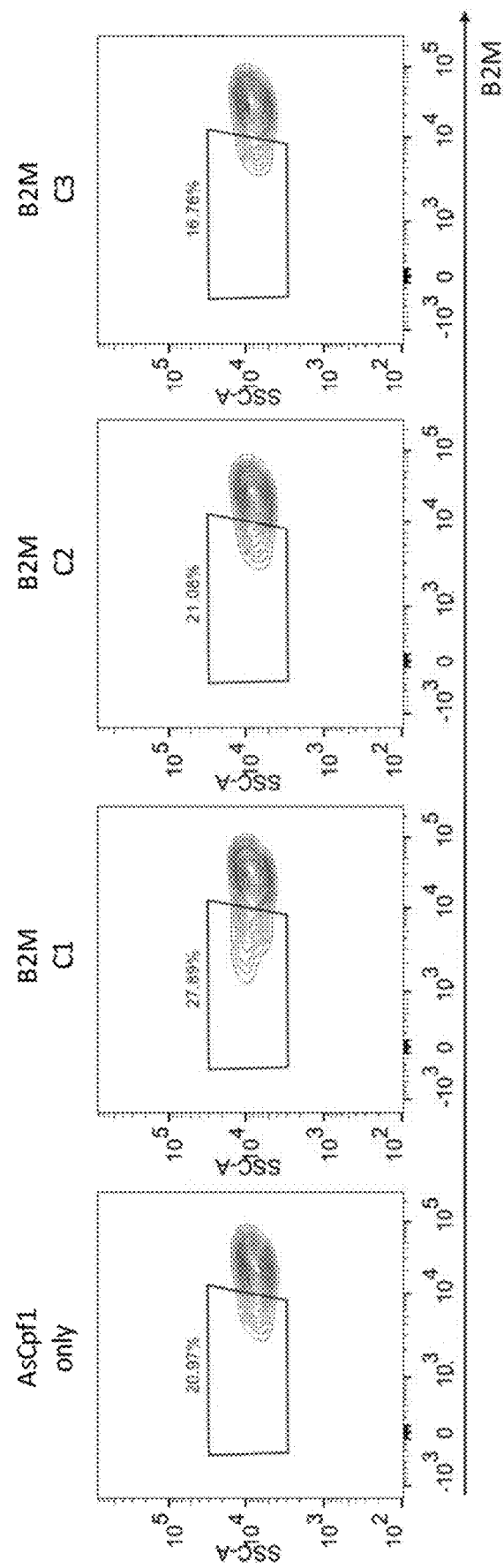
FIG. 38 demonstrates a comparison of B2M surface expression in 293T cells when transfected with LbCpf1 and guide crB2M.
Figure 40B:
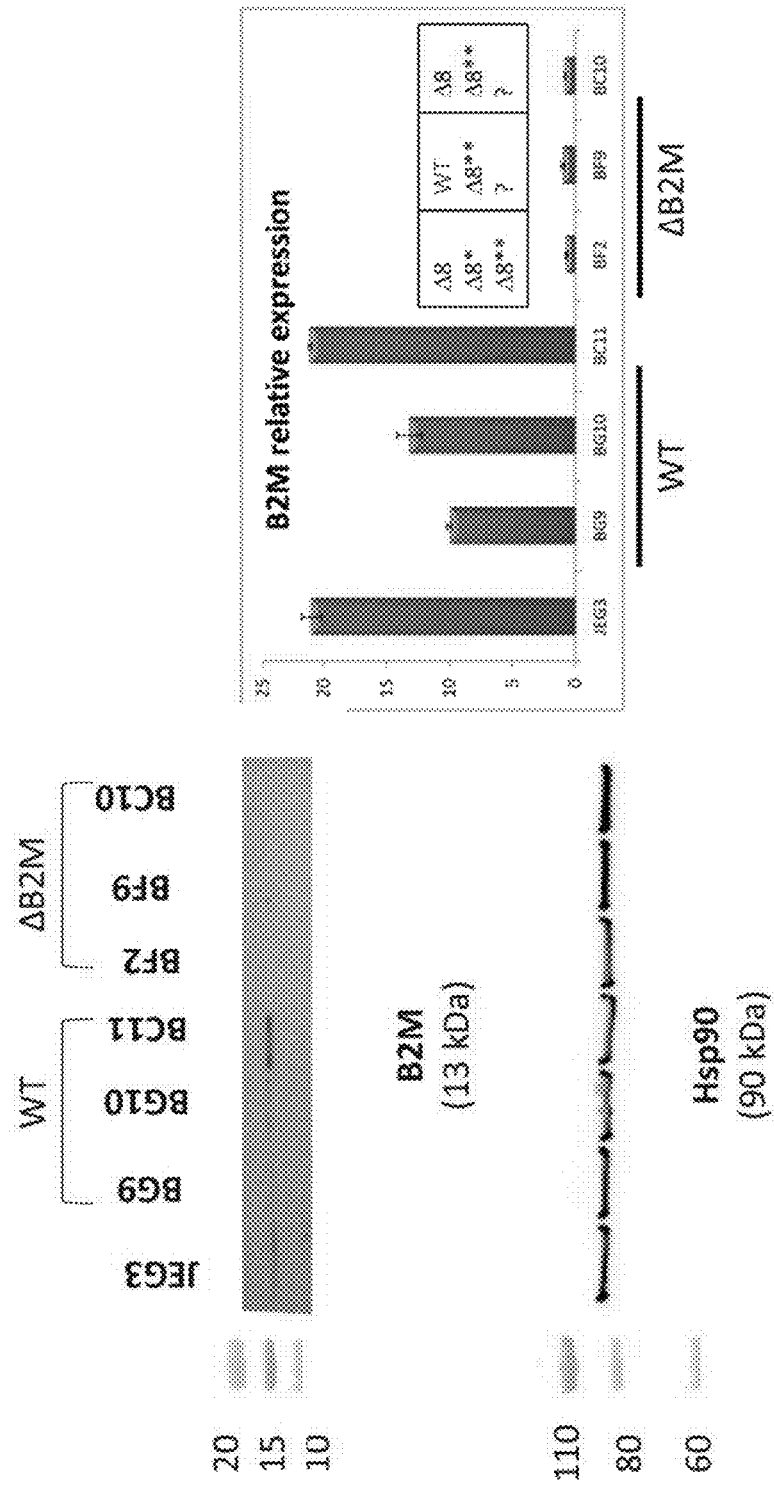
Figure 40C:
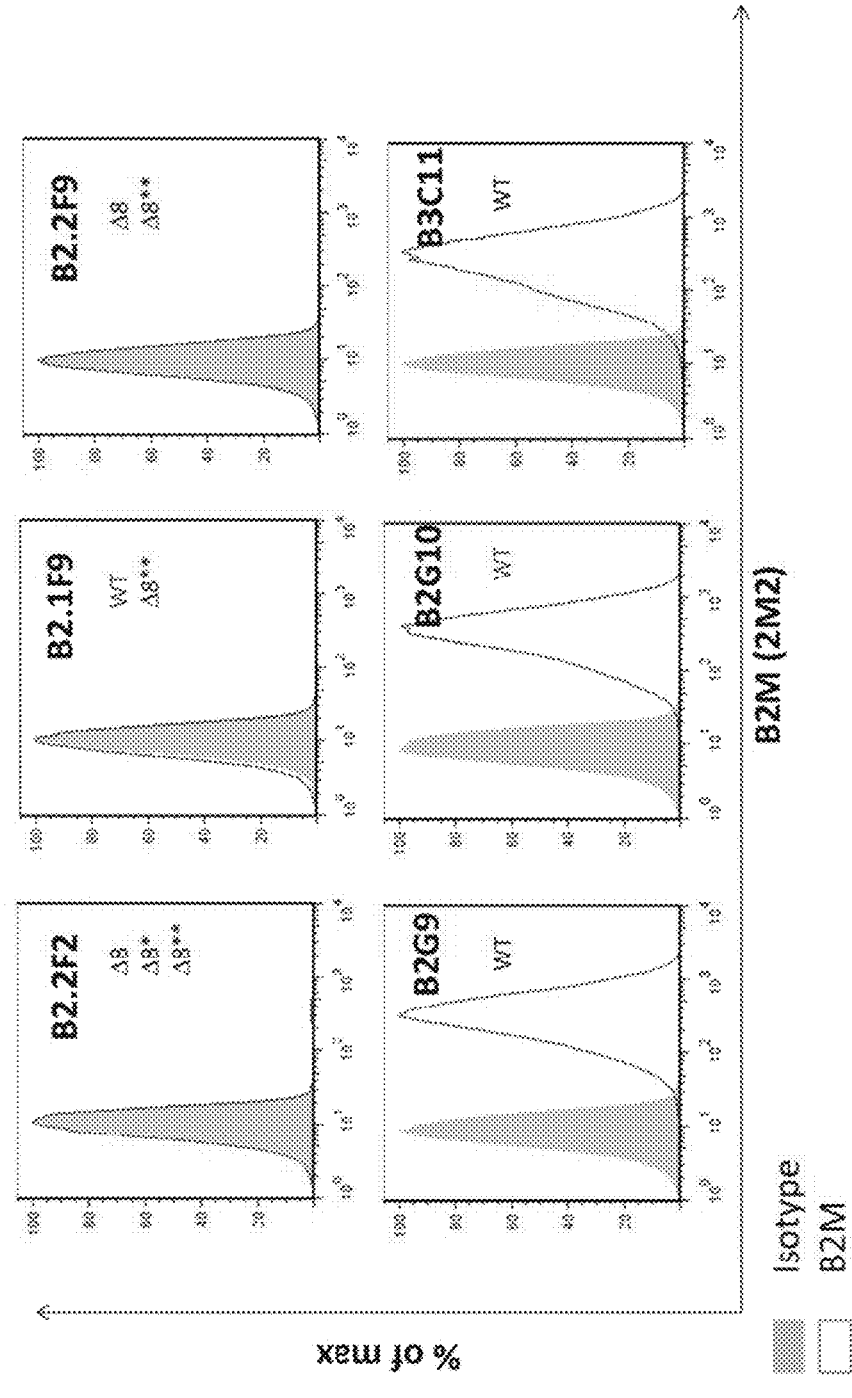
Figure 40D:
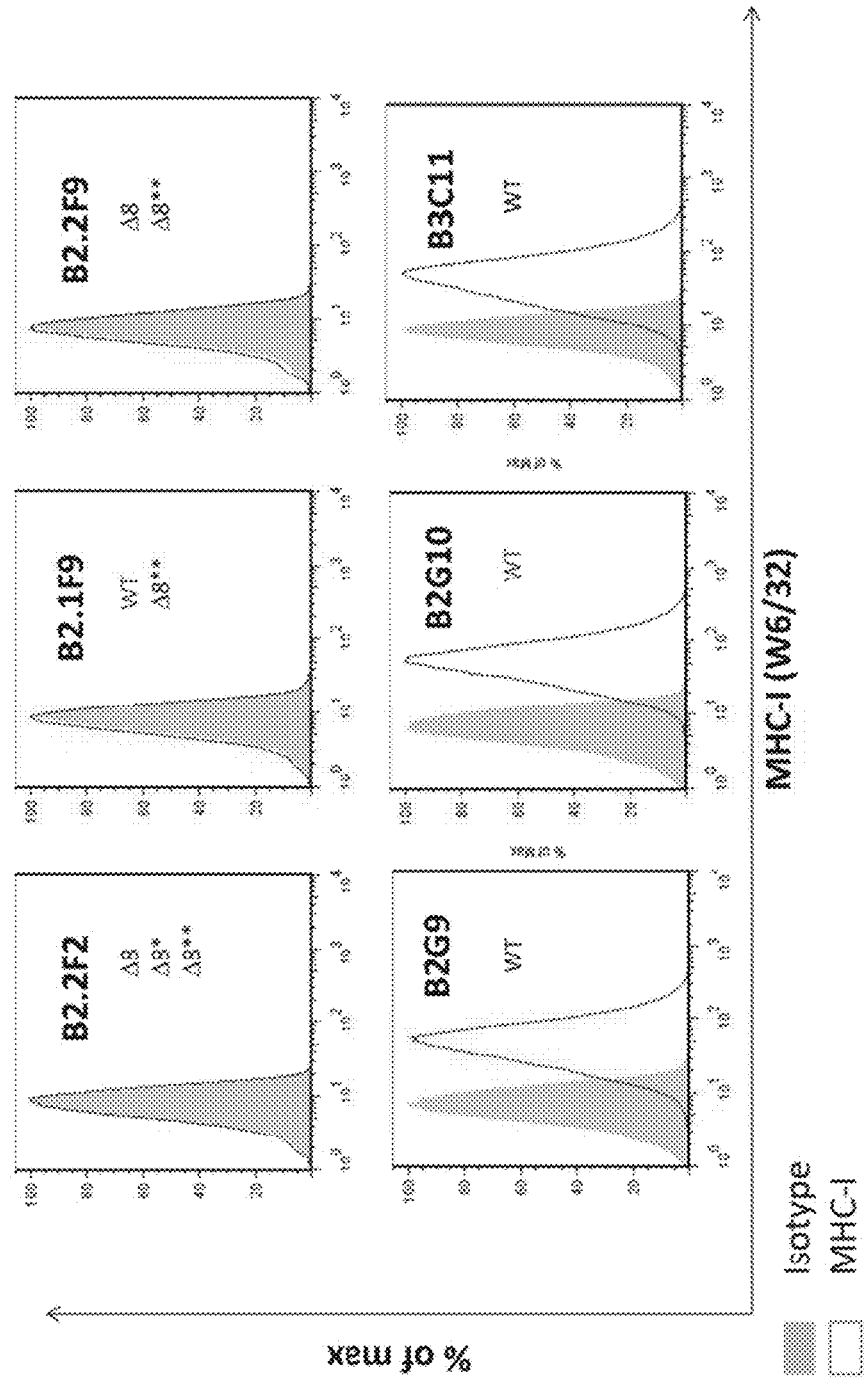
Figure 40E:
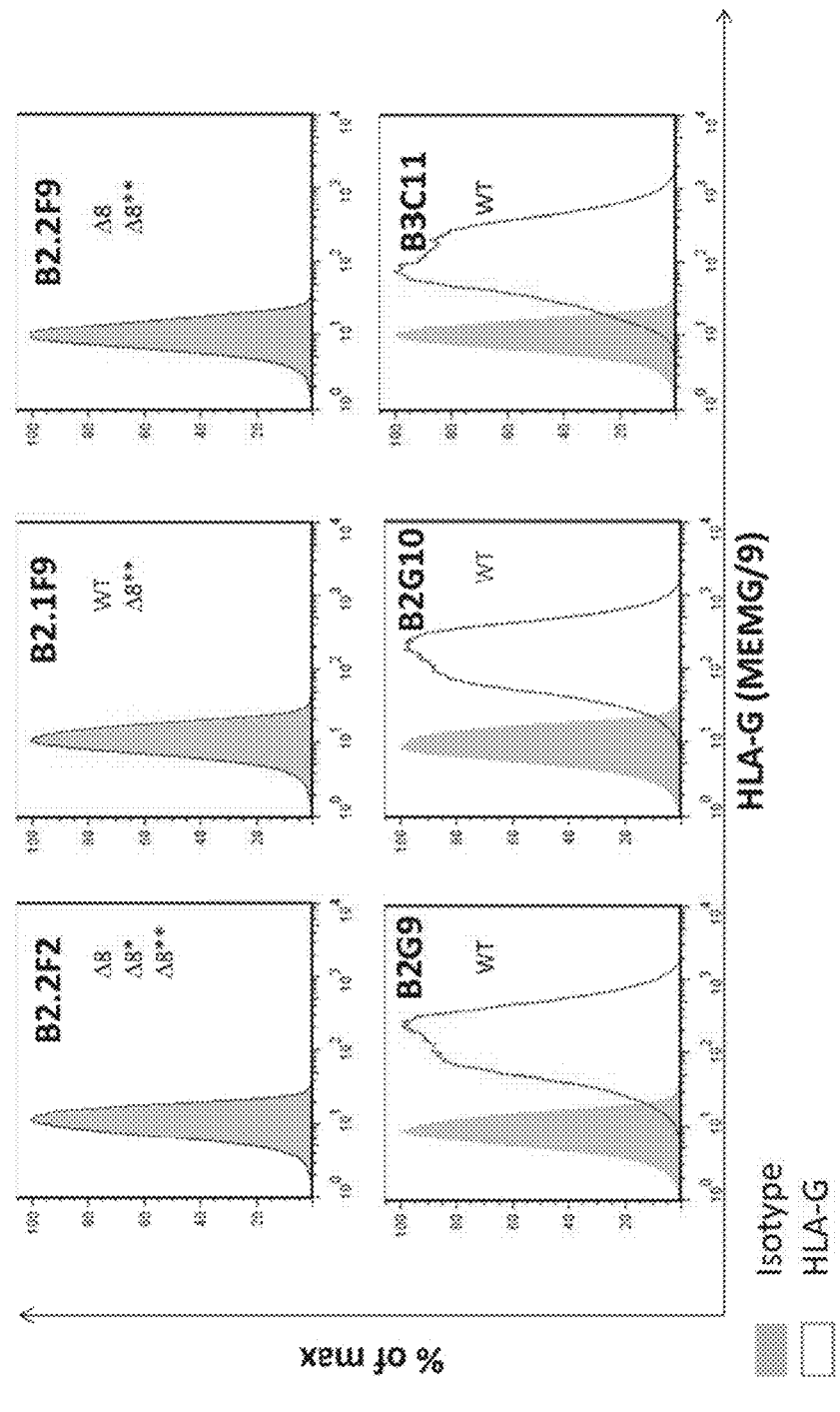
Figure 40F:
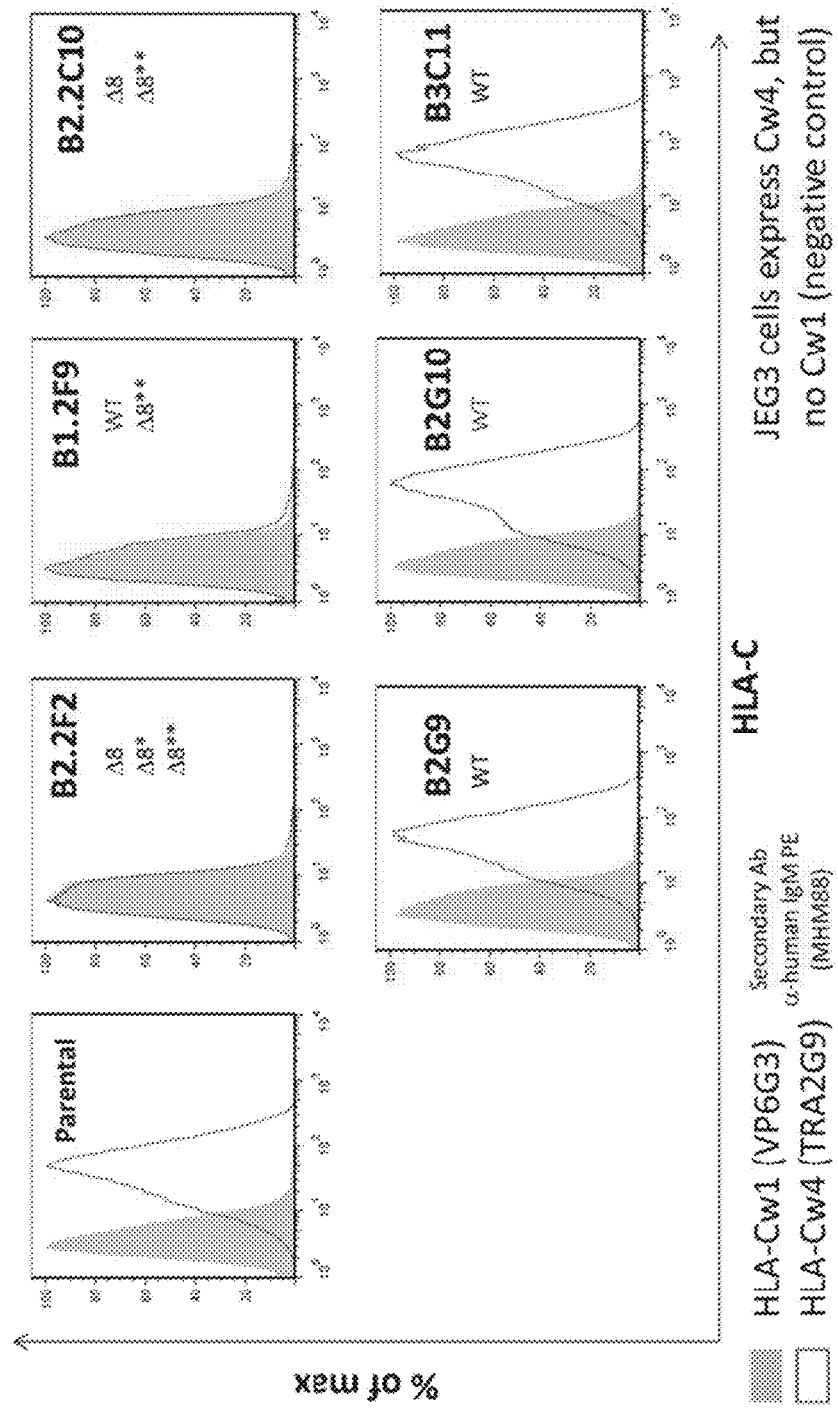
Figure 40G:
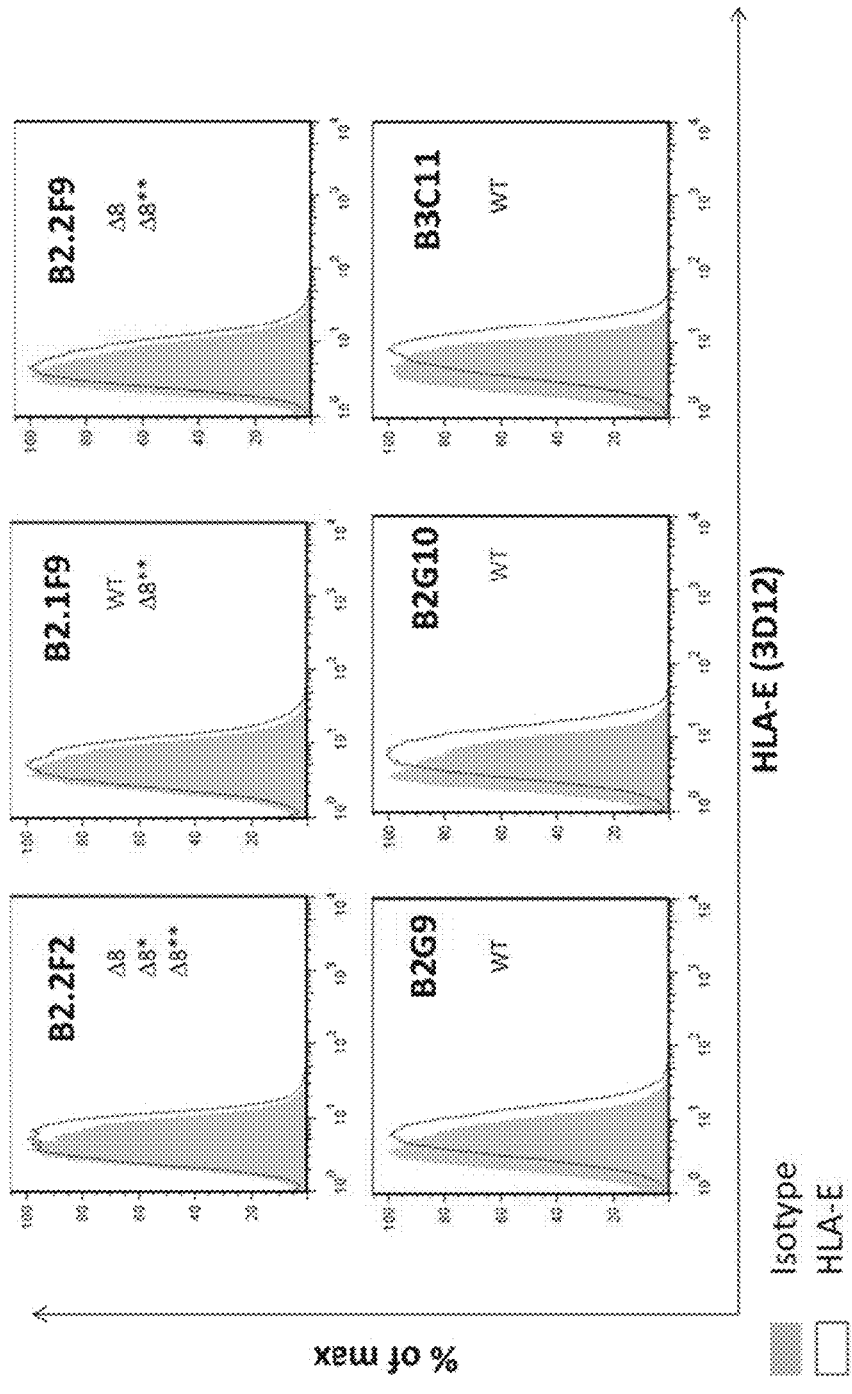
Figure 41:
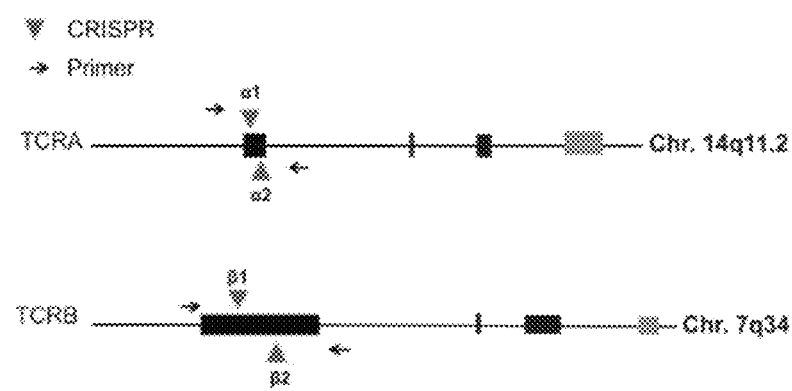
FIG. 41 demonstrates an exemplary TCR targeting strategy of the present invention.
Figure 42A:
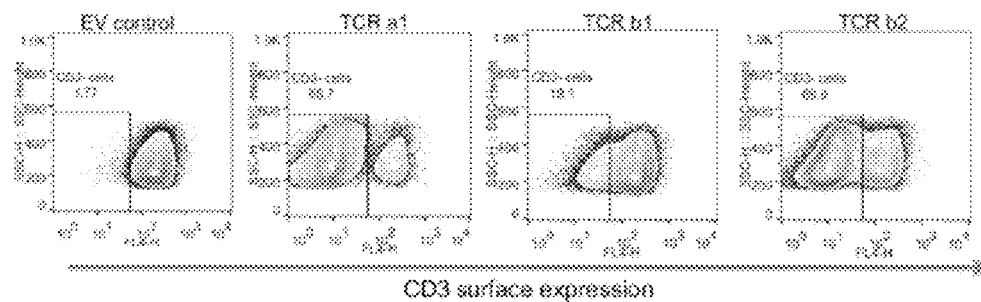
FIGS. 42A-42B demonstrate deletion of T cell receptor in Jurkat T cells.
Figure 42B:
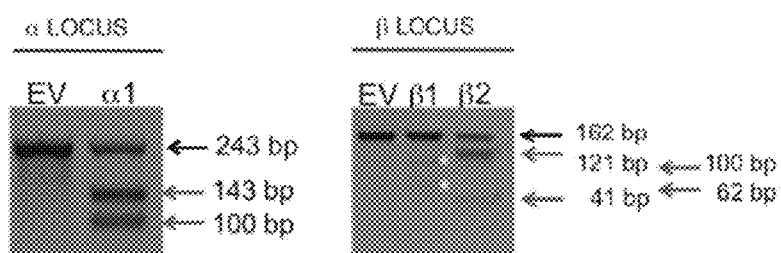
Figure 43A:
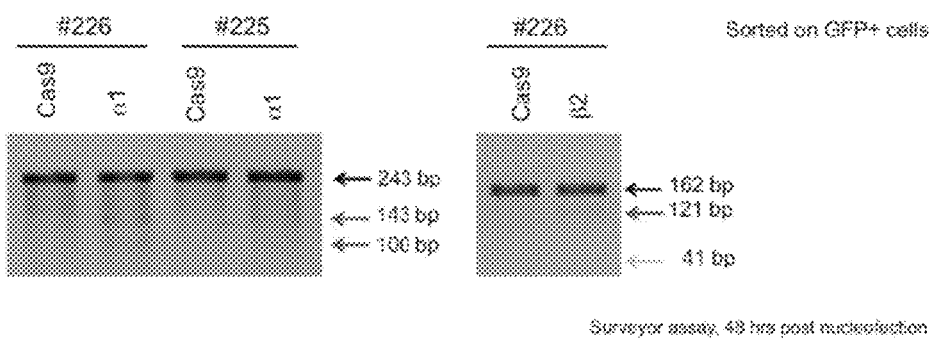
FIGS. 43A-43B demonstrate TCR Deletion in Primary Human CD3+ T Cells.
Figure 43B:
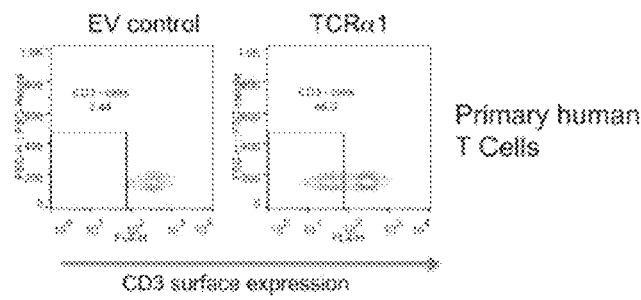
Figures 44A, 44B, 44C:
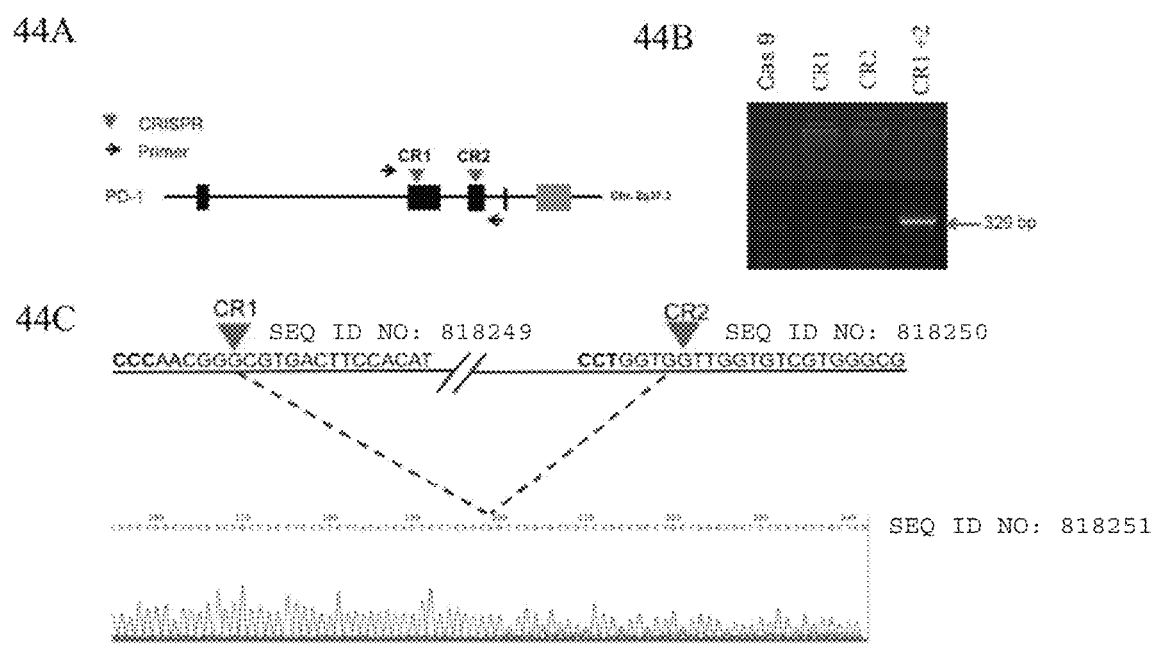
FIGS. 44A-44C demonstrate an exemplary PD-1 locus targeting strategy of the present invention.
Figure 45A:
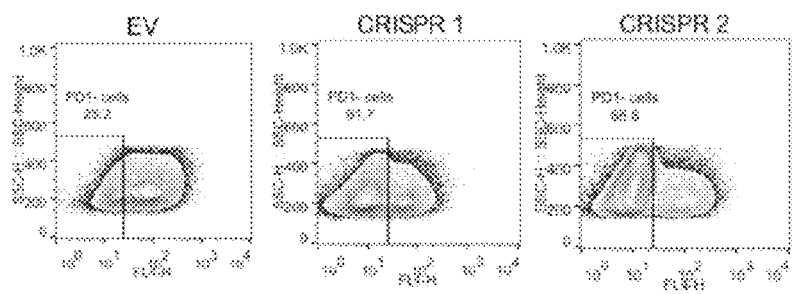
FIGS. 45A-45B demonstrate the loss of PD-1 expression in Jurkat T cells.
Figure 45B:
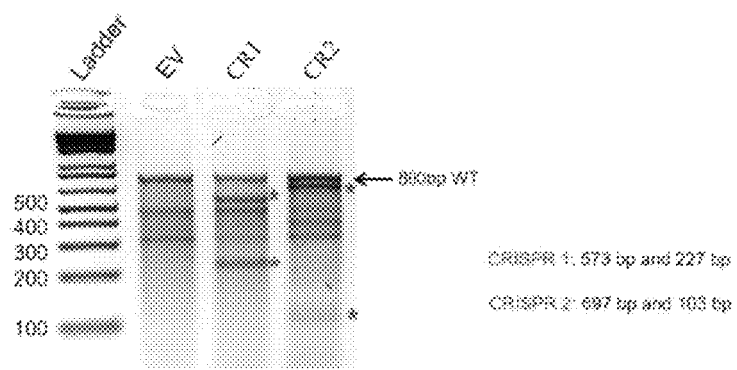
Figure 46A:
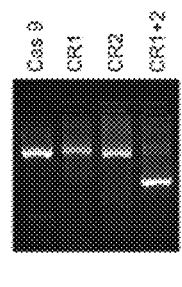
FIGS. 46A-46C demonstrate an exemplary CTLA4 locus targeting strategy of the present invention.
Figure 46B:
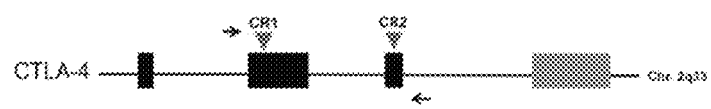
Figure 46C:
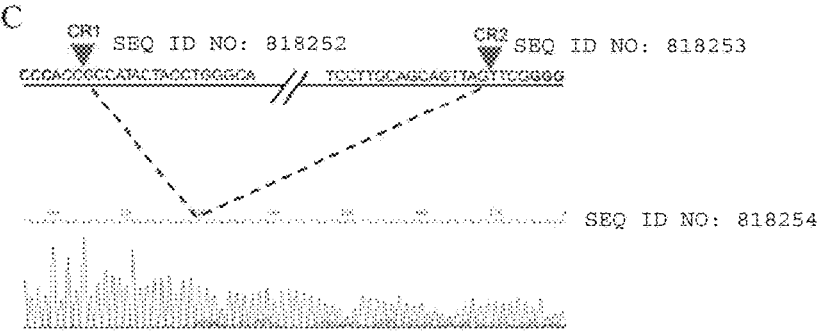
Figures 47A, 47B:
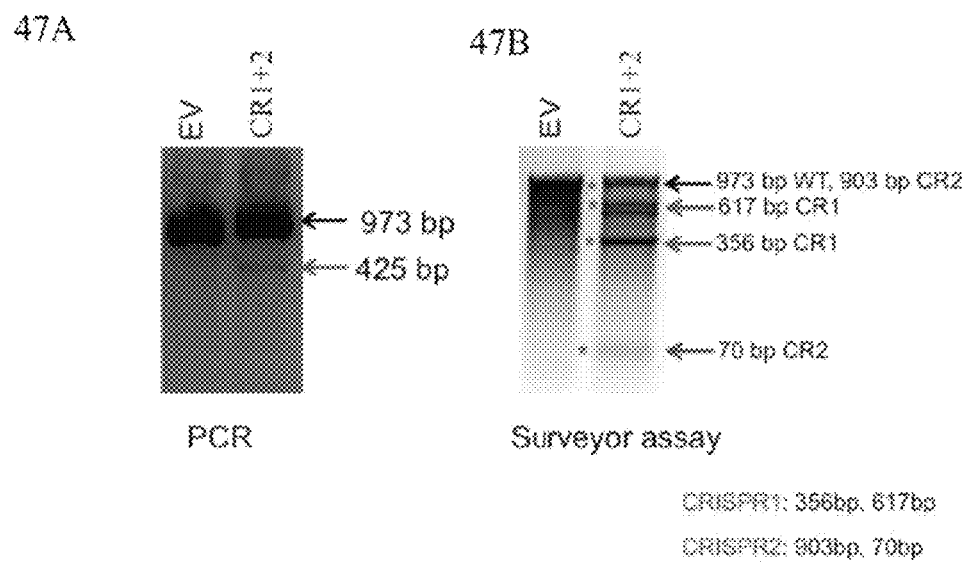
FIGS. 47A-47B demonstrate cutting at the CTLA-4 locus in Jurkat T cells.

The successful targeting of B2M utilizing TALENs and/or CRISPR has previously been described in PCT Patent Application No. PCT/US2015/059621, which is incorporated herein by reference and is shown in FIGS. 32-40. It has further been demonstrated that surface expression of MHC class I molecules is reduced or eliminated, thereby blocking the surface trafficking of MHC-I molecules. For example, loss of MHC class I surface expression in B2M−/− Jurkat Cas9 T cells was shown in comparison to MHC class I surface expression in Jurkat Cas9 T cells in FIG. 31.

Figure 20A:
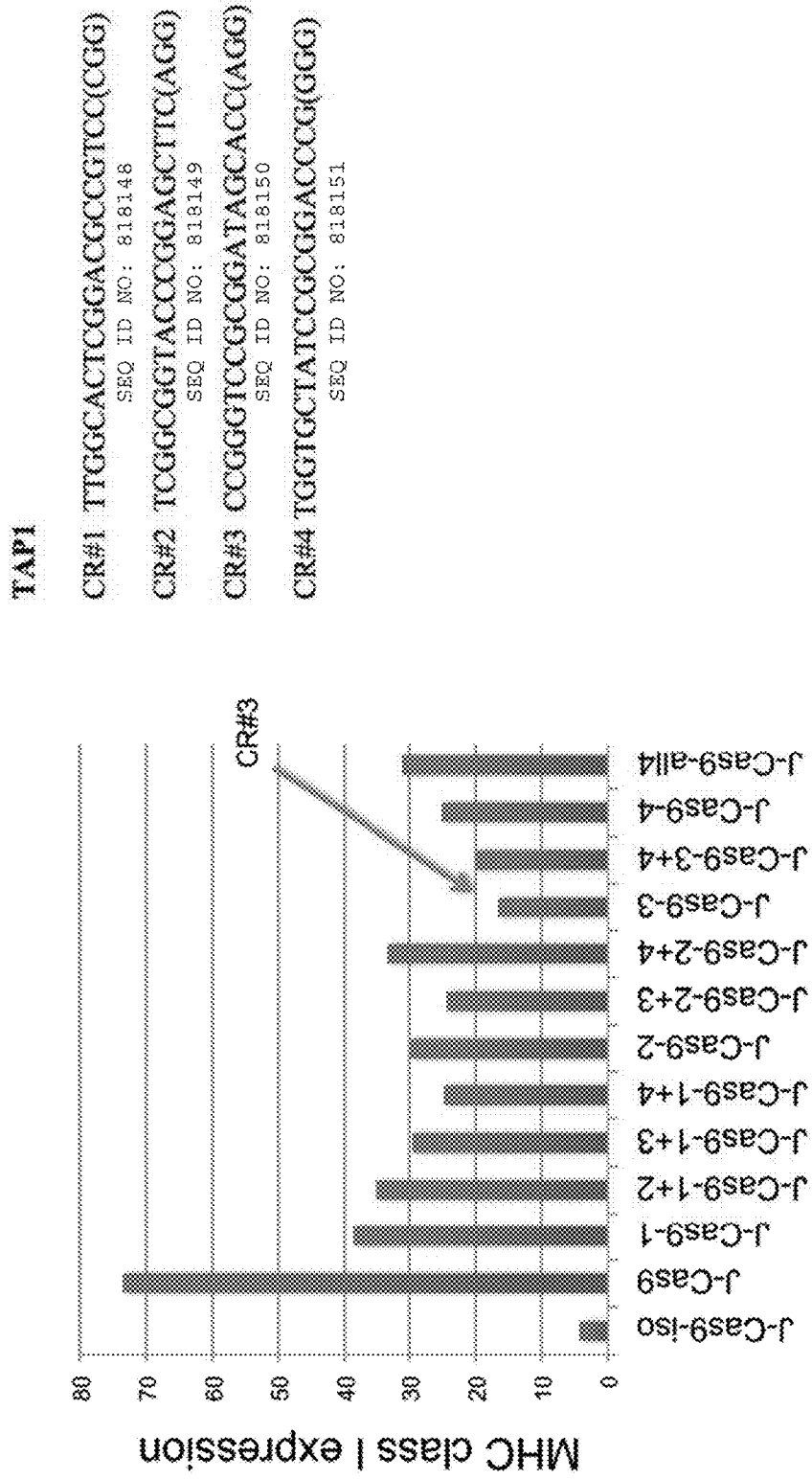
Figure 20B:
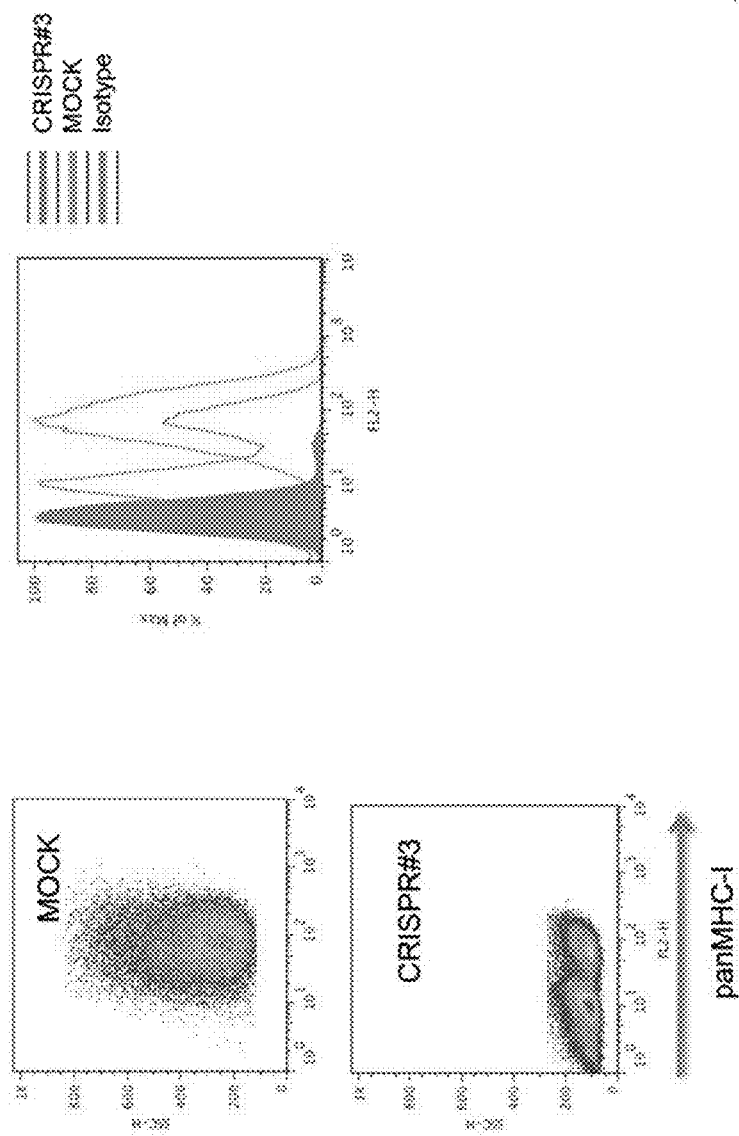
Figure 20C:
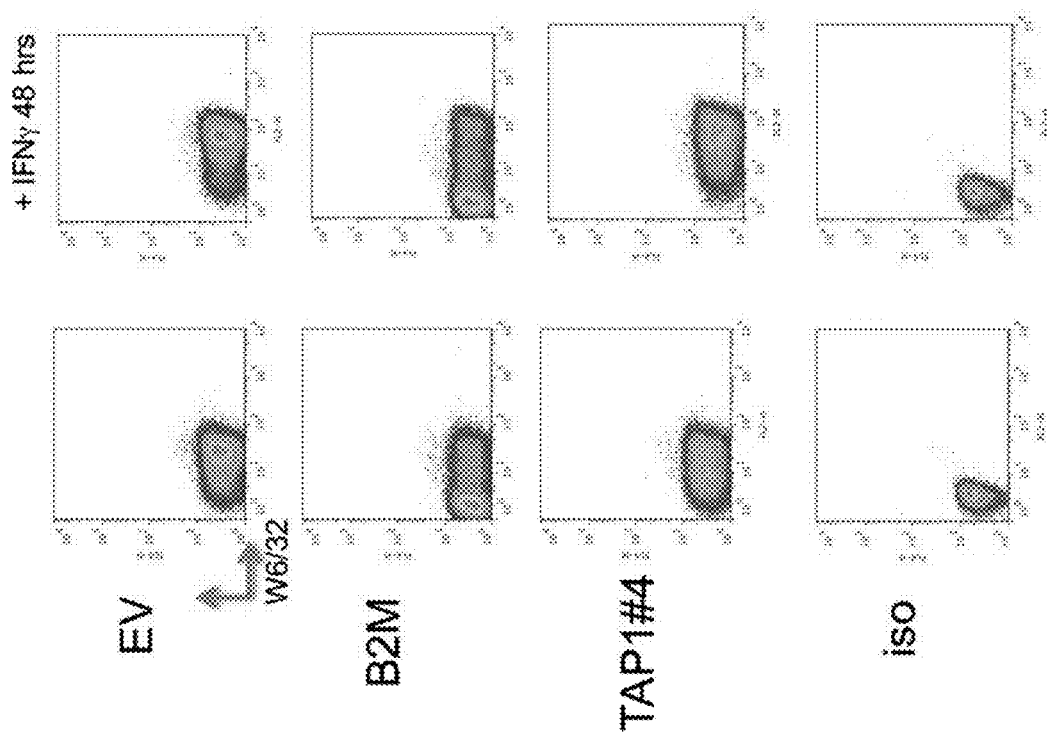

In addition, the inventors have demonstrated that surface trafficking of MHC class I molecules can be suppressed but disrupting the TAP1 gene, an ER-resident peptide transporter. For example, TAP1 CRISPR expression reduces MHC-I surface expression in Jurkat cells (FIG. 20A), as well as in Jurkat T cells (FIG. 20B), following 48 hour treatment with IFNγ. It was further demonstrated that HLA surface expression in Jurkat (Cas9) T cells could be eliminated (FIG. 20C and FIG. 20D). The Jurkat T cells were established from the peripheral blood of a 14 year old boy who had acute T cell leukemia.

HLA Razor

Figure 21C:
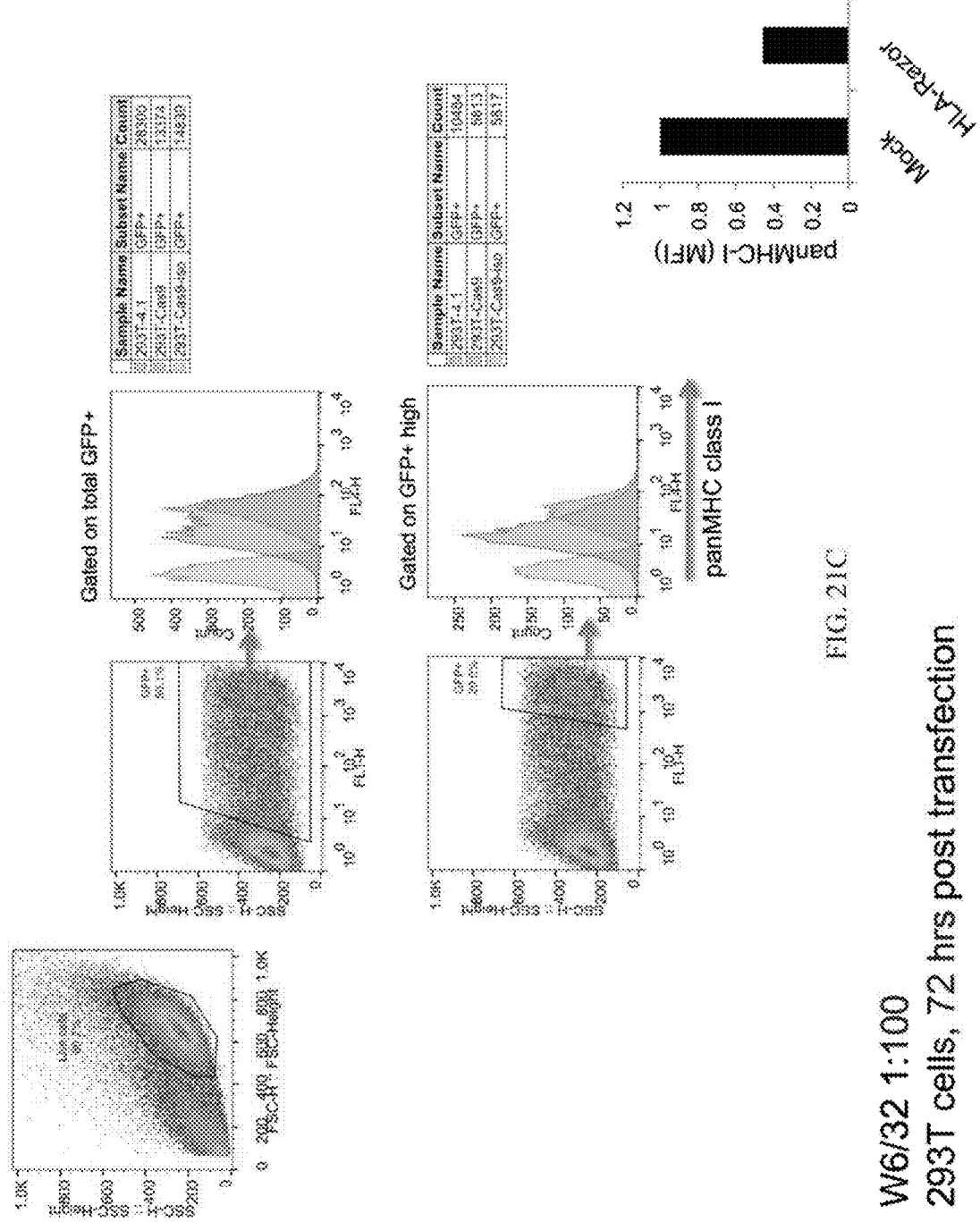
Figure 21D:
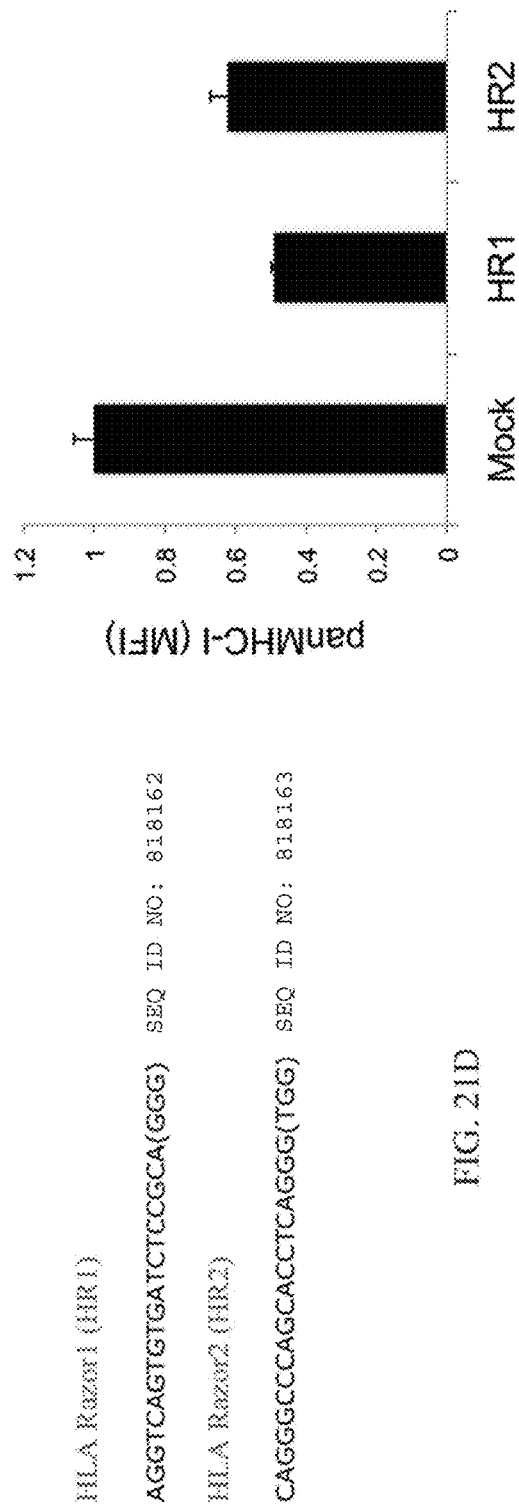

The inventors examined CRISPR guide RNAs that allow simultaneous deletion of all MHC class I alleles by targeting a conserved region in the HLA genes. A TALEN pair of guides that target the same conserved region in MHC class I genes were also identified. Any guide that targets the conserved regions may be identified or classified as an HLA Razor. The targeting of a conserved sequence found in all HLAs by CRISPR or TALENS was demonstrated in FIG. 21A. The two violet boxes indicate the binding sites for the pan-HLA TALEN pair. The blue arrow indicates the pan-HLA CRISPR tested pair, with the PAM being boxed in blue. The expression of pan-HLA-TALENs in 293T and HuES9 cells was shown in FIG. 21B at 72 hours post transfection. The HLA-Razor CRISPR blunts MHC class I expression in 293T cells as demonstrated in FIG. 21C. The 293T cells were also co-transfected with Cas9-GFP. FIG. 21D provides a comparison of the activity of two different HLA Razors targeting two different conserved regions of the HLAs.

Knock-In of PD-L1 and HLA-G

The present inventors have used a CRISPR/Cas system to facilitate the insertion of tolerogenic factors, such as the tolerogenic factors shown in Table 2, into an AAVS1 locus, to actively inhibit immune rejection. As evidenced in FIGS. 11A-11C, tolerogenic factors, such as PD-L1 and HLA-G, have been successfully expressed from the AAVS1 locus.

Figure 22A:
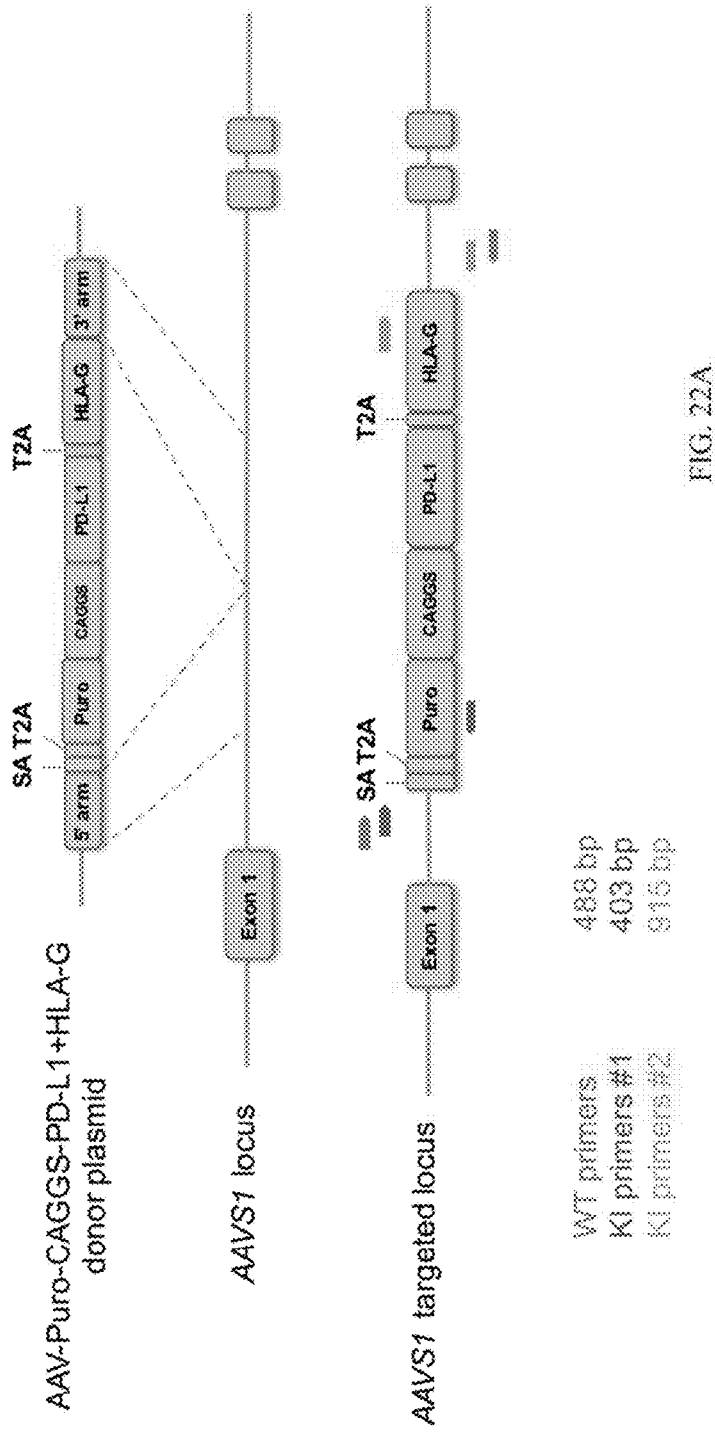
Figure 22B:
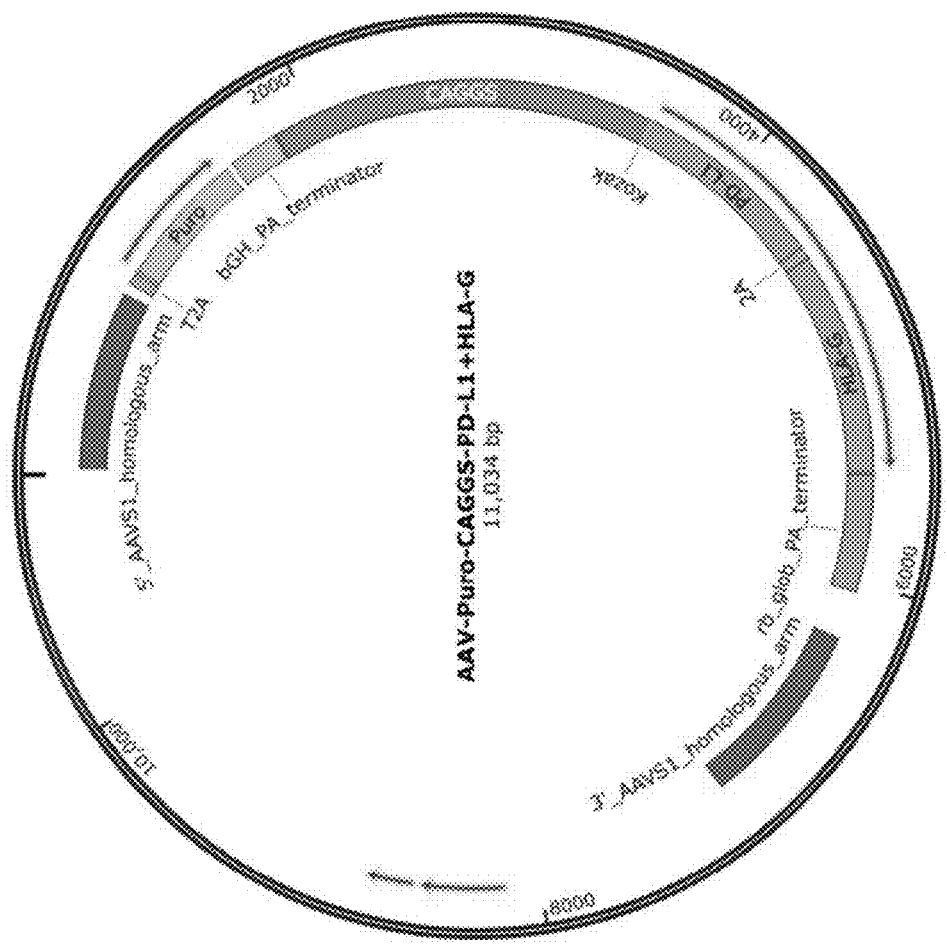

A schematic of the PD-L1 and HLA-G knock-in strategy is shown in FIG. 22A. Wild type (WT) and knock-in (KI) primers for clone screening were designed. The amplicon with WT primers is predicted as 488 bp, and the amplicons with KI primers are predicted as 403 bp and 915 bp. A design of a knock-in donor plasmid (FIG. 22B) shows that the reading frames of PD-L1 and HLA-G are linked by T2A and their expression is driven by a CAGGS promoter. Puromycin was used as a drug resistance marker following the SA-2A gene trap element.

Figure 22C:
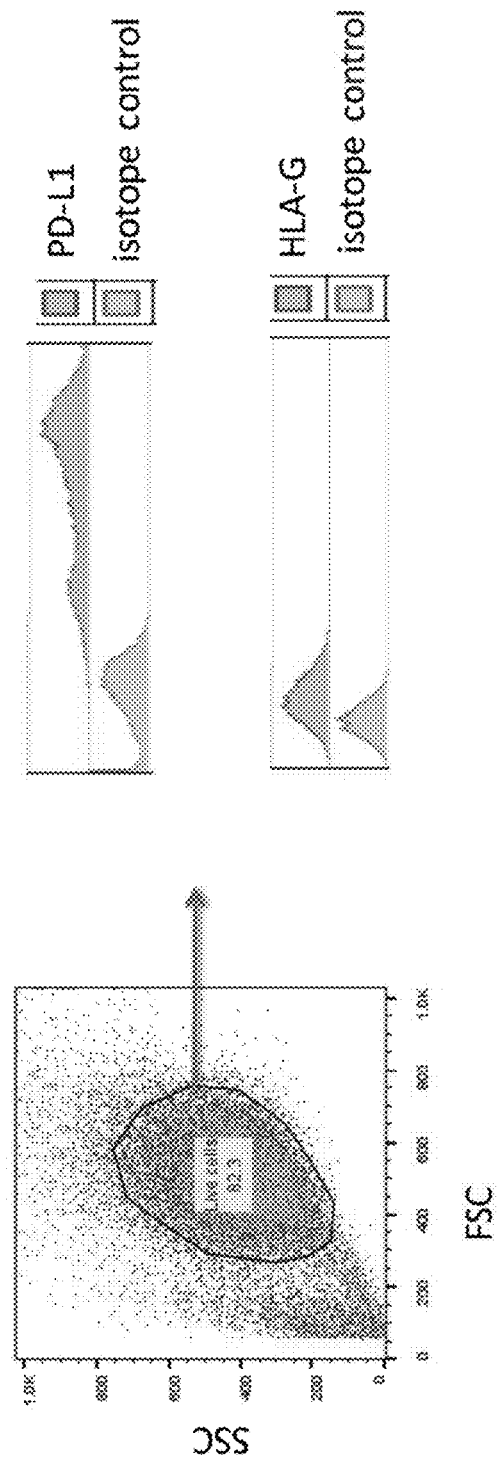
Figure 22D:
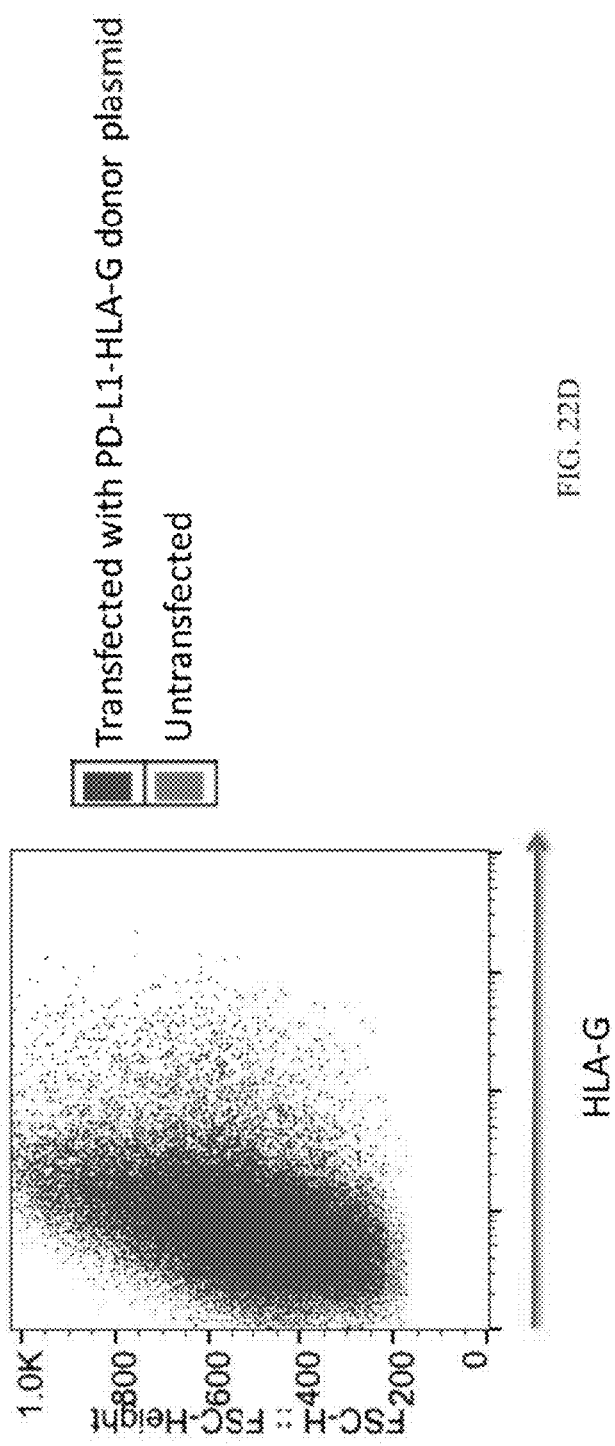

The expression of PD-L1 and HLA-G was examined in the donor plasmid-transfected 293T cells by FACS analysis. FIG. 22C shows the ectopic PD-L1 and HLA-G expression in 293T cells. APC-conjugated PD-L1 antibody and FITC-conjugated HLA-G antibody were used. In addition, the expression of ectopic HLA-G expression in JEG-3 cells is shown in FIG. 22D. The donor plasmid was transfected into an HLA-G−/− JEG-3 cell line, and ectopic HLA-G expression was examined by FACS analysis 48 hours post-transfection. A PE-conjugated HLA-G antibody (MEM/G9) was used to detect surface HLA-G surface expression.

Figure 22F:
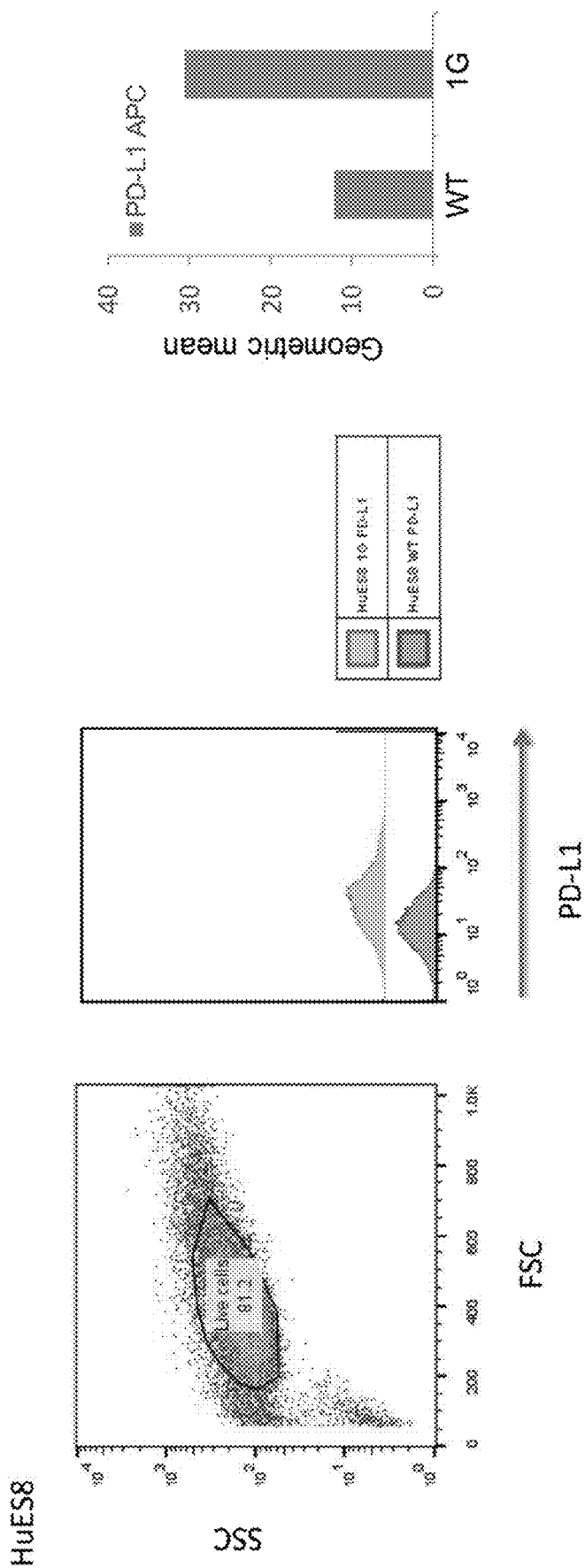

PCR screening was performed, which confirmed that clone 1G was a heterozygous KI clone for PD-L1/HLA-G (FIG. 22E). Clone 1G was identified as a heterozygous KI clone by the presence of bands using both WT primers and KI-specific primers amplified from genomic DNA of targeted HuES8. The expression of PD-L1 was verified in HuES8 KI clone 1G by FACS analysis using an APC-conjugated PD-L1 antibody (FIG. 22F).

Knock-In of CD-47

Figure 23:
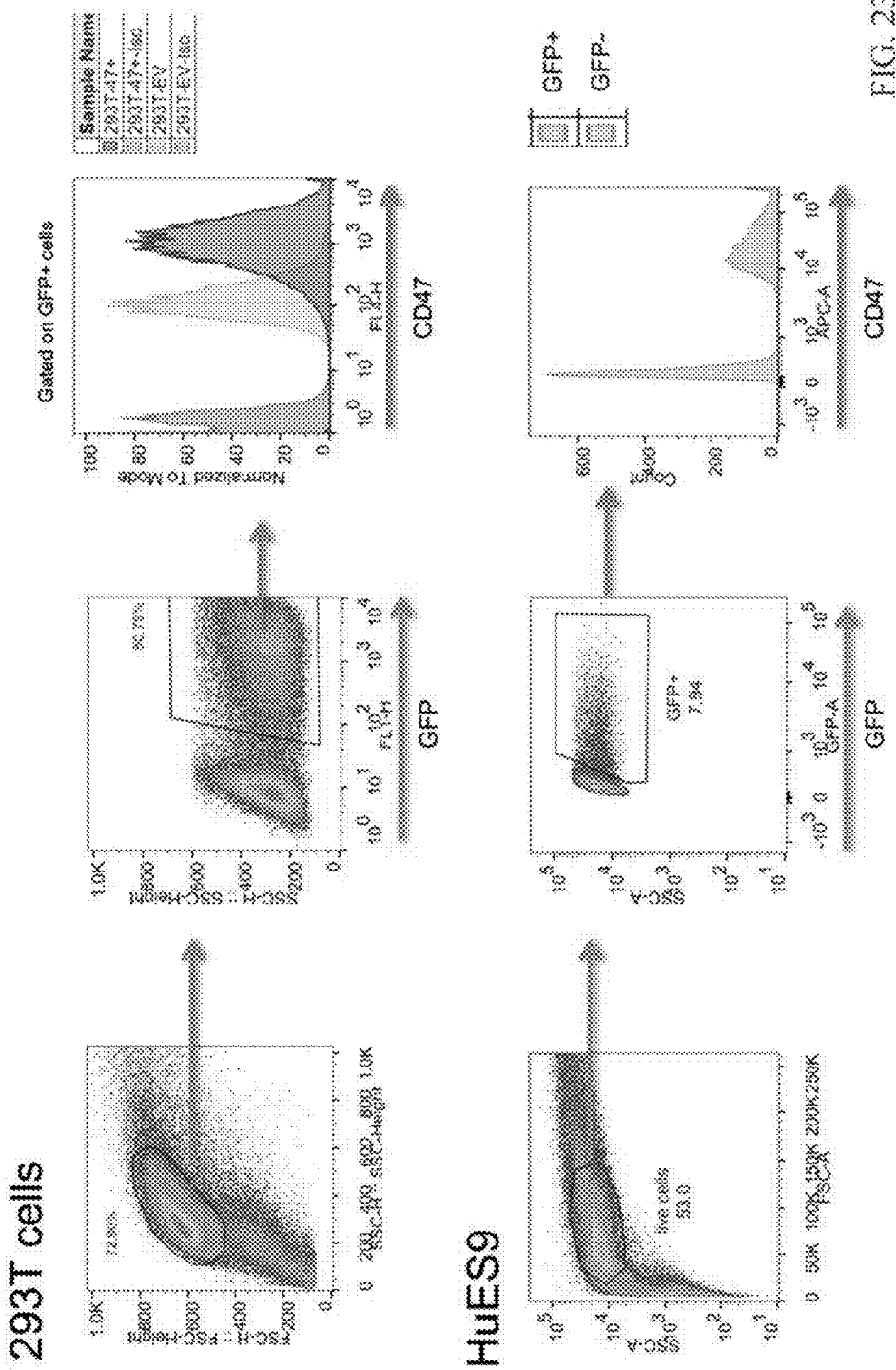
FIG. 23 demonstrates expression of CD47 in 293T cells and hPSCs using a knock-in strategy. Human CD47 was cloned into an expression plasmid driven by a CAG promoter, which in addition contains an IRES-GFP. 293T cells already express high levels of CD47, the human 'don't eat me' signal, which prevents engulfment of cells from macrophages. Expression can be increased by overexpression of CD47 in both 293T cells, as well as in human pluripotent stem cells (HuES9), as detected by FACS using a CD47-specific antibody. Overexpression of CD47 will assist engraftment of stem cell-derived transplants by protecting cells from macrophage engulfment.

In addition, a CD47 knock-in strategy was also examined. Human CD47 was cloned into an expression plasmid driven by a CAG promoter, which also contained an IRES-GFP. 293T cells already express high levels of CD47 (the human "don't eat me" signal), which prevents engulfment of cells from macrophages. Expression can be increased by overexpression of CD47 in both 293T cells, as well as in human pluripotent stem cells (HuES9), as detected by FACS using a CD47-specific antibody (FIG. 23). It is expected that overexpression of CD47 will assist engraftment of stem cell-derived transplants by protecting cells from macrophage engulfment.

Additional targets to be Modified in Universal Donor Cells

Additional targets may be modified in universal donor cells to tailor them to a specific application. For example, additional targets may be modified in universal donor cells to tailor them to be used as universal CAR T cells. In one instance, the inventors deleted TRAC and TRBC in HuES9 to disrupt TCR expression (FIG. 24). A dual guide RNA approach was used to introduce deletions into the TRAC and TRBC loci in HuES9 cells. The TCRA wild type band is 249 bp and after deletion is 209 bp. The TCRB wild type band is 162 bp and after deletion is 140 bp. The inventors additionally targeted TCRA in HuES9 B2M−/−CIITA−/− to create a triple knock-out stem cell line for B2M−/−, CIITA−/− and TCR−/−, which upon differentiation into T cells will be devoid of MHC-I and -II and exhibit no TCR surface expression.

Figure 25B:
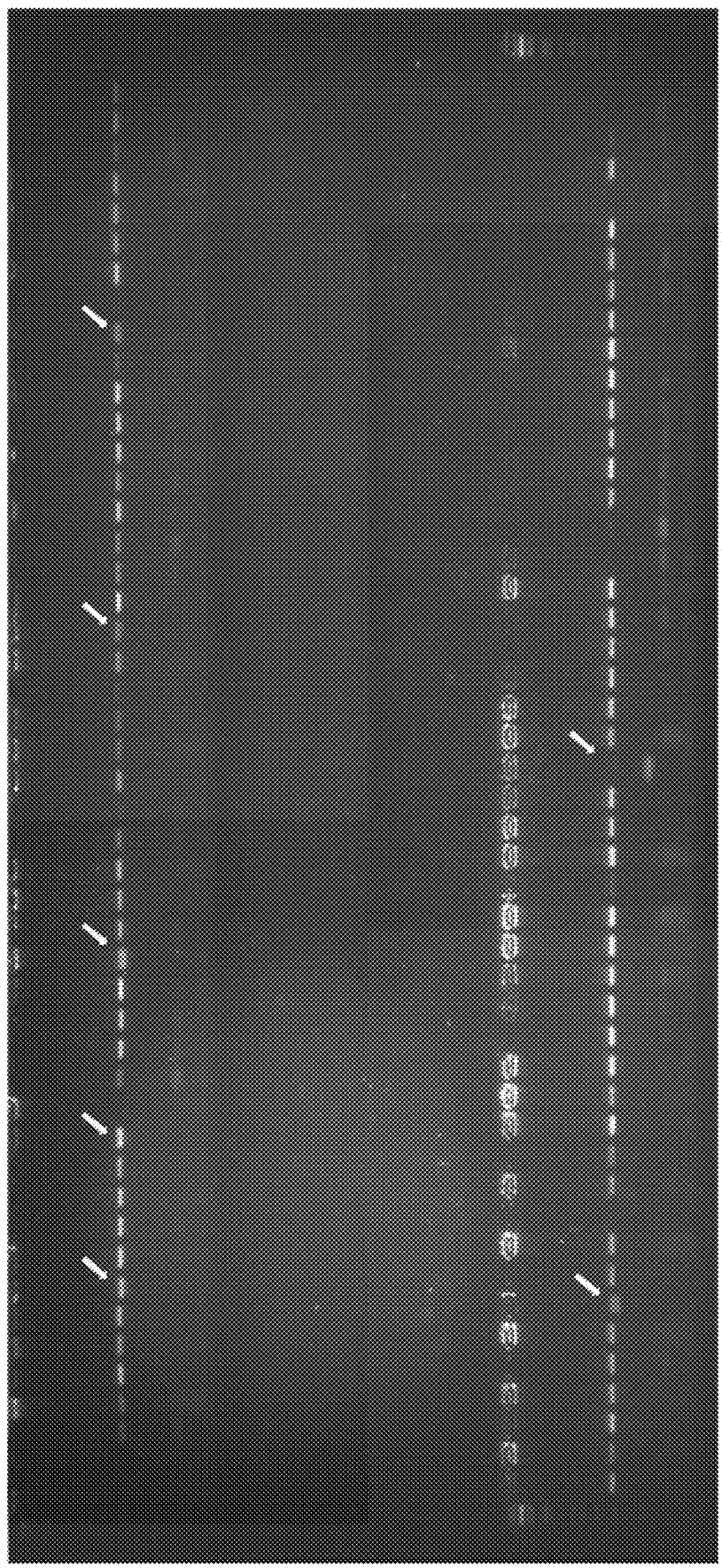
Figure 25C:
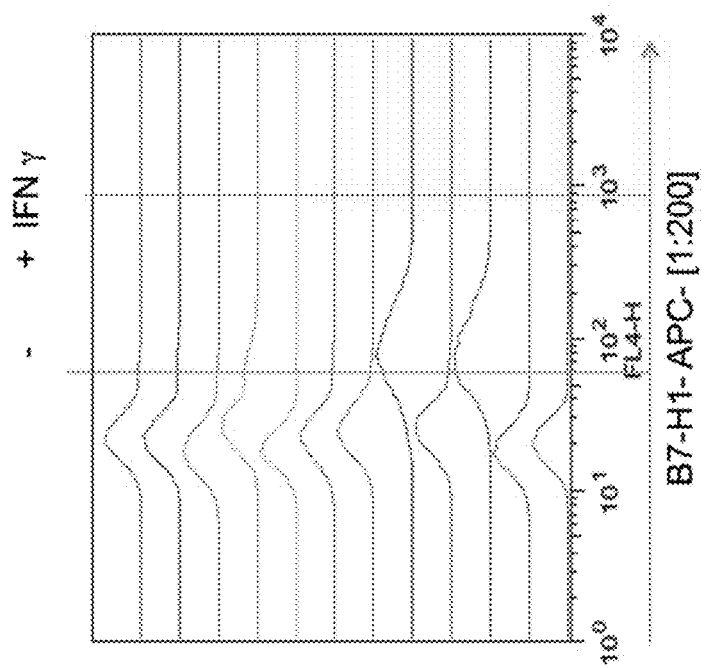
Figure 25D:
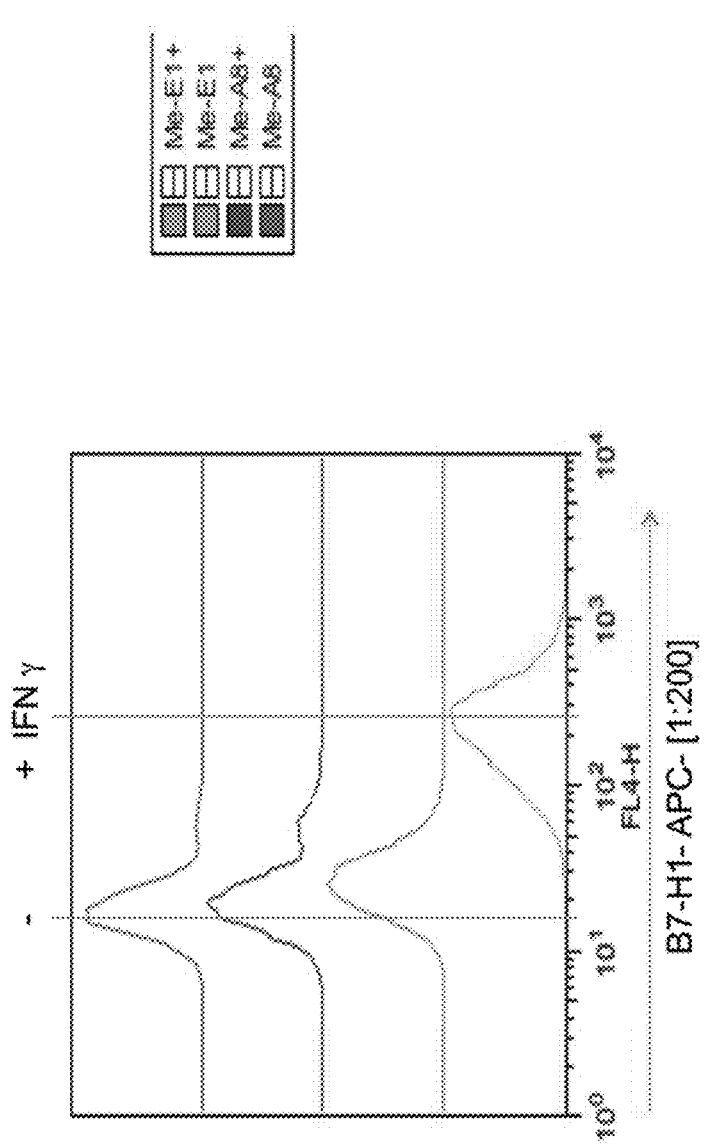

In another instance, the inventors targeted PD-L1 (FIG. 25A). It was identified that CRISPRs targeting Cd274/B7-H1/PD-L1 were very useful in breaking tolerance in cancer immunotherapy. PD-L1 knock out was demonstrated in multiple cell types, including JEG-3, a choriocarcinoma cell line, and in two melanoma cell lines, 501 and MalMe (FIGS. 25B-25D). Screening of targeted B7-H1 colonies was conducted, and it was identified that there was an 8.3% CRISPR cutting efficiency in JEG-3 cells (FIG. 25B). Additionally, reconfirmation of 501 melanoma knock out clones was shown in FIG. 25C, and reconfirmation of MalMe melanoma knock out clones was shown in FIG. 25D.

Targeting Co-Inhibitor/Co-Stimulatory Receptors or Their Ligands

Figure 26A:
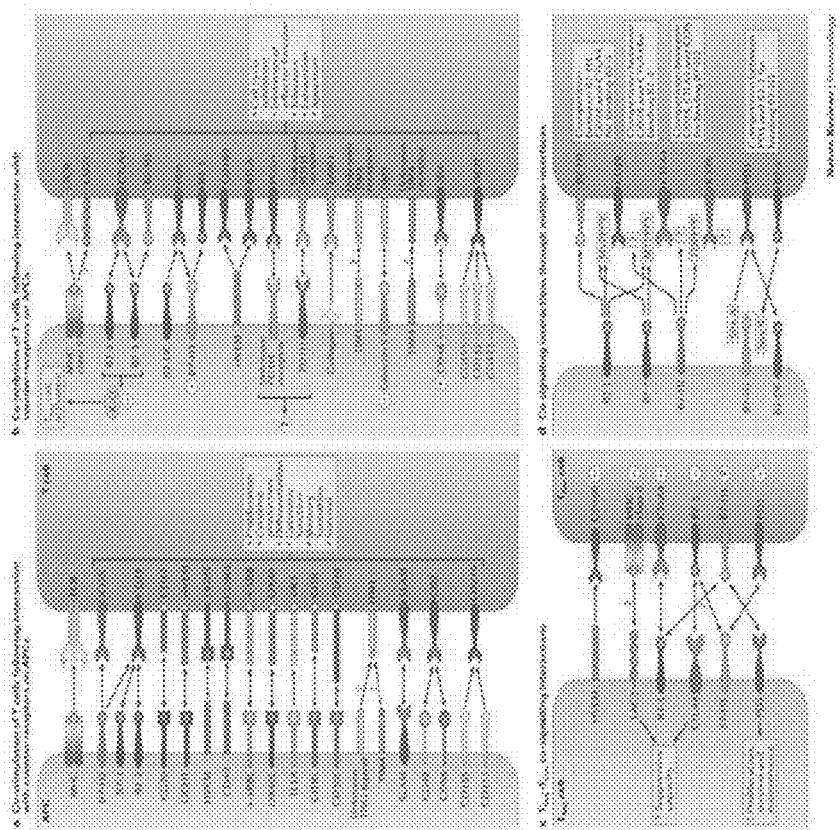
FIGS. 26A-26P demonstrate targeting of co-inhibitory/co-stimulatory receptors or their ligands. For each target, the indicated four CRISPRs have been cloned and tested for on-target activity in 293T cells. The expected size of the PCR band, when cutting of both CRISPRs occurs, is indicated below the gel picture.
Figure 26B:
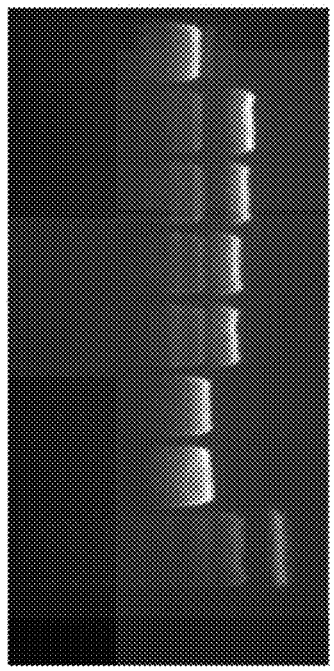
FIG. 26B demonstrates dual guide targeting of TIGIT in 293T cells. All four CRISPRS were found to work.
Figure 26C:
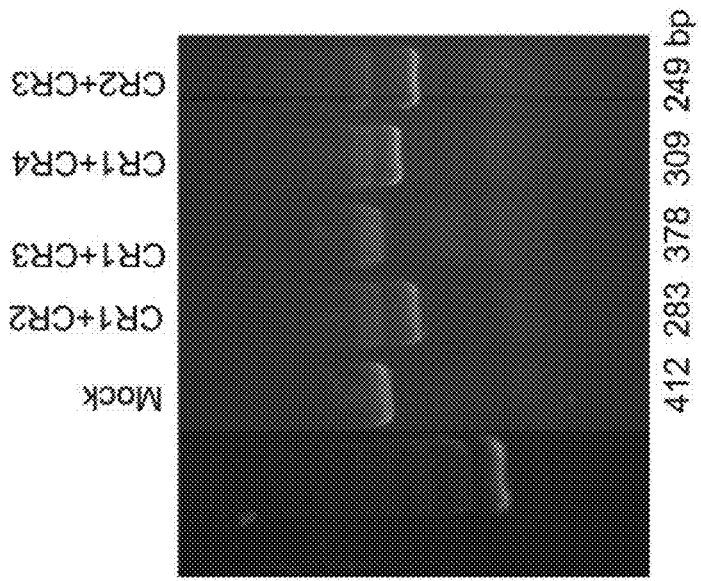
FIG. 26C demonstrates dual guide targeting of TIM3 in 293T cells. All four CRISPRs were found to work.
Figure 26D:
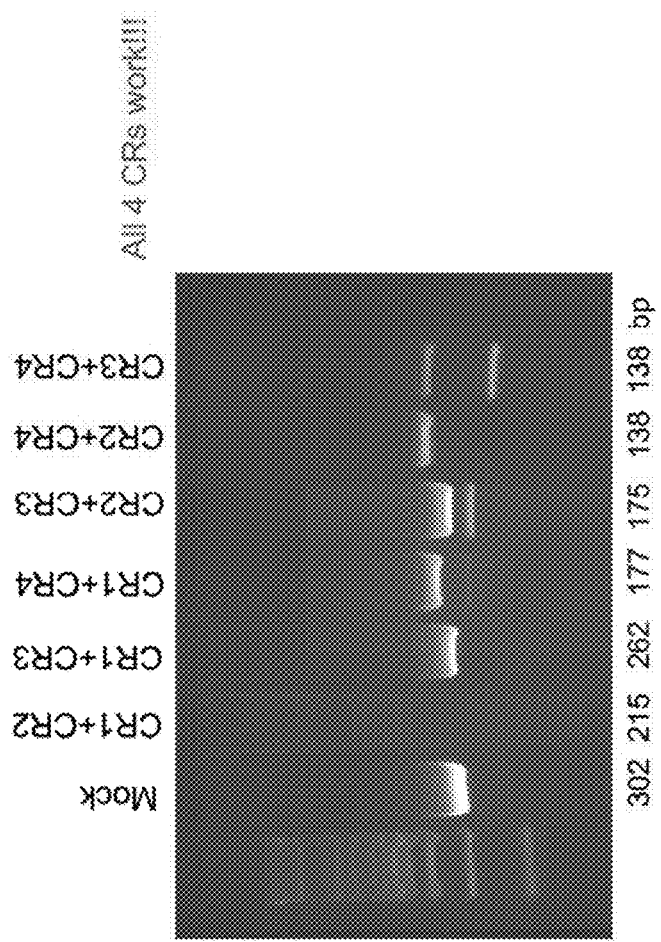
FIG. 26D demonstrates dual guide targeting of HVEM in 293T cells. All four CRISPRs were found to work.
Figure 26E:
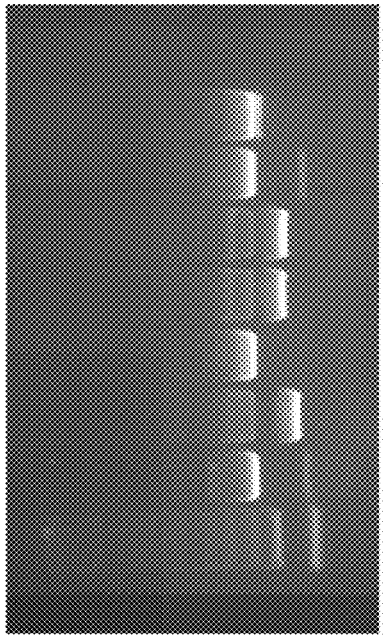
FIG. 26E demonstrates dual guide targeting of 2B4/CD244 in 293T cells. All four CRISPRs were found to work.
Figure 26F:
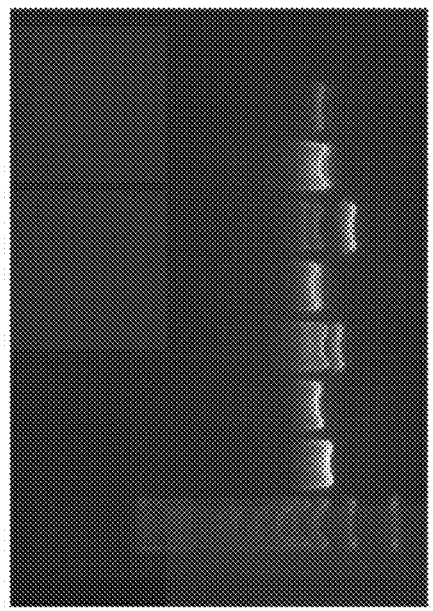
FIG. 26F demonstrates dual guide targeting of CD28 in 293T cells. CRISPRs #1, #2 and #3 were found to work.
Figure 26G:
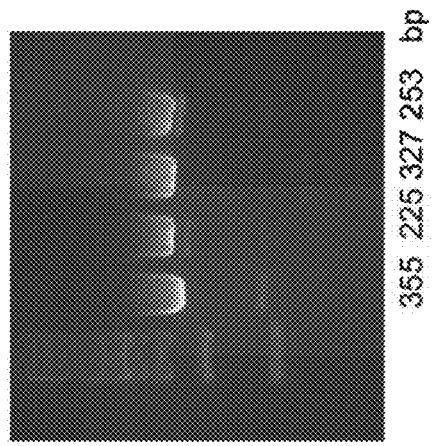
FIG. 26G demonstrates dual guide targeting of OX40 in 293T cells. CRISPRs #1, #2 and #4 were found to work.
Figure 26H:
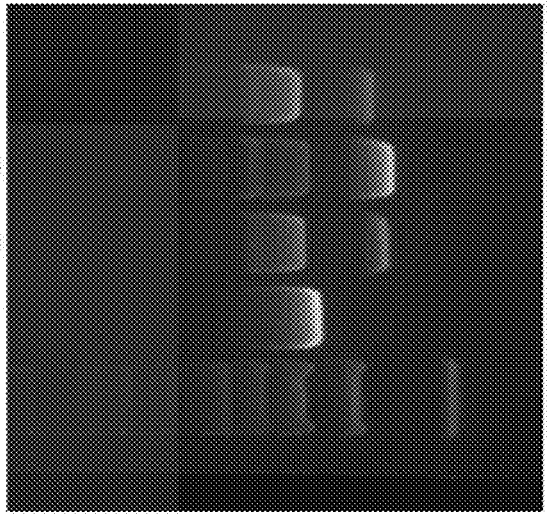
FIG. 26H demonstrates dual guide targeting of B71 in 293T cells. CRISPRs #1, #3 and #4 were found to work.
Figure 26I:
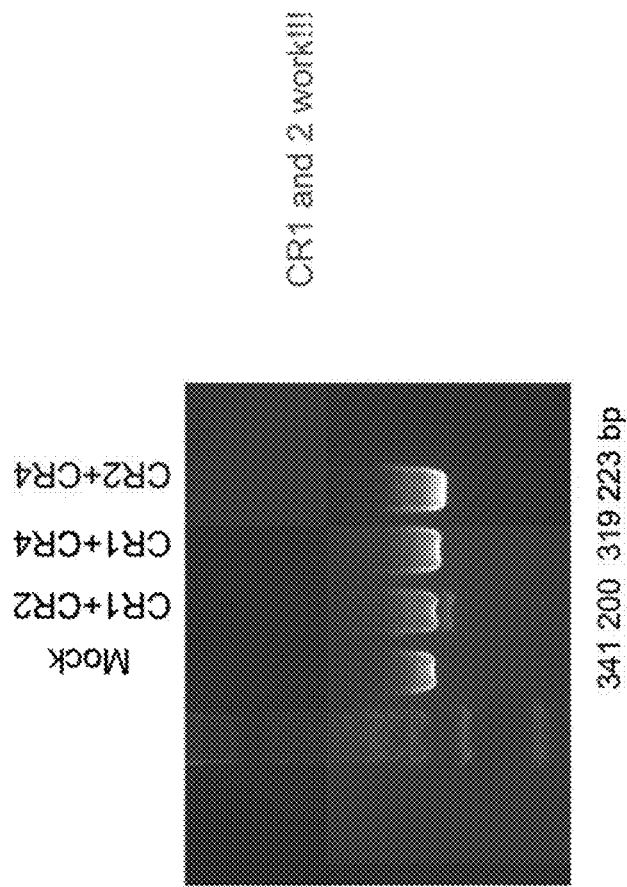
FIG. 26I demonstrates dual guide targeting of CD226 in 293T cells. CRISPRs #1 and #2 were found to work.
Figure 26J:
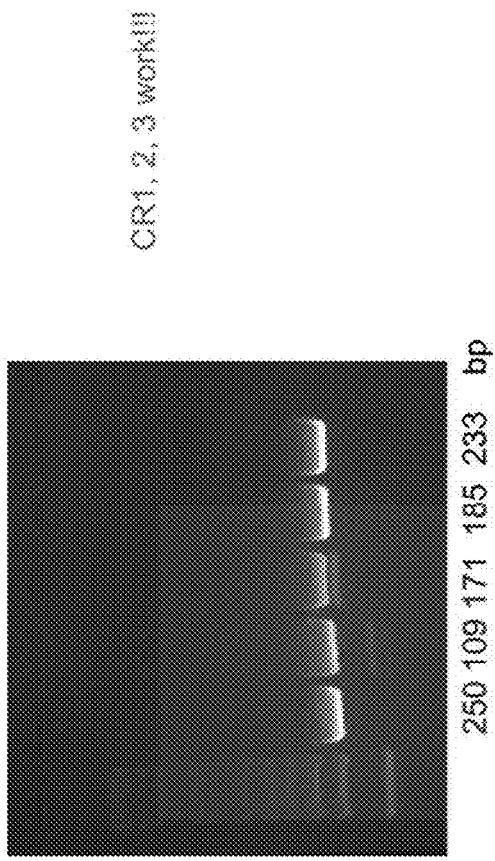
FIG. 26J demonstrates dual guide targeting of CD2 in 293T cells. CRISPRs #1, #2 and #3 were found to work.
Figure 26K:
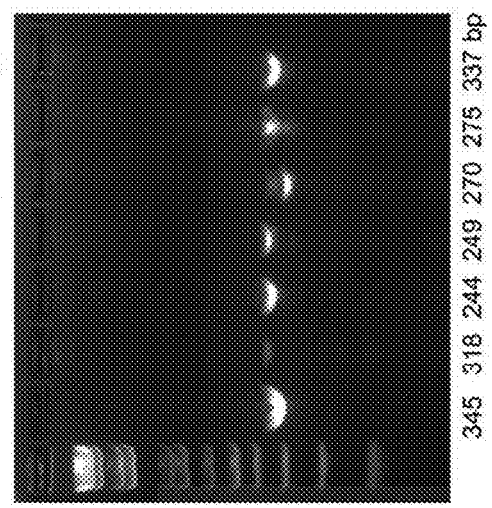
FIG. 26K demonstrates dual guide targeting of LAG3 in 293T cells. CRISPRs #2 and #3 were found to work.
Figure 26L:
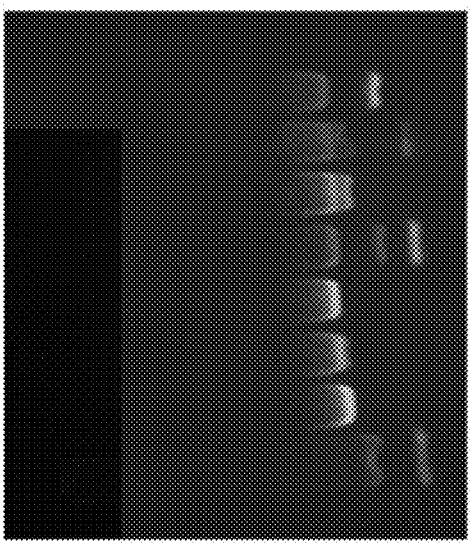
FIG. 26L demonstrates dual guide targeting of BTLA in 293T cells. All four CRISPRs were found to work.
Figure 26M:
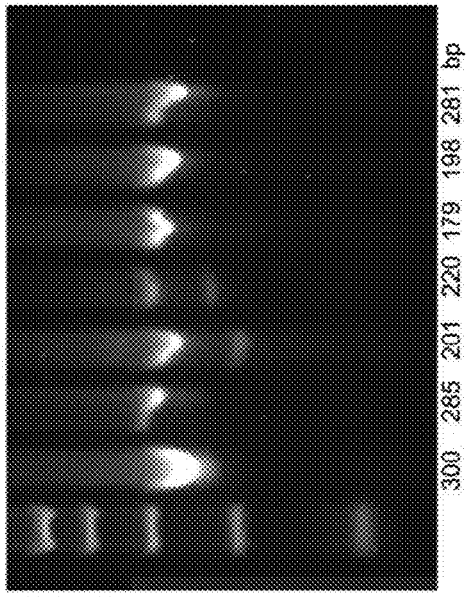
FIG. 26M demonstrates dual guide targeting of ICOS in 293T cells. CRISPRs #2, #3 and #4 were found to work.
Figure 26N:
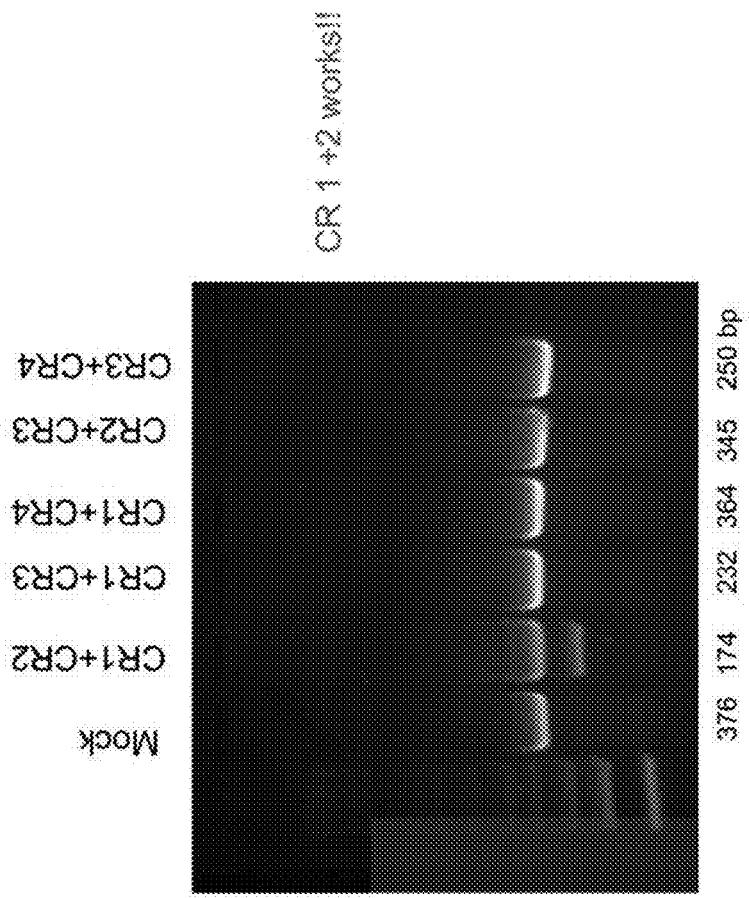
FIG. 26N demonstrates dual guide targeting of CD27 in 293T cells. CRISPRs #1 and #2 were found to work.
Figure 26O:
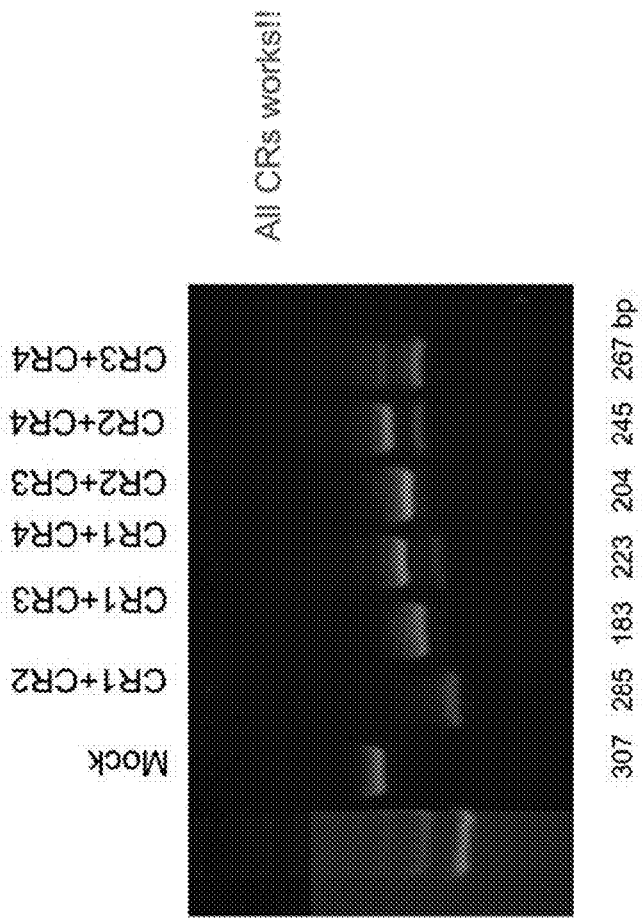
FIG. 26O demonstrates dual guide targeting of ST2 in 293T cells. All four CRISPRs were found to work.
Figure 26P:
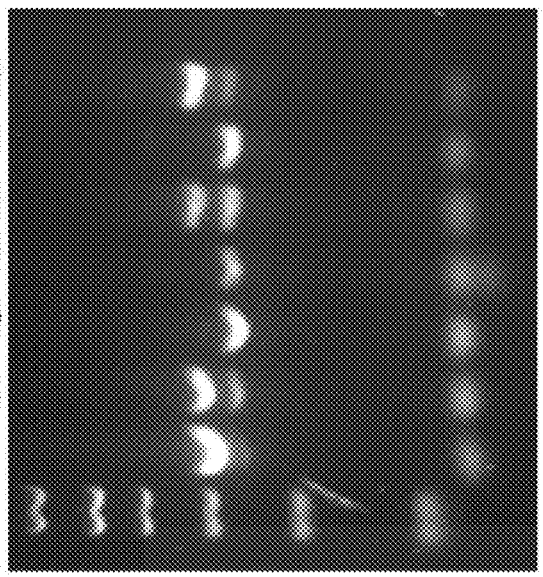

The inventors examined multiple targets utilizing CRISPR. An illustration of co-stimulatory/inhibitory molecules and their receptors on T cells is provided in FIG. 26A. For each target examined, the indicated four CRISPRs have been cloned and tested for on-target activity in 293T cells. The expected size of the PCR band, when cutting of both CRISPRs occurs, is indicated below each individual gel picture (FIGS. 26B-26P). Dual guide targeting in 293T cells was demonstrated for TIGIT (FIG. 26B), TIM3 (FIG. 26C), HVEM (FIG. 26D), 2B4/CD244 (FIG. 26E), CD28 (FIG. 26F), OX40 (FIG. 26G), B71 (FIG. 26H), CD226 (FIG. 26I), CD2 (FIG. 26J), LAG3 (FIG. 26K), BTLA (FIG. 26L), ICOS (FIG. 26M), CD27 (FIG. 26N), ST2 (FIG. 26O) and GITR (FIG. 26P).

Figure 30B:
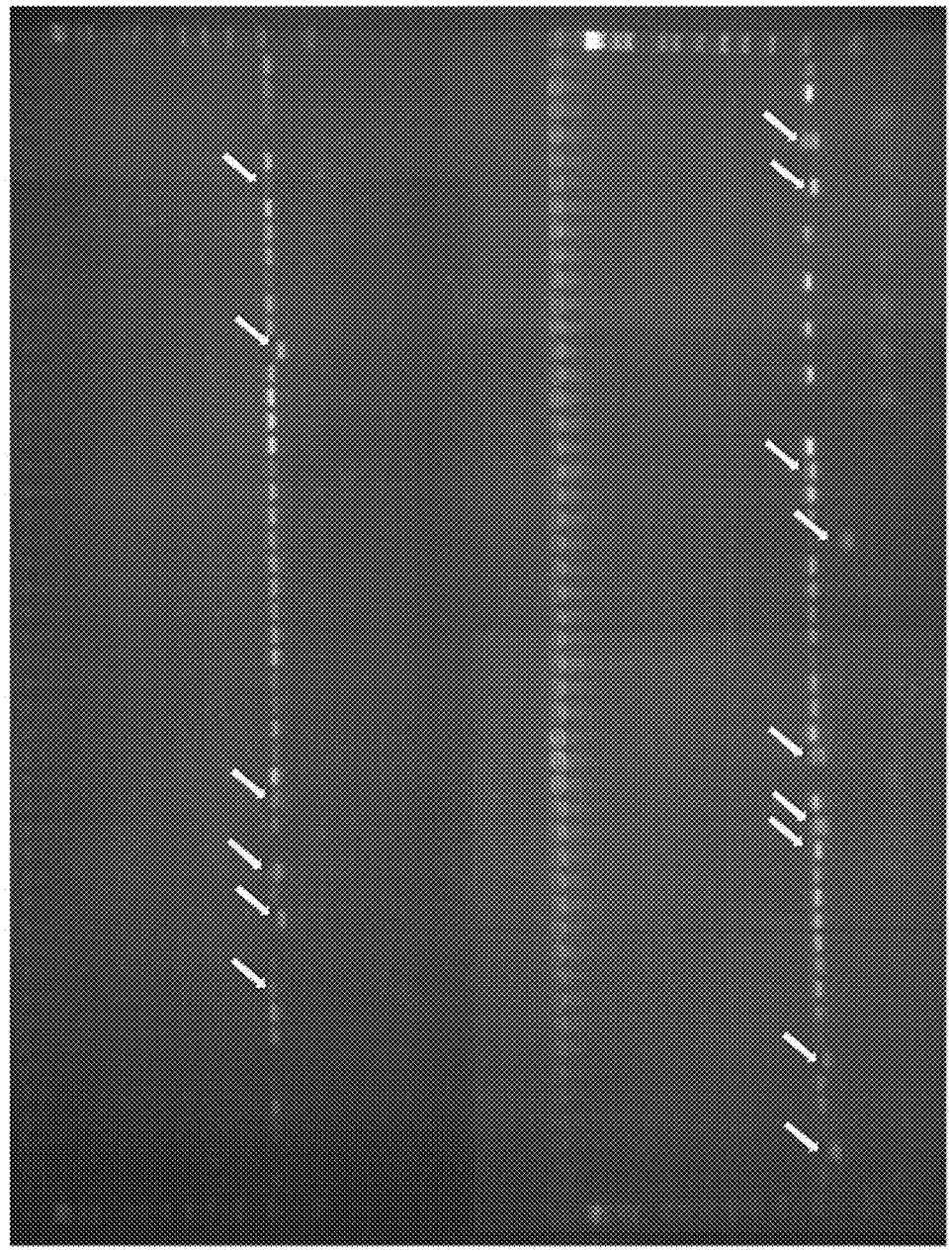
Figure 30C:
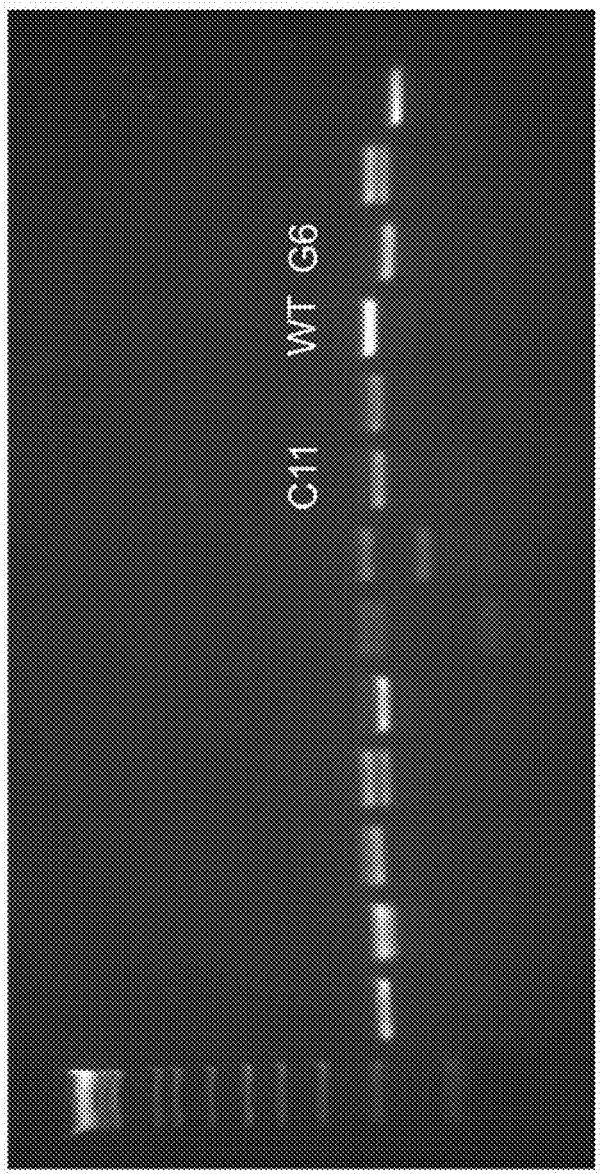
Figure 30D:
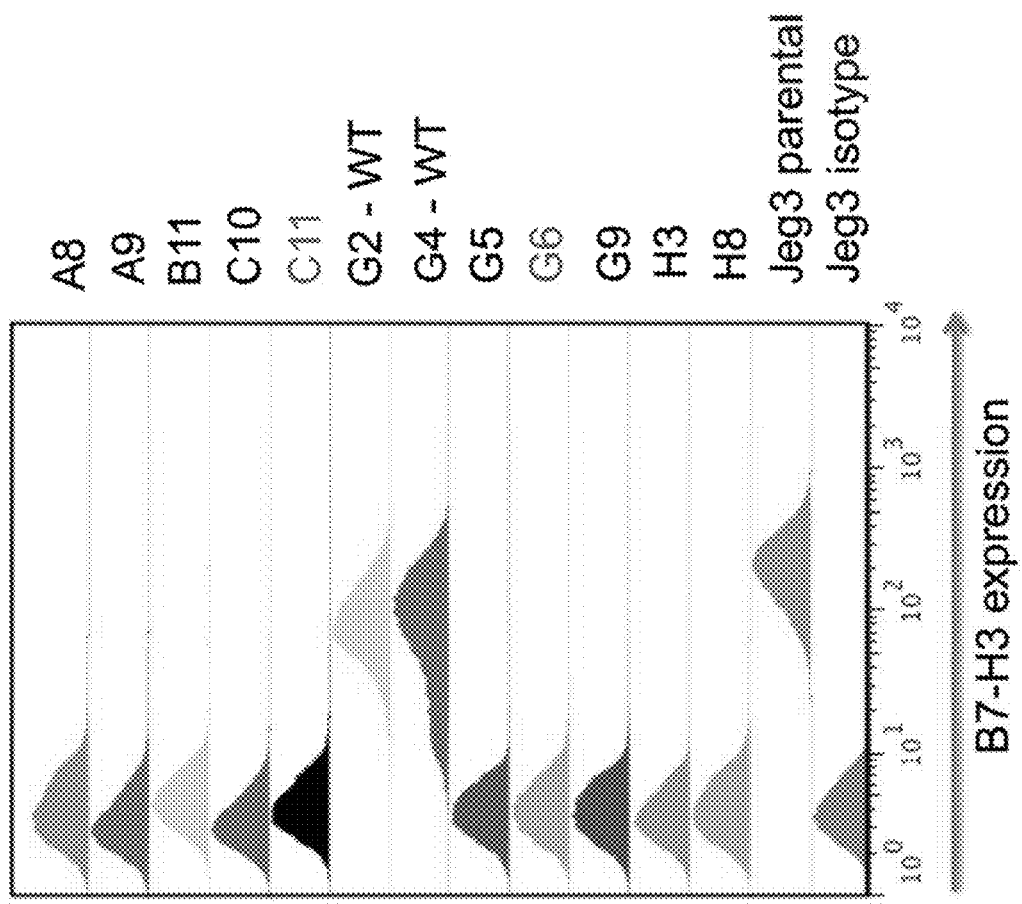

CRISPR targeting of B7-H3 was examined in JEG-3 cells (FIGS. 30A-30D). FIG. 30B shows a screening of targeted B7-H3 colonies in JEG-3 cells and identifies a CRISPR cutting efficiency of 15/80 or about 18.7%. Confirmation of the B7-H3 knock-outs through sequencing was performed (FIG. 30C) and the loss of B7-H3 surface expression in targeted Jeg3 clones was provided in FIG. 30D.

Differentiation of Modified Embryonic Stem Cells

Modified embryonic stem cells may be differentiated into a variety of different cell types, with reduced or absent HLA expression (FIG. 28A). Examples of such cell types include mesenchymal progenitors cells (MPCs), hypoimmunogenic cardiomyocytes, endothelial cells (ECs), macrophages, hepatocytes, beta cells (e.g., pancreatic beta cells), or neural progenitor cells (NPCs).

Figure 28B:
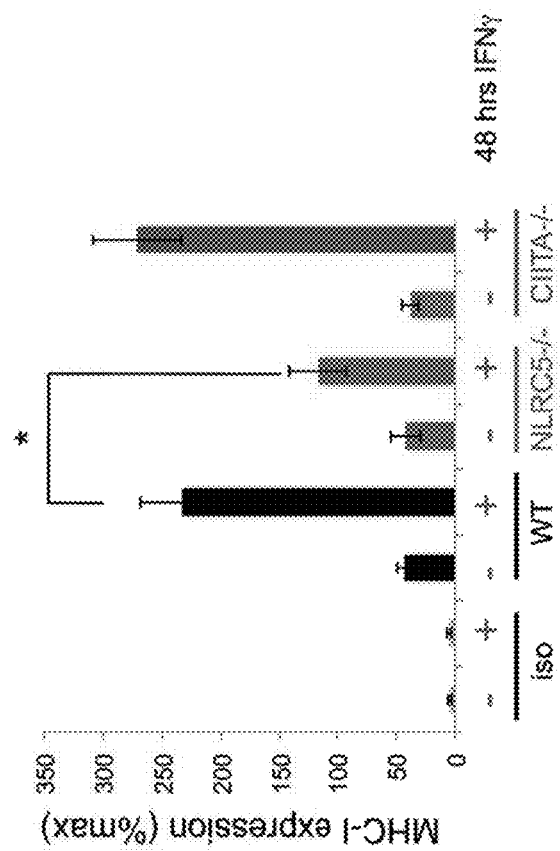

Initially, the inventors demonstrated reduced MHC-I expression in NLRC5−/− human ES cells in FIG. 28B. Low basal MHC-I expression was seen in stem cells, but expression could be increased by IFNγ stimulation. There is about a 50% reduction in IFNγ-treated NLRC5−/− cells.

Figure 28C:
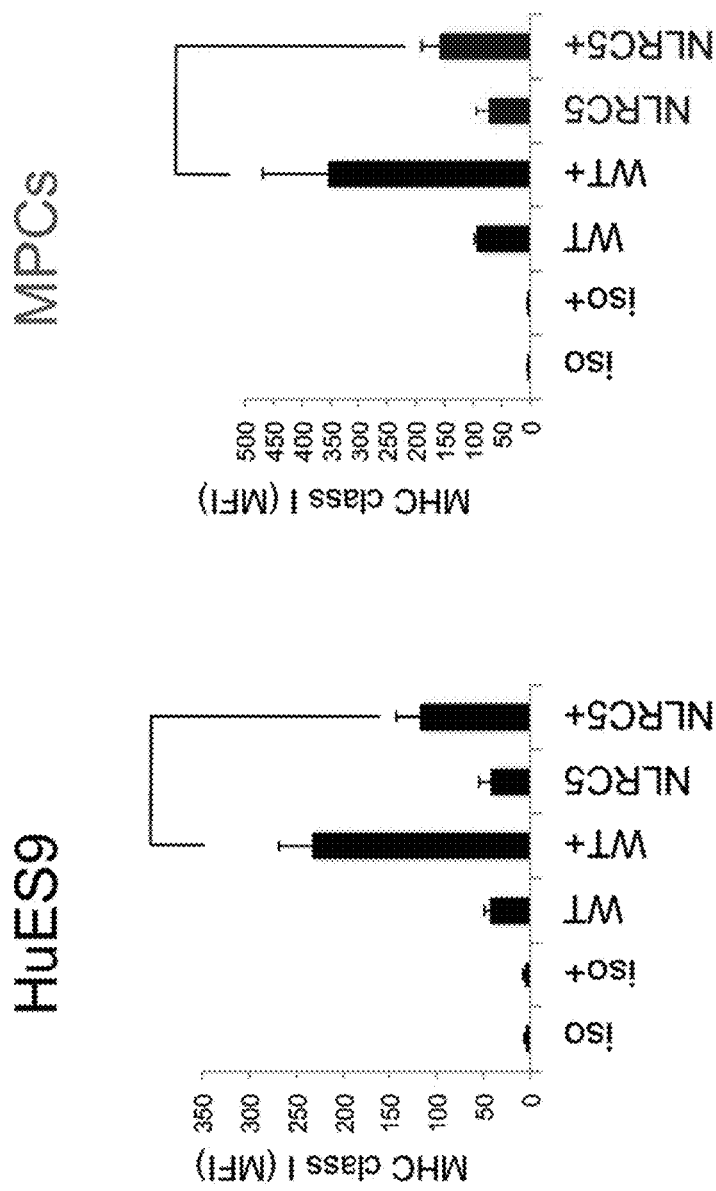
Figure 28D:
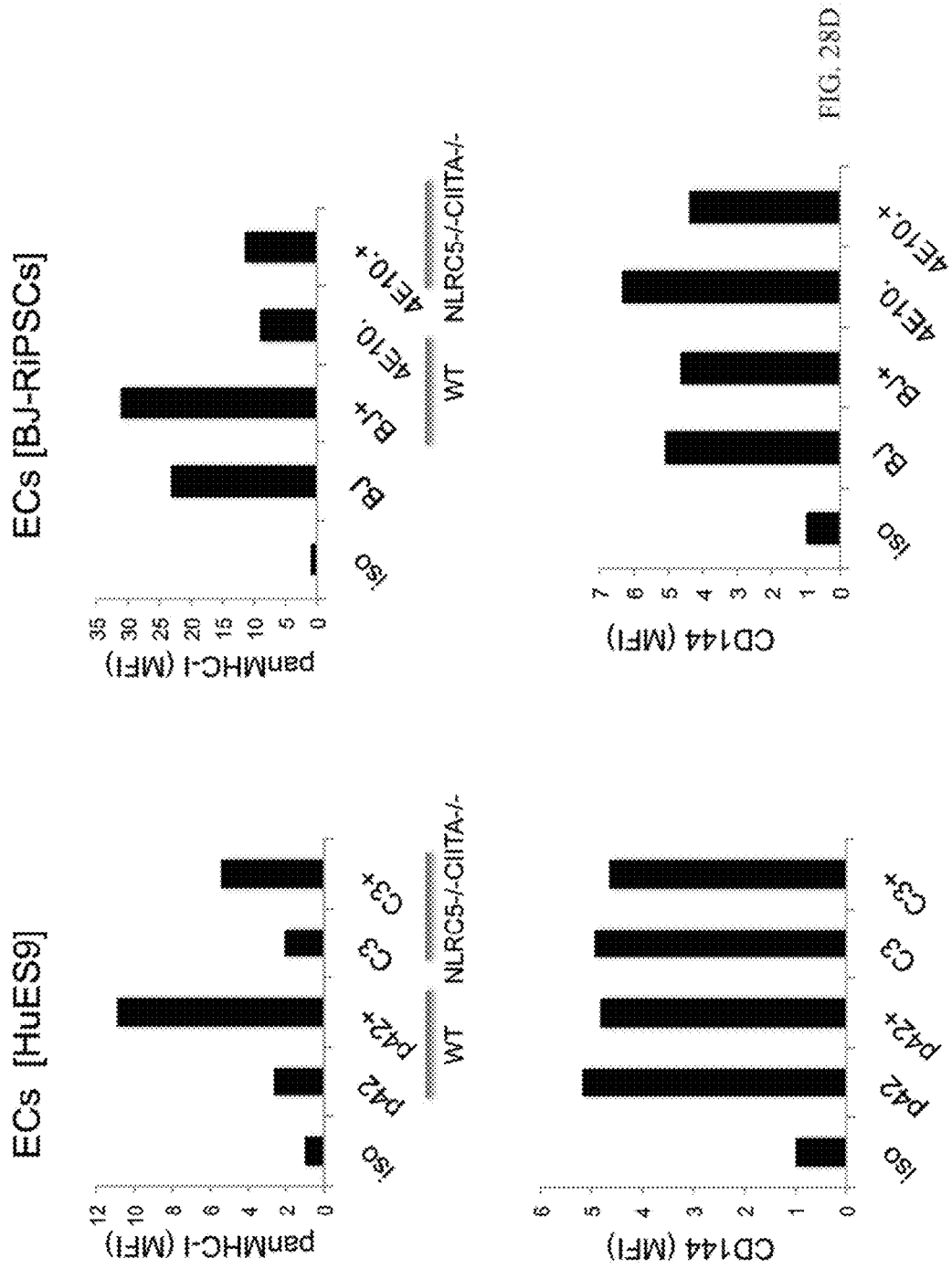
Figure 28E:
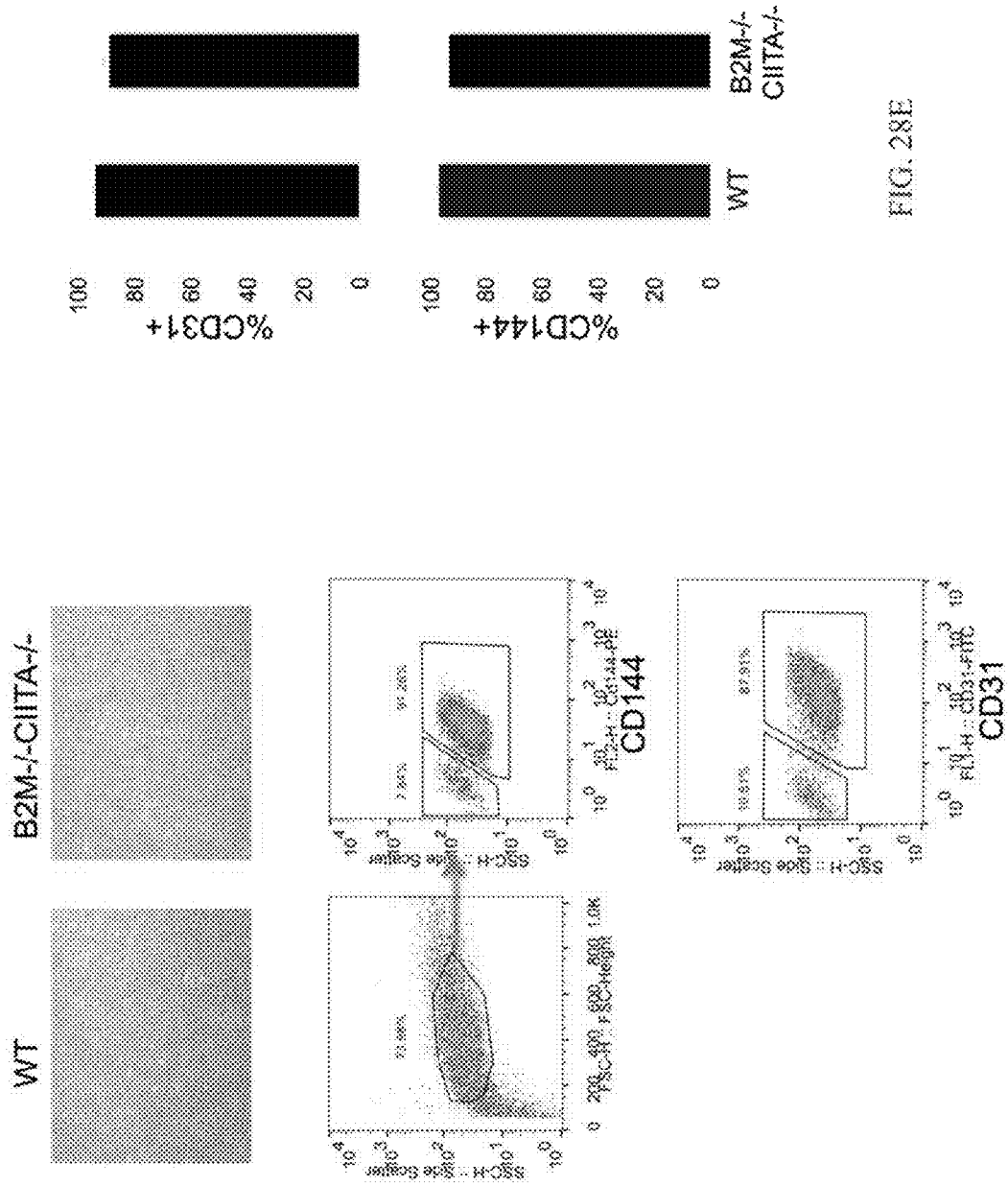
Figure 28F:
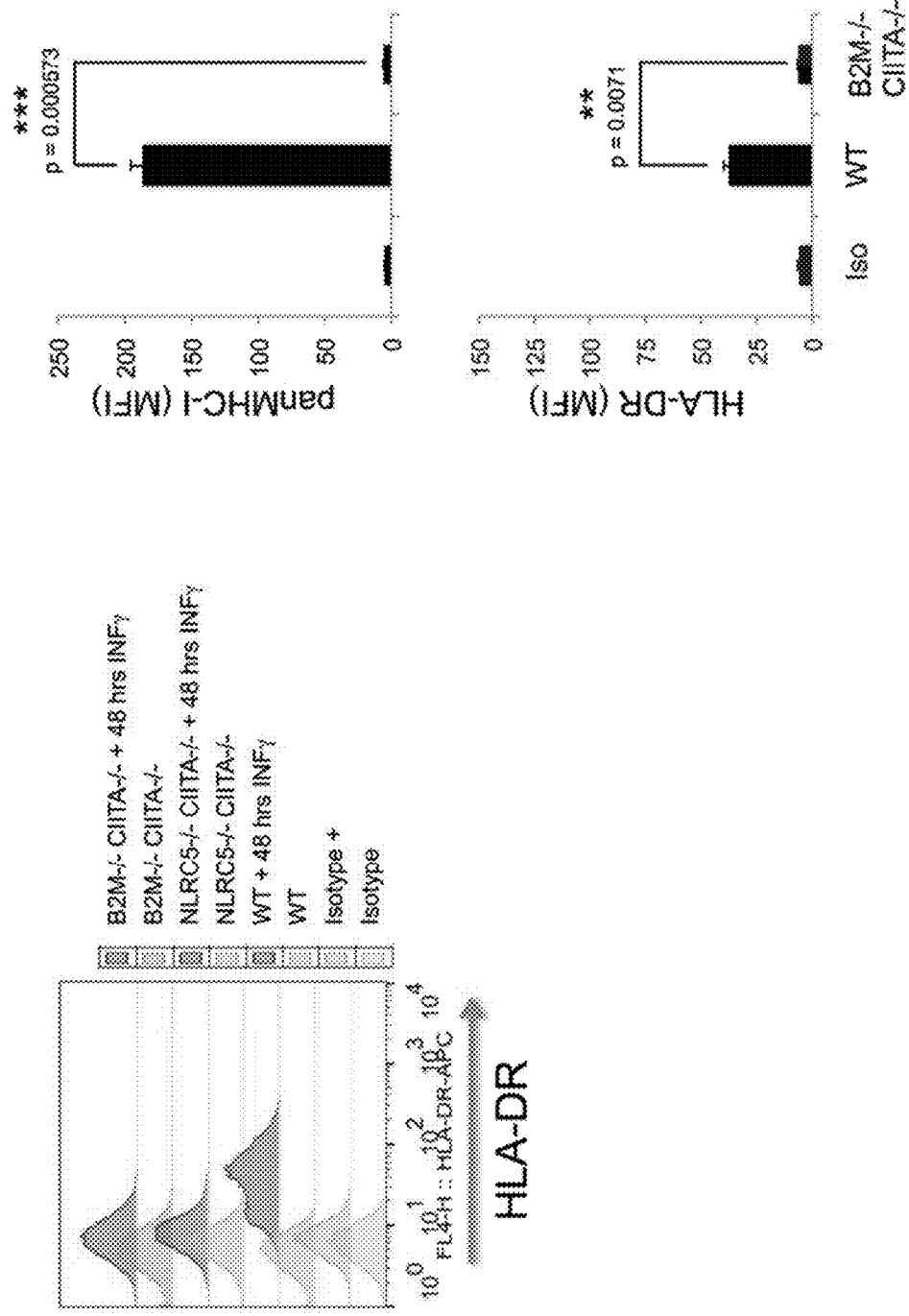
Figure 28G:
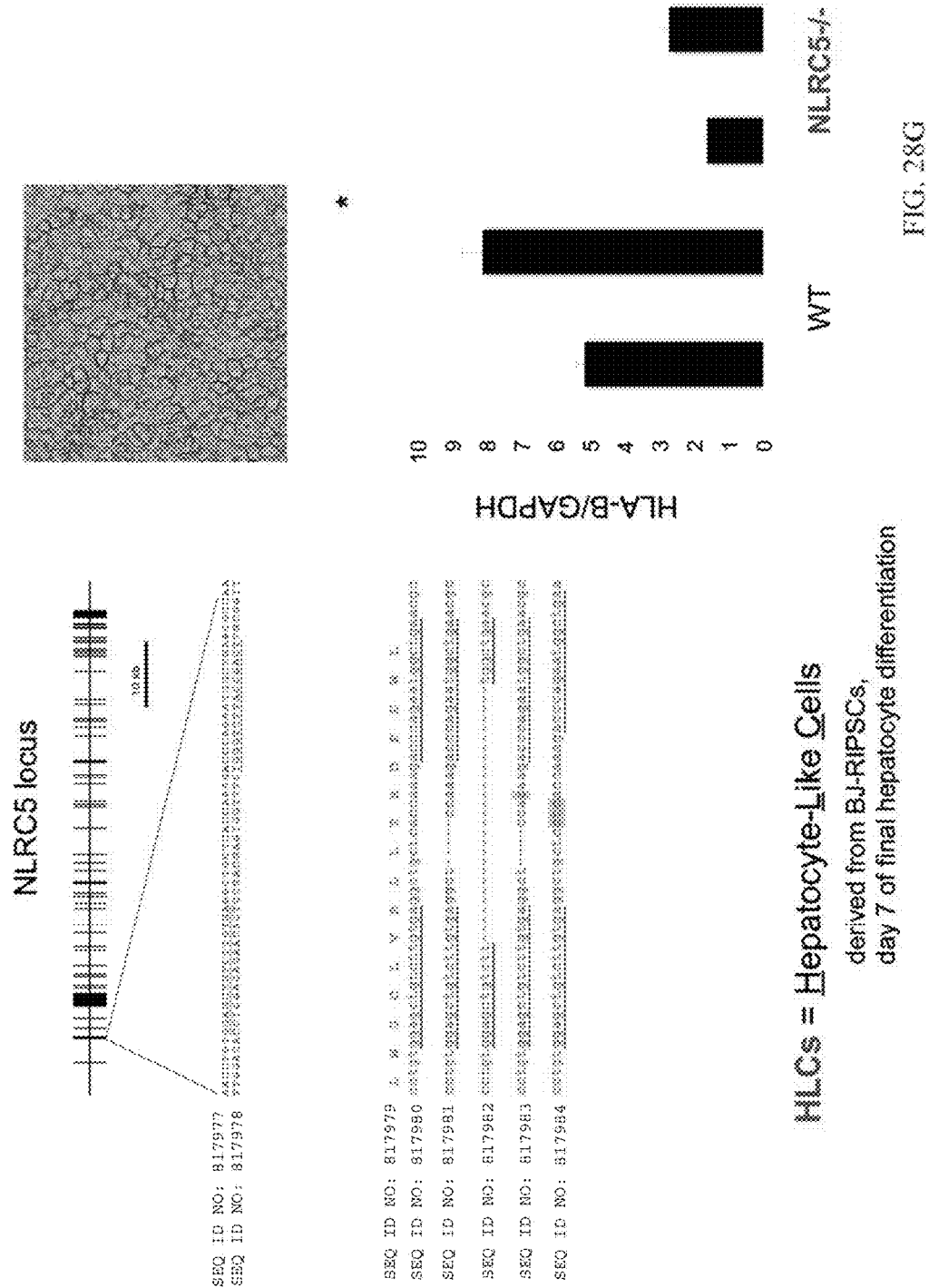

The inventors then examined MHC-I expression in various differentiated cell types. For example, FIG. 28C shows reduced MHC-I expression in NLRC5−/− human mesenchymal progenitor cells (MPCs). The graphs included in FIG. 28C demonstrate the differences between MHC-I expression in HuES9 cells and MPC cells. FIG. 28D shows reduced MHC-I expression in stem cell-derived NLRC5−/− endothelial cells (ECs). Similar differentiation efficiency for ECs was shown in FIG. 28E, and a loss of HLA expression in B2M−/−CIITA−/− ECs was shown in FIG. 28F. Next, reduced MHC class I expression in NLRC5−/− hepatocyte-like cells (HLCs) was provided (FIG. 28G). The HLCs were derived from BJ-RIPSCs.

Figure 28I:
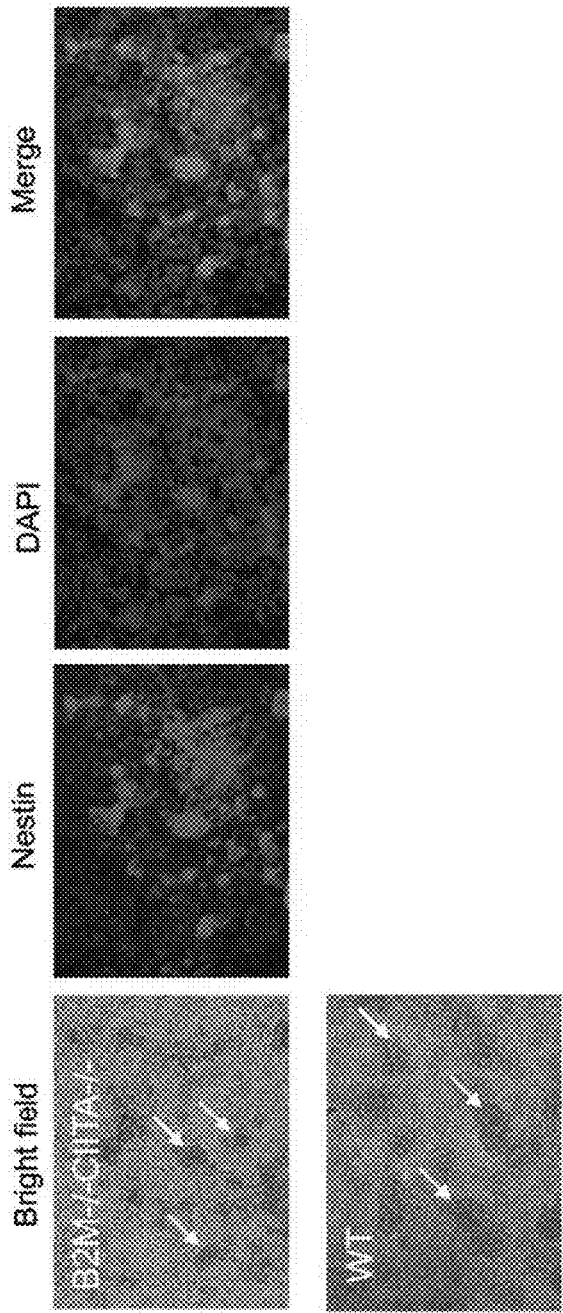
Figure 28J:
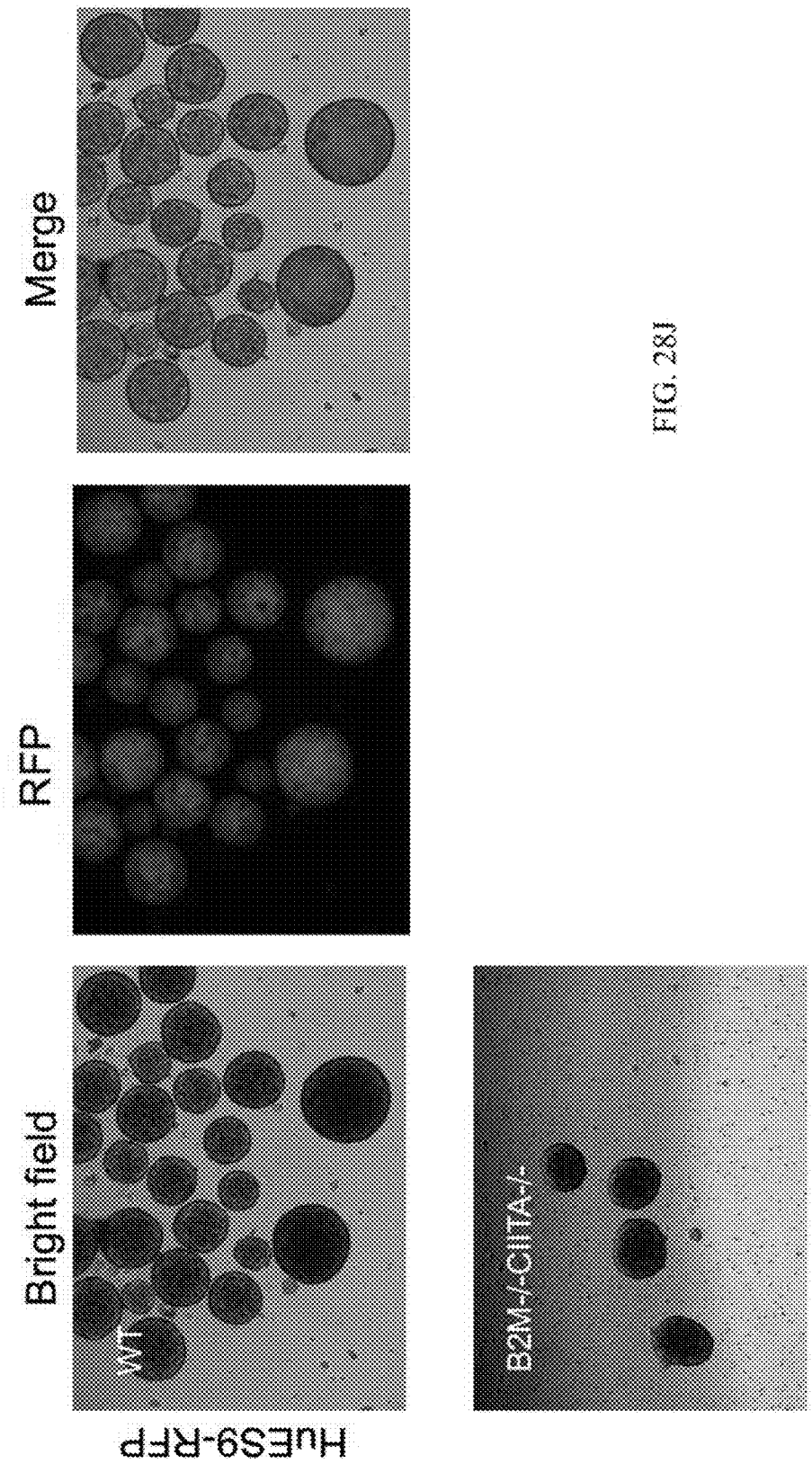

At FIG. 28H it is shown that a mutation of CIITA abrogates MHC class II expression in hESC-derived macrophages. Additionally, neural progenitor cells (NPCs) are differentiated from an embryonic stem cell (FIG. 28I). It was shown that B2M−/−CIITA−/−HuES9 cells form Nestin+ neural rosettes (white arrows in figure) as a result of differentiation. Finally, the inventors have adapted modified embryonic stem cells to spin culture so as to be utilized for beta-cell differentiation (FIG. 28J).

In Vivo Data

Figure 29B:
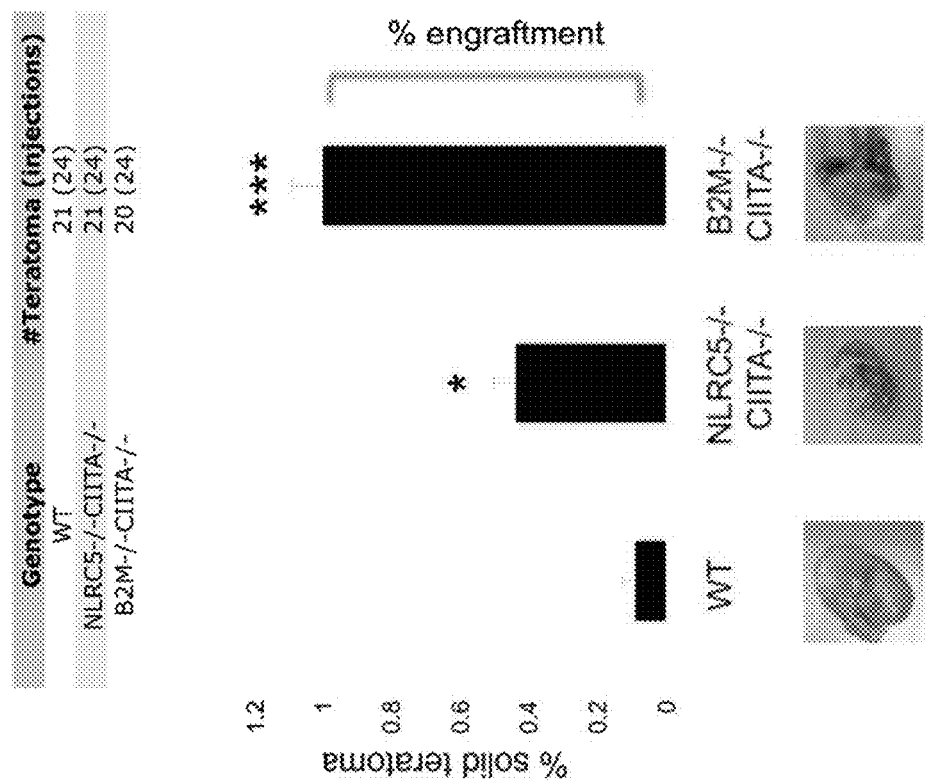

Finally, the inventors have generated 'hypoimmunogenic' DKO cell lines (FIG. 29A). The cells lines examined were WT HuES9 cells, NLRC5−/− C2TA−/− HuES9 cells and B2M−/− C2TA−/− HuES9 cells. The different cells lines showed different levels of MHC-I and MHC-II expression (FIG. 29A). For example, WT HuES9 cells exhibited expression of MHC-I and MHC-II. The NLRC5−/− C2TA−/− HuES9 cells exhibited reduced MHC-I expression and no MHC-II expression. The B2M−/− C2TA−/− HuES9 cells exhibited no MHC-I and MHC-II expression. These cells lines were then examined in humanized mice and improved engraftment of genome-edited stem cells in humanized mice was shown in FIG. 29B.

SEQUENCE LISTING (818254 sequences)

SEQ ID NO: 1 - protein, 1368 aa, synthetic construct [sequence omitted]

SEQ ID NO: 2 - DNA, 20 bp, synthetic construct
  misc_feature 1..20: note = CRISPR gRNA sequence
  source 1..20: mol_type = other DNA
gggtttccagagaagccaat

SEQ ID NO: 3 - DNA, 20 bp, synthetic construct
  misc_feature 1..20: note = CRISPR gRNA sequence
  source 1..20: mol_type = other DNA
gaagccaatcagtgtcgtcg

SEQ ID NO: 4 - DNA, 20 bp, synthetic construct
  misc_feature 1..20: note = CRISPR gRNA sequence
  source 1..20: mol_type = other DNA
tcgtcgcggtcgctgttcta

SEQ ID NO: 5 - DNA, 20 bp, synthetic construct
  misc_feature 1..20: note = CRISPR gRNA sequence
  source 1..20: mol_type = other DNA
taaagcccgcacgcacccac

SEQ ID NO: 6 - DNA, 20 bp, synthetic construct
  misc_feature 1..20: note = CRISPR gRNA sequence
  source 1..20: mol_type = other DNA
aaagcccgcacgcacccacc

SEQ ID NO: 7 - DNA, 20 bp, synthetic construct
  misc_feature 1..20: note = CRISPR gRNA sequence
  source 1..20: mol_type = other DNA
cgcacgcacccaccgggact

SEQ ID NO: 8 - DNA, 20 bp, synthetic construct
  misc_feature 1..20: note = CRISPR gRNA sequence
  source 1..20: mol_type = other DNA
accgggactcagattctccc

SEQ ID NO: 9 - DNA, 20 bp, synthetic construct
  misc_feature 1..20: note = CRISPR gRNA sequence
  source 1..20: mol_type = other DNA
tcagattctccccagacgcc

SEQ ID NO: 10 - DNA, 20 bp, synthetic construct
  misc_feature 1..20: note = CRISPR gRNA sequence
  source 1..20: mol_type = other DNA
cagattctccccagacgccg

SEQ ID NO: 11 - DNA, 20 bp, synthetic construct
  misc_feature 1..20: note = CRISPR gRNA sequence
  source 1..20: mol_type = other DNA
ttctccccagacgccgagga

SEQ ID NO: 12 - DNA, 20 bp, synthetic construct
  misc_feature 1..20: note = CRISPR gRNA sequence
  source 1..20: mol_type = other DNA
gacgccgaggatggccgtca

SEQ ID NO: 13 - DNA, 20 bp, synthetic construct
  misc_feature 1..20: note = CRISPR gRNA sequence
  source 1..20: mol_type = other DNA
aaccctcctcctgctactct

SEQ ID NO: 14 - DNA, 20 bp, synthetic construct
  misc_feature 1..20: note = CRISPR gRNA sequence
  source 1..20: mol_type = other DNA
accctcctcctgctactctc

SEQ ID NO: 15 - DNA, 20 bp, synthetic construct
  misc_feature 1..20: note = CRISPR gRNA sequence
  source 1..20: mol_type = other DNA
ccctcctcctgctactctcg

SEQ ID NO: 16 - DNA, 20 bp, synthetic construct
  misc_feature 1..20: note = CRISPR gRNA sequence
  source 1..20: mol_type = other DNA
cctcctcctgctactctcgg

SEQ ID NO: 17 - DNA, 20 bp, synthetic construct
  misc_feature 1..20: note = CRISPR gRNA sequence
  source 1..20: mol_type = other DNA
cctgctactctcgggggccc

SEQ ID NO: 18 - DNA, 20 bp, synthetic construct
  misc_feature 1..20: note = CRISPR gRNA sequence
  source 1..20: mol_type = other DNA
cgggggccctggccctgacc

SEQ ID NO: 19 - DNA, 20 bp, synthetic construct
  misc_feature 1..20: note = CRISPR gRNA sequence
  source 1..20: mol_type = other DNA
ccctggccctgacccagacc

SEQ ID NO: 20 - DNA, 20 bp, synthetic construct
  misc_feature 1..20: note = CRISPR gRNA sequence
  source 1..20: mol_type = other DNA
cctggccctgacccagacct

SEQ ID NO: 21 - DNA, 20 bp, synthetic construct
  misc_feature 1..20: note = CRISPR gRNA sequence
  source 1..20: mol_type = other DNA
ggccctgacccagacctggg

SEQ ID NO: 22 - DNA, 20 bp, synthetic construct
  misc_feature 1..20: note = CRISPR gRNA sequence
  source 1..20: mol_type = other DNA
gccctgacccagacctgggc

SEQ ID NO: 23 - DNA, 20 bp, synthetic construct
  misc_feature 1..20: note = CRISPR gRNA sequence
  source 1..20: mol_type = other DNA
tgacccagacctgggcgggt

SEQ ID NO: 24 - DNA, 20 bp, synthetic construct
  misc_feature 1..20: note = CRISPR gRNA sequence
  source 1..20: mol_type = other DNA
cagacctgggcgggtgagtg

SEQ ID NO: 25 - DNA, 20 bp, synthetic construct
  misc_feature 1..20: note = CRISPR gRNA sequence
  source 1..20: mol_type = other DNA
agacctgggcgggtgagtgc

SEQ ID NO: 26 - DNA, 20 bp, synthetic construct
  misc_feature 1..20: note = CRISPR gRNA sequence
  source 1..20: mol_type = other DNA
gacctgggcgggtgagtgcg

SEQ ID NO: 27 - DNA, 20 bp, synthetic construct
  misc_feature 1..20: note = CRISPR gRNA sequence
  source 1..20: mol_type = other DNA
tgggcgggtgagtgcggggt

SEQ ID NO: 28 - DNA, 20 bp, synthetic construct
  misc_feature 1..20: note = CRISPR gRNA sequence
  source 1..20: mol_type = other DNA
gggcgggtgagtgcggggtc

SEQ ID NO: 29 - DNA, 20 bp, synthetic construct
  misc_feature 1..20: note = CRISPR gRNA sequence
  source 1..20: mol_type = other DNA
gcgggtgagtgcggggtcgg

SEQ ID NO: 30 - DNA, 20 bp, synthetic construct
  misc_feature 1..20: note = CRISPR gRNA sequence
  source 1..20: mol_type = other DNA
cgggtgagtgcggggtcggg

SEQ ID NO: 31 - DNA, 20 bp, synthetic construct
  misc_feature 1..20: note = CRISPR gRNA sequence
  source 1..20: mol_type = other DNA
gggtgagtgcggggtcggga

SEQ ID NO: 32 - DNA, 20 bp, synthetic construct
  misc_feature 1..20: note = CRISPR gRNA sequence
  source 1..20: mol_type = other DNA
cgggagggaaaccgcctctg

SEQ ID NO: 33 - DNA, 20 bp, synthetic construct
  misc_feature 1..20: note = CRISPR gRNA sequence
  source 1..20: mol_type = other DNA
gggagggaaaccgcctctgc

SEQ ID NO: 34 - DNA, 20 bp, synthetic construct
  misc_feature 1..20: note = CRISPR gRNA sequence
  source 1..20: mol_type = other DNA
ggagggaaaccgcctctgcg

SEQ ID NO: 35 - DNA, 20 bp, synthetic construct
  misc_feature 1..20: note = CRISPR gRNA sequence
  source 1..20: mol_type = other DNA
agggaaaccgcctctgcggg

SEQ ID NO: 36 - DNA, 20 bp, synthetic construct
  misc_feature 1..20: note = CRISPR gRNA sequence
  source 1..20: mol_type = other DNA
gaaaccgcctctgcggggag

SEQ ID NO: 37 - DNA, 20 bp, synthetic construct
  misc_feature 1..20: note = CRISPR gRNA sequence
  source 1..20: mol_type = other DNA
ccgcctctgcggggagaagc

SEQ ID NO: 38 - DNA, 20 bp, synthetic construct
  misc_feature 1..20: note = CRISPR gRNA sequence
  source 1..20: mol_type = other DNA
cgcctctgcggggagaagca

SEQ ID NO: 39 - DNA, 20 bp, synthetic construct
  misc_feature 1..20: note = CRISPR gRNA sequence
  source 1..20: mol_type = other DNA
gcctctgcggggagaagcaa

SEQ ID NO: 40 - DNA, 20 bp, synthetic construct
  misc_feature 1..20: note = CRISPR gRNA sequence
  source 1..20: mol_type = other DNA
cctctgcggggagaagcaag

SEQ ID NO: 41 - DNA, 20 bp, synthetic construct
  misc_feature 1..20: note = CRISPR gRNA sequence
  source 1..20: mol_type = other DNA
ggagaagcaaggggccctcc

SEQ ID NO: 42 - DNA, 20 bp, synthetic construct
  misc_feature 1..20: note = CRISPR gRNA sequence
  source 1..20: mol_type = other DNA
gaagcaaggggccctcctgg

SEQ ID NO: 43 - DNA, 20 bp, synthetic construct
  misc_feature 1..20: note = CRISPR gRNA sequence
  source 1..20: mol_type = other DNA
aagcaaggggccctcctggc

SEQ ID NO: 44 - DNA, 20 bp, synthetic construct
  misc_feature 1..20: note = CRISPR gRNA sequence
  source 1..20: mol_type = other DNA
agcaaggggccctcctggcg

SEQ ID NO: 45 - DNA, 20 bp, synthetic construct
  misc_feature 1..20: note = CRISPR gRNA sequence
  source 1..20: mol_type = other DNA
gcaaggggccctcctggcgg

SEQ ID NO: 46 - DNA, 20 bp, synthetic construct
  misc_feature 1..20: note = CRISPR gRNA sequence
  source 1..20: mol_type = other DNA
gggccctcctggcgggggcg

SEQ ID NO: 47 - DNA, 20 bp, synthetic construct
  misc_feature 1..20: note = CRISPR gRNA sequence
  source 1..20: mol_type = other DNA
ggccctcctggcgggggcgc

SEQ ID NO: 48 - DNA, 20 bp, synthetic construct
  misc_feature 1..20: note = CRISPR gRNA sequence
  source 1..20: mol_type = other DNA
tcctggcgggggcgcaggac

SEQ ID NO: 49 - DNA, 20 bp, synthetic construct
  misc_feature 1..20: note = CRISPR gRNA sequence
  source 1..20: mol_type = other DNA
cctggcgggggcgcaggacc

SEQ ID NO: 50 - DNA, 20 bp, synthetic construct
  misc_feature 1..20: note = CRISPR gRNA sequence
  source 1..20: mol_type = other DNA
ctggcgggggcgcaggaccg

SEQ ID NO: 51 - DNA, 20 bp, synthetic construct
  misc_feature 1..20: note = CRISPR gRNA sequence
  source 1..20: mol_type = other DNA
tggcgggggcgcaggaccgg

SEQ ID NO: 52 - DNA, 20 bp, synthetic construct
  misc_feature 1..20: note = CRISPR gRNA sequence
  source 1..20: mol_type = other DNA
gcgggggcgcaggaccgggg

SEQ ID NO: 53 - DNA, 20 bp, synthetic construct
  misc_feature 1..20: note = CRISPR gRNA sequence
  source 1..20: mol_type = other DNA
caggaccgggggagccgcgc

SEQ ID NO: 54 - DNA, 20 bp, synthetic construct
  misc_feature 1..20: note = CRISPR gRNA sequence
  source 1..20: mol_type = other DNA
aggaccgggggagccgcgcc

SEQ ID NO: 55 - DNA, 20 bp, synthetic construct
  misc_feature 1..20: note = CRISPR gRNA sequence
  source 1..20: mol_type = other DNA
cgggggagccgcgccgggac

SEQ ID NO: 56 - DNA, 20 bp, synthetic construct
  misc_feature 1..20: note = CRISPR gRNA sequence
  source 1..20: mol_type = other DNA
gggggagccgcgccgggacg

SEQ ID NO: 57 - DNA, 20 bp, synthetic construct
  misc_feature 1..20: note = CRISPR gRNA sequence
  source 1..20: mol_type = other DNA
ggggagccgcgccgggacga

SEQ ID NO: 58 - DNA, 20 bp, synthetic construct
  misc_feature 1..20: note = CRISPR gRNA sequence
  source 1..20: mol_type = other DNA
agccgcgccgggacgagggt

SEQ ID NO: 59 - DNA, 20 bp, synthetic construct
  misc_feature 1..20: note = CRISPR gRNA sequence
  source 1..20: mol_type = other DNA
gccgcgccgggacgagggtc

SEQ ID NO: 60 - DNA, 20 bp, synthetic construct
  misc_feature 1..20: note = CRISPR gRNA sequence
  source 1..20: mol_type = other DNA
gcgccgggacgagggtcggg

SEQ ID NO: 61 - DNA, 20 bp, synthetic construct
  misc_feature 1..20: note = CRISPR gRNA sequence
  source 1..20: mol_type = other DNA
cgccgggacgagggtcgggc

SEQ ID NO: 62 - DNA, 20 bp, synthetic construct
  misc_feature 1..20: note = CRISPR gRNA sequence
  source 1..20: mol_type = other DNA
gacgagggtcgggcaggtct

SEQ ID NO: 63 - DNA, 20 bp, synthetic construct
  misc_feature 1..20: note = CRISPR gRNA sequence
  source 1..20: mol_type = other DNA
tctcagccactgctcgcccc

SEQ ID NO: 64 - DNA, 20 bp, synthetic construct
  misc_feature 1..20: note = CRISPR gRNA sequence
  source 1..20: mol_type = other DNA
ctcagccactgctcgccccc

SEQ ID NO: 65 - DNA, 20 bp, synthetic construct
  misc_feature 1..20: note = CRISPR gRNA sequence
  source 1..20: mol_type = other DNA
cccccaggctcccactccat

SEQ ID NO: 66 - DNA, 20 bp, synthetic construct
  misc_feature 1..20: note = CRISPR gRNA sequence
  source 1..20: mol_type = other DNA
ccccaggctcccactccatg

SEQ ID NO: 67 - DNA, 20 bp, synthetic construct
  misc_feature 1..20: note = CRISPR gRNA sequence
  source 1..20: mol_type = other DNA
atttcttcacatccgtgtcc

SEQ ID NO: 68 - DNA, 20 bp, synthetic construct
  misc_feature 1..20: note = CRISPR gRNA sequence
  source 1..20: mol_type = other DNA
ttcacatccgtgtcccggcc

SEQ ID NO: 69 - DNA, 20 bp, synthetic construct
  misc_feature 1..20: note = CRISPR gRNA sequence
  source 1..20: mol_type = other DNA
tccgtgtcccggcccggccg

SEQ ID NO: 70 - DNA, 20 bp, synthetic construct
  misc_feature 1..20: note = CRISPR gRNA sequence
  source 1..20: mol_type = other DNA
ccgtgtcccggcccggccgc

SEQ ID NO: 71 - DNA, 20 bp, synthetic construct
  misc_feature 1..20: note = CRISPR gRNA sequence
  source 1..20: mol_type = other DNA
cgtgtcccggcccggccgcg

SEQ ID NO: 72 - DNA, 20 bp, synthetic construct
  misc_feature 1..20: note = CRISPR gRNA sequence
  source 1..20: mol_type = other DNA
tgtcccggcccggccgcggg

SEQ ID NO: 73 - DNA, 20 bp, synthetic construct
  misc_feature 1..20: note = CRISPR gRNA sequence
  source 1..20: mol_type = other DNA
ggagccccgcttcatcgccg

SEQ ID NO: 74 - DNA, 20 bp, synthetic construct
  misc_feature 1..20: note = CRISPR gRNA sequence
  source 1..20: mol_type = other DNA
gagccccgcttcatcgccgt

SEQ ID NO: 75 - DNA, 20 bp, synthetic construct
  misc_feature 1..20: note = CRISPR gRNA sequence
  source 1..20: mol_type = other DNA
cttcatcgccgtgggctacg

SEQ ID NO: 76 - DNA, 20 bp, synthetic construct
  misc_feature 1..20: note = CRISPR gRNA sequence
  source 1..20: mol_type = other DNA
tgggctacgtggacgacacg

SEQ ID NO: 77 - DNA, 20 bp, synthetic construct
  misc_feature 1..20: note = CRISPR gRNA sequence
  source 1..20: mol_type = other DNA
tggacgacacgcagttcgtg

SEQ ID NO: 78 - DNA, 20 bp, synthetic construct
  misc_feature 1..20: note = CRISPR gRNA sequence
  source 1..20: mol_type = other DNA
acgcagttcgtgcggttcga

SEQ ID NO: 79 - DNA, 20 bp, synthetic construct
  misc_feature 1..20: note = CRISPR gRNA sequence
  source 1..20: mol_type = other DNA
cggttcgacagcgacgccgc

SEQ ID NO: 80 - DNA, 20 bp, synthetic construct
  misc_feature 1..20: note = CRISPR gRNA sequence
  source 1..20: mol_type = other DNA
tcgacagcgacgccgcgagc

SEQ ID NO: 81 - DNA, 20 bp, synthetic construct
  misc_feature 1..20: note = CRISPR gRNA sequence
  source 1..20: mol_type = other DNA
gacagcgacgccgcgagcca

SEQ ID NO: 82 - DNA, 20 bp, synthetic construct
  misc_feature 1..20: note = CRISPR gRNA sequence
  source 1..20: mol_type = other DNA
acagcgacgccgcgagccag

SEQ ID NO: 83 - DNA, 20 bp, synthetic construct
  misc_feature 1..20: note = CRISPR gRNA sequence
  source 1..20: mol_type = other DNA
cgacgccgcgagccagagga

SEQ ID NO: 84 - DNA, 20 bp, synthetic construct
  misc_feature 1..20: note = CRISPR gRNA sequence
  source 1..20: mol_type = other DNA
acgccgcgagccagaggatg

SEQ ID NO: 85 - DNA, 20 bp, synthetic construct
  misc_feature 1..20: note = CRISPR gRNA sequence
  source 1..20: mol_type = other DNA
cgagccagaggatggagccg

SEQ ID NO: 86 - DNA, 20 bp, synthetic construct
  misc_feature 1..20: note = CRISPR gRNA sequence
  source 1..20: mol_type = other DNA
gagccagaggatggagccgc

SEQ ID NO: 87 - DNA, 20 bp, synthetic construct
  misc_feature 1..20: note = CRISPR gRNA sequence
  source 1..20: mol_type = other DNA
ggatggagccgcgggcgccg

SEQ ID NO: 88 - DNA, 20 bp, synthetic construct
  misc_feature 1..20: note = CRISPR gRNA sequence
  source 1..20: mol_type = other DNA
ggagccgcgggcgccgtgga

SEQ ID NO: 89 - DNA, 20 bp, synthetic construct
  misc_feature 1..20: note = CRISPR gRNA sequence
  source 1..20: mol_type = other DNA
agccgcgggcgccgtggata

SEQ ID NO: 90 - DNA, 20 bp, synthetic construct
  misc_feature 1..20: note = CRISPR gRNA sequence
  source 1..20: mol_type = other DNA
cgcgggcgccgtggatagag

SEQ ID NO: 91 - DNA, 20 bp, synthetic construct
  misc_feature 1..20: note = CRISPR gRNA sequence
  source 1..20: mol_type = other DNA
gcgggcgccgtggatagagc

SEQ ID NO: 92 - DNA, 20 bp, synthetic construct
  misc_feature 1..20: note = CRISPR gRNA sequence
  source 1..20: mol_type = other DNA
gggcgccgtggatagagcag

SEQ ID NO: 93 - DNA, 20 bp, synthetic construct
  misc_feature 1..20: note = CRISPR gRNA sequence
  source 1..20: mol_type = other DNA
ggcgccgtggatagagcagg

SEQ ID NO: 94 - DNA, 20 bp, synthetic construct
  misc_feature 1..20: note = CRISPR gRNA sequence
  source 1..20: mol_type = other DNA
gcgccgtggatagagcagga

SEQ ID NO: 95 - DNA, 20 bp, synthetic construct
  misc_feature 1..20: note = CRISPR gRNA sequence
  source 1..20: mol_type = other DNA
cgccgtggatagagcaggag

SEQ ID NO: 96 - DNA, 20 bp, synthetic construct
  misc_feature 1..20: note = CRISPR gRNA sequence
  source 1..20: mol_type = other DNA
gtggatagagcaggaggggc

SEQ ID NO: 97 - DNA, 20 bp, synthetic construct
  misc_feature 1..20: note = CRISPR gRNA sequence
  source 1..20: mol_type = other DNA
ggatagagcaggaggggccg

SEQ ID NO: 98 - DNA, 20 bp, synthetic construct
  misc_feature 1..20: note = CRISPR gRNA sequence
  source 1..20: mol_type = other DNA
agcaggaggggccggagtat

SEQ ID NO: 99 - DNA, 20 bp, synthetic construct
  misc_feature 1..20: note = CRISPR gRNA sequence
  source 1..20: mol_type = other DNA
gcaggaggggccggagtatt

SEQ ID NO: 100 - DNA, 20 bp, synthetic construct
  misc_feature 1..20: note = CRISPR gRNA sequence
  source 1..20: mol_type = other DNA
aggggccggagtattgggac

SEQ ID NO: 101 - DNA, 20 bp, synthetic construct
  misc_feature 1..20: note = CRISPR gRNA sequence
  source 1..20: mol_type = other DNA
ggggccggagtattgggacc

SEQ ID NO: 102 - DNA, 20 bp, synthetic construct
  misc_feature 1..20: note = CRISPR gRNA sequence
  source 1..20: mol_type = other DNA
ggccggagtattgggaccag

SEQ ID NO: 103 - DNA, 20 bp, synthetic construct
  misc_feature 1..20: note = CRISPR gRNA sequence
  source 1..20: mol_type = other DNA
agtattgggaccaggagaca

SEQ ID NO: 104 - DNA, 20 bp, synthetic construct
  misc_feature 1..20: note = CRISPR gRNA sequence
  source 1..20: mol_type = other DNA
accaggagacacggaatgtg

SEQ ID NO: 105 - DNA, 20 bp, synthetic construct
  misc_feature 1..20: note = CRISPR gRNA sequence
  source 1..20: mol_type = other DNA
ccaggagacacggaatgtga

SEQ ID NO: 106 - DNA, 20 bp, synthetic construct
  misc_feature 1..20: note = CRISPR gRNA sequence
  source 1..20: mol_type = other DNA
agacacggaatgtgaaggcc

SEQ ID NO: 107 - DNA, 20 bp, synthetic construct
  misc_feature 1..20: note = CRISPR gRNA sequence
  source 1..20: mol_type = other DNA
ggaatgtgaaggcccagtca

SEQ ID NO: 108 - DNA, 20 bp, synthetic construct
  misc_feature 1..20: note = CRISPR gRNA sequence
  source 1..20: mol_type = other DNA
ggcccagtcacagactgacc

SEQ ID NO: 109 - DNA, 20 bp, synthetic construct
  misc_feature 1..20: note = CRISPR gRNA sequence
  source 1..20: mol_type = other DNA
ccagtcacagactgaccgag

SEQ ID NO: 110 - DNA, 20 bp, synthetic construct
  misc_feature 1..20: note = CRISPR gRNA sequence
  source 1..20: mol_type = other DNA
acagactgaccgagtggacc

SEQ ID NO: 111 - DNA, 20 bp, synthetic construct
  misc_feature 1..20: note = CRISPR gRNA sequence
  source 1..20: mol_type = other DNA
cagactgaccgagtggacct

SEQ ID NO: 112 - DNA, 20 bp, synthetic construct
  misc_feature 1..20: note = CRISPR gRNA sequence
  source 1..20: mol_type = other DNA
agactgaccgagtggacctg

SEQ ID NO: 113 - DNA, 20 bp, synthetic construct
  misc_feature 1..20: note = CRISPR gRNA sequence
  source 1..20: mol_type = other DNA
gtggacctggggaccctgcg

SEQ ID NO: 114 - DNA, 20 bp, synthetic construct
  misc_feature 1..20: note = CRISPR gRNA sequence
  source 1..20: mol_type = other DNA
ccctgcgcggctactacaac

SEQ ID NO: 115 - DNA, 20 bp, synthetic construct
  misc_feature 1..20: note = CRISPR gRNA sequence
  source 1..20: mol_type = other DNA
ctgcgcggctactacaacca

SEQ ID NO: 116 - DNA, 20 bp, synthetic construct
  misc_feature 1..20: note = CRISPR gRNA sequence
  source 1..20: mol_type = other DNA
gcggctactacaaccagagc

SEQ ID NO: 117 - DNA, 20 bp, synthetic construct
  misc_feature 1..20: note = CRISPR gRNA sequence
  source 1..20: mol_type = other DNA
cggctactacaaccagagcg

SEQ ID NO: 118 - DNA, 20 bp, synthetic construct
  misc_feature 1..20: note = CRISPR gRNA sequence
  source 1..20: mol_type = other DNA
tactacaaccagagcgaggc

SEQ ID NO: 119 - DNA, 20 bp, synthetic construct
  misc_feature 1..20: note = CRISPR gRNA sequence
  source 1..20: mol_type = other DNA
acaaccagagcgaggccggt

SEQ ID NO: 120 - DNA, 20 bp, synthetic construct
  misc_feature 1..20: note = CRISPR gRNA sequence
  source 1..20: mol_type = other DNA
gcgaggccggtgagtgaccc

SEQ ID NO: 121 - DNA, 20 bp, synthetic construct
  misc_feature 1..20: note = CRISPR gRNA sequence
  source 1..20: mol_type = other DNA
ggccggtgagtgaccccggc

SEQ ID NO: 122 - DNA, 20 bp, synthetic construct
  misc_feature 1..20: note = CRISPR gRNA sequence
  source 1..20: mol_type = other DNA
gccggtgagtgaccccggcc

SEQ ID NO: 123 - DNA, 20 bp, synthetic construct
  misc_feature 1..20: note = CRISPR gRNA sequence
  source 1..20: mol_type = other DNA
ccggtgagtgaccccggccg

SEQ ID NO: 124 - DNA, 20 bp, synthetic construct
  misc_feature 1..20: note = CRISPR gRNA sequence
  source 1..20: mol_type = other DNA
cggtgagtgaccccggccgg

SEQ ID NO: 125 - DNA, 20 bp, synthetic construct
  misc_feature 1..20: note = CRISPR gRNA sequence
  source 1..20: mol_type = other DNA
agtgaccccggccgggggcg

SEQ ID NO: 126 - DNA, 20 bp, synthetic construct
  misc_feature 1..20: note = CRISPR gRNA sequence
  source 1..20: mol_type = other DNA
gtgaccccggccgggggcgc

SEQ ID NO: 127 - DNA, 20 bp, synthetic construct
  misc_feature 1..20: note = CRISPR gRNA sequence
  source 1..20: mol_type = other DNA
ccccggccgggggcgcaggt

SEQ ID NO: 128 - DNA, 20 bp, synthetic construct
  misc_feature 1..20: note = CRISPR gRNA sequence
  source 1..20: mol_type = other DNA
cccggccgggggcgcaggtc

SEQ ID NO: 129 - DNA, 20 bp, synthetic construct
  misc_feature 1..20: note = CRISPR gRNA sequence
  source 1..20: mol_type = other DNA
tcaggacccctcatccccca

SEQ ID NO: 130 - DNA, 20 bp, synthetic construct
  misc_feature 1..20: note = CRISPR gRNA sequence
  source 1..20: mol_type = other DNA
gacccctcatcccccacgga

SEQ ID NO: 131 - DNA, 20 bp, synthetic construct
  misc_feature 1..20: note = CRISPR gRNA sequence
  source 1..20: mol_type = other DNA
acccctcatcccccacggac

SEQ ID NO: 132 - DNA, 20 bp, synthetic construct
  misc_feature 1..20: note = CRISPR gRNA sequence
  source 1..20: mol_type = other DNA
ctcatcccccacggacgggc

SEQ ID NO: 133 - DNA, 20 bp, synthetic construct
  misc_feature 1..20: note = CRISPR gRNA sequence
  source 1..20: mol_type = other DNA
tcatcccccacggacgggcc

SEQ ID NO: 134 - DNA, 20 bp, synthetic construct
  misc_feature 1..20: note = CRISPR gRNA sequence
  source 1..20: mol_type = other DNA
cggacgggccaggtcgccca

SEQ ID NO: 135 - DNA, 20 bp, synthetic construct
  misc_feature 1..20: note = CRISPR gRNA sequence
  source 1..20: mol_type = other DNA
gccaggtcgcccacagtctc

SEQ ID NO: 136 - DNA, 20 bp, synthetic construct
  misc_feature 1..20: note = CRISPR gRNA sequence
  source 1..20: mol_type = other DNA
ccaggtcgcccacagtctcc

SEQ ID NO: 137 - DNA, 20 bp, synthetic construct
  misc_feature 1..20: note = CRISPR gRNA sequence
  source 1..20: mol_type = other DNA
cgcccacagtctccgggtcc

SEQ ID NO: 138 - DNA, 20 bp, synthetic construct
  misc_feature 1..20: note = CRISPR gRNA sequence
  source 1..20: mol_type = other DNA
cgggtccgagatccaccccg

SEQ ID NO: 139 - DNA, 20 bp, synthetic construct
  misc_feature 1..20: note = CRISPR gRNA sequence
  source 1..20: mol_type = other DNA
cgagatccaccccgaagccg

SEQ ID NO: 140 - DNA, 20 bp, synthetic construct
  misc_feature 1..20: note = CRISPR gRNA sequence
  source 1..20: mol_type = other DNA
gagatccaccccgaagccgc

SEQ ID NO: 141 - DNA, 20 bp, synthetic construct
  misc_feature 1..20: note = CRISPR gRNA sequence
  source 1..20: mol_type = other DNA
ccccgaagccgcgggacccc

SEQ ID NO: 142 - DNA, 20 bp, synthetic construct
  misc_feature 1..20: note = CRISPR gRNA sequence
  source 1..20: mol_type = other DNA
ggaccccgagacccttgccc

SEQ ID NO: 143 - DNA, 20 bp, synthetic construct
  misc_feature 1..20: note = CRISPR gRNA sequence
  source 1..20: mol_type = other DNA
gaccccgagacccttgcccc

SEQ ID NO: 144 - DNA, 20 bp, synthetic construct
  misc_feature 1..20: note = CRISPR gRNA sequence
  source 1..20: mol_type = other DNA
ccccgagacccttgccccgg

SEQ ID NO: 145 - DNA, 20 bp, synthetic construct
  misc_feature 1..20: note = CRISPR gRNA sequence
  source 1..20: mol_type = other DNA
ccgagacccttgccccggga

SEQ ID NO: 146 - DNA, 20 bp, synthetic construct
  misc_feature 1..20: note = CRISPR gRNA sequence
  source 1..20: mol_type = other DNA
cgagacccttgccccgggag

SEQ ID NO: 147 - DNA, 20 bp, synthetic construct
  misc_feature 1..20: note = CRISPR gRNA sequence
  source 1..20: mol_type = other DNA
cccttgccccgggagaggcc

SEQ ID NO: 148 - DNA, 20 bp, synthetic construct
  misc_feature 1..20: note = CRISPR gRNA sequence
  source 1..20: mol_type = other DNA
ccttgccccgggagaggccc

SEQ ID NO: 149 - DNA, 20 bp, synthetic construct
  misc_feature 1..20: note = CRISPR gRNA sequence
  source 1..20: mol_type = other DNA
gaggcccaggcgcctttacc

SEQ ID NO: 150 - DNA, 20 bp, synthetic construct
  misc_feature 1..20: note = CRISPR gRNA sequence
  source 1..20: mol_type = other DNA
cctttacccggtttcatttt

SEQ ID NO: 151 - DNA, 20 bp, synthetic construct
  misc_feature 1..20: note = CRISPR gRNA sequence
  source 1..20: mol_type = other DNA
acccggtttcattttcagtt

SEQ ID NO: 152 - DNA, 20 bp, synthetic construct
  misc_feature 1..20: note = CRISPR gRNA sequence
  source 1..20: mol_type = other DNA
cccggtttcattttcagttt

SEQ ID NO: 153 - DNA, 20 bp, synthetic construct
  misc_feature 1..20: note = CRISPR gRNA sequence
  source 1..20: mol_type = other DNA
gtttaggccaaaaatccccc

SEQ ID NO: 154 - DNA, 20 bp, synthetic construct
  misc_feature 1..20: note = CRISPR gRNA sequence
  source 1..20: mol_type = other DNA
tttaggccaaaaatcccccc

SEQ ID NO: 155 - DNA, 20 bp, synthetic construct
  misc_feature 1..20: note = CRISPR gRNA sequence
  source 1..20: mol_type = other DNA
ggccaaaaatccccccgggt

SEQ ID NO: 156 - DNA, 20 bp, synthetic construct
  misc_feature 1..20: note = CRISPR gRNA sequence
  source 1..20: mol_type = other DNA
aaaaatccccccgggttggt

SEQ ID NO: 157 - DNA, 20 bp, synthetic construct
  misc_feature 1..20: note = CRISPR gRNA sequence
  source 1..20: mol_type = other DNA
aaaatccccccgggttggtc

SEQ ID NO: 158 - DNA, 20 bp, synthetic construct
  misc_feature 1..20: note = CRISPR gRNA sequence
  source 1..20: mol_type = other DNA
aaatccccccgggttggtcg

SEQ ID NO: 159 - DNA, 20 bp, synthetic construct
  misc_feature 1..20: note = CRISPR gRNA sequence
  source 1..20: mol_type = other DNA
ccccccgggttggtcggggc

SEQ ID NO: 160 - DNA, 20 bp, synthetic construct
  misc_feature 1..20: note = CRISPR gRNA sequence
  source 1..20: mol_type = other DNA
cccccgggttggtcggggct

SEQ ID NO: 161 - DNA, 20 bp, synthetic construct
  misc_feature 1..20: note = CRISPR gRNA sequence
  source 1..20: mol_type = other DNA
ccgggttggtcggggctggg

SEQ ID NO: 162 - DNA, 20 bp, synthetic construct
  misc_feature 1..20: note = CRISPR gRNA sequence
  source 1..20: mol_type = other DNA
cgggttggtcggggctgggc

SEQ ID NO: 163 - DNA, 20 bp, synthetic construct
  misc_feature 1..20: note = CRISPR gRNA sequence
  source 1..20: mol_type = other DNA
gggttggtcggggctgggcg

SEQ ID NO: 164 - DNA, 20 bp, synthetic construct
  misc_feature 1..20: note = CRISPR gRNA sequence
  source 1..20: mol_type = other DNA
ggtcggggctgggcggggct

SEQ ID NO: 165 - DNA, 20 bp, synthetic construct
  misc_feature 1..20: note = CRISPR gRNA sequence
  source 1..20: mol_type = other DNA
gtcggggctgggcggggctc

SEQ ID NO: 166 - DNA, 20 bp, synthetic construct
  misc_feature 1..20: note = CRISPR gRNA sequence
  source 1..20: mol_type = other DNA
tcggggctgggcggggctcg

SEQ ID NO: 167 - DNA, 20 bp, synthetic construct
  misc_feature 1..20: note = CRISPR gRNA sequence
  source 1..20: mol_type = other DNA
cggggctgggcggggctcgg

SEQ ID NO: 168 - DNA, 20 bp, synthetic construct
  misc_feature 1..20: note = CRISPR gRNA sequence
  source 1..20: mol_type = other DNA
ctgggcggggctcgggggac

SEQ ID NO: 169 - DNA, 20 bp, synthetic construct
  misc_feature 1..20: note = CRISPR gRNA sequence
  source 1..20: mol_type = other DNA
tgggcggggctcgggggact

SEQ ID NO: 170 - DNA, 20 bp, synthetic construct
  misc_feature 1..20: note = CRISPR gRNA sequence
  source 1..20: mol_type = other DNA
tcgggggactgggctgaccg

SEQ ID NO: 171 - DNA, 20 bp, synthetic construct
  misc_feature 1..20: note = CRISPR gRNA sequence
  source 1..20: mol_type = other DNA
cgggggactgggctgaccgc

SEQ ID NO: 172 - DNA, 20 bp, synthetic construct
  misc_feature 1..20: note = CRISPR gRNA sequence
  source 1..20: mol_type = other DNA
gggggactgggctgaccgcg

SEQ ID NO: 173 - DNA, 20 bp, synthetic construct
  misc_feature 1..20: note = CRISPR gRNA sequence
  source 1..20: mol_type = other DNA
gactgggctgaccgcggggt

SEQ ID NO: 174 - DNA, 20 bp, synthetic construct
  misc_feature 1..20: note = CRISPR gRNA sequence
  source 1..20: mol_type = other DNA
actgggctgaccgcggggtc

SEQ ID NO: 175 - DNA, 20 bp, synthetic construct
  misc_feature 1..20: note = CRISPR gRNA sequence
  source 1..20: mol_type = other DNA
ctgggctgaccgcggggtcg

SEQ ID NO: 176 - DNA, 20 bp, synthetic construct
  misc_feature 1..20: note = CRISPR gRNA sequence
  source 1..20: mol_type = other DNA
gctgaccgcggggtcggggc

SEQ ID NO: 177 - DNA, 20 bp, synthetic construct
  misc_feature 1..20: note = CRISPR gRNA sequence
  source 1..20: mol_type = other DNA
ctgaccgcggggtcggggcc

SEQ ID NO: 178 - DNA, 20 bp, synthetic construct
  misc_feature 1..20: note = CRISPR gRNA sequence
  source 1..20: mol_type = other DNA
ggccaggttctcacaccatc

SEQ ID NO: 179 - DNA, 20 bp, synthetic construct
  misc_feature 1..20: note = CRISPR gRNA sequence
  source 1..20: mol_type = other DNA
cacaccatccagataatgta

SEQ ID NO: 180 - DNA, 20 bp, synthetic construct
  misc_feature 1..20: note = CRISPR gRNA sequence
  source 1..20: mol_type = other DNA
gataatgtatggctgcgacg

SEQ ID NO: 181 - DNA, 20 bp, synthetic construct
  misc_feature 1..20: note = CRISPR gRNA sequence
  source 1..20: mol_type = other DNA
ataatgtatggctgcgacgt

SEQ ID NO: 182 - DNA, 20 bp, synthetic construct
  misc_feature 1..20: note = CRISPR gRNA sequence
  source 1..20: mol_type = other DNA
taatgtatggctgcgacgtg

SEQ ID NO: 183 - DNA, 20 bp, synthetic construct
  misc_feature 1..20: note = CRISPR gRNA sequence
  source 1..20: mol_type = other DNA
gtatggctgcgacgtggggt

SEQ ID NO: 184 - DNA, 20 bp, synthetic construct
  misc_feature 1..20: note = CRISPR gRNA sequence
  source 1..20: mol_type = other DNA
ggctgcgacgtggggtcgga

SEQ ID NO: 185 - DNA, 20 bp, synthetic construct
  misc_feature 1..20: note = CRISPR gRNA sequence
  source 1..20: mol_type = other DNA
gctgcgacgtggggtcggac

SEQ ID NO: 186 - DNA, 20 bp, synthetic construct
  misc_feature 1..20: note = CRISPR gRNA sequence
  source 1..20: mol_type = other DNA
tcggacgggcgcttcctccg

SEQ ID NO: 187 - DNA, 20 bp, synthetic construct
  misc_feature 1..20: note = CRISPR gRNA sequence
  source 1..20: mol_type = other DNA
cggacgggcgcttcctccgc

SEQ ID NO: 188 - DNA, 20 bp, synthetic construct
  misc_feature 1..20: note = CRISPR gRNA sequence
  source 1..20: mol_type = other DNA
ggcgcttcctccgcgggtac

SEQ ID NO: 189 - DNA, 20 bp, synthetic construct
  misc_feature 1..20: note = CRISPR gRNA sequence
  source 1..20: mol_type = other DNA
gcttcctccgcgggtaccgg

SEQ ID NO: 190 - DNA, 20 bp, synthetic construct
  misc_feature 1..20: note = CRISPR gRNA sequence
  source 1..20: mol_type = other DNA
cttcctccgcgggtaccggc

SEQ ID NO: 191 - DNA, 20 bp, synthetic construct
  misc_feature 1..20: note = CRISPR gRNA sequence
  source 1..20: mol_type = other DNA
taccggcaggacgcctacga

SEQ ID NO: 192 - DNA, 20 bp, synthetic construct
  misc_feature 1..20: note = CRISPR gRNA sequence
  source 1..20: mol_type = other DNA
ggcaggacgcctacgacggc

SEQ ID NO: 193 - DNA, 20 bp, synthetic construct
  misc_feature 1..20: note = CRISPR gRNA sequence
  source 1..20: mol_type = other DNA
gcaggacgcctacgacggca

SEQ ID NO: 194 - DNA, 20 bp, synthetic construct
  misc_feature 1..20: note = CRISPR gRNA sequence
  source 1..20: mol_type = other DNA
aggattacatcgccctgaac

SEQ ID NO: 195 - DNA, 20 bp, synthetic construct
  misc_feature 1..20: note = CRISPR gRNA sequence
  source 1..20: mol_type = other DNA
ggattacatcgccctgaacg

SEQ ID NO: 196 - DNA, 20 bp, synthetic construct
  misc_feature 1..20: note = CRISPR gRNA sequence
  source 1..20: mol_type = other DNA
tgaacgaggacctgcgctct

SEQ ID NO: 197 - DNA, 20 bp, synthetic construct
  misc_feature 1..20: note = CRISPR gRNA sequence
  source 1..20: mol_type = other DNA
ggacctgcgctcttggaccg

SEQ ID NO: 198 - DNA, 20 bp, synthetic construct
  misc_feature 1..20: note = CRISPR gRNA sequence
  source 1..20: mol_type = other DNA
cctgcgctcttggaccgcgg

SEQ ID NO: 199 - DNA, 20 bp, synthetic construct
  misc_feature 1..20: note = CRISPR gRNA sequence
  source 1..20: mol_type = other DNA
ctcttggaccgcggcggaca

SEQ ID NO: 200 - DNA, 20 bp, synthetic construct
  misc_feature 1..20: note = CRISPR gRNA sequence
  source 1..20: mol_type = other DNA
ttggaccgcggcggacatgg

SEQ ID NO: 201 - DNA, 20 bp, synthetic construct
  misc_feature 1..20: note = CRISPR gRNA sequence
  source 1..20: mol_type = other DNA
ccgcggcggacatggcggct

SEQ ID NO: 202 - DNA, 20 bp, synthetic construct
  misc_feature 1..20: note = CRISPR gRNA sequence
  source 1..20: mol_type = other DNA
acatggcggctcagatcacc

SEQ ID NO: 203 - DNA, 20 bp, synthetic construct
  misc_feature 1..20: note = CRISPR gRNA sequence
  source 1..20: mol_type = other DNA
cggctcagatcaccaagcgc

SEQ ID NO: 204 - DNA, 20 bp, synthetic construct
  misc_feature 1..20: note = CRISPR gRNA sequence
  source 1..20: mol_type = other DNA
ctcagatcaccaagcgcaag

SEQ ID NO: 205 - DNA, 20 bp, synthetic construct
  misc_feature 1..20: note = CRISPR gRNA sequence
  source 1..20: mol_type = other DNA
tcagatcaccaagcgcaagt

SEQ ID NO: 206 - DNA, 20 bp, synthetic construct
  misc_feature 1..20: note = CRISPR gRNA sequence
  source 1..20: mol_type = other DNA
agatcaccaagcgcaagtgg

SEQ ID NO: 207 - DNA, 20 bp, synthetic construct
  misc_feature 1..20: note = CRISPR gRNA sequence
  source 1..20: mol_type = other DNA
gatcaccaagcgcaagtggg

SEQ ID NO: 208 - DNA, 20 bp, synthetic construct
  misc_feature 1..20: note = CRISPR gRNA sequence
  source 1..20: mol_type = other DNA
caccaagcgcaagtgggagg

SEQ ID NO: 209 - DNA, 20 bp, synthetic construct
  misc_feature 1..20: note = CRISPR gRNA sequence
  source 1..20: mol_type = other DNA
gcaagtgggaggcggcccat

SEQ ID NO: 210 - DNA, 20 bp, synthetic construct
  misc_feature 1..20: note = CRISPR gRNA sequence
  source 1..20: mol_type = other DNA
caagtgggaggcggcccatg

SEQ ID NO: 211 - DNA, 20 bp, synthetic construct
  misc_feature 1..20: note = CRISPR gRNA sequence
  source 1..20: mol_type = other DNA
gtgggaggcggcccatgagg

SEQ ID NO: 212 - DNA, 20 bp, synthetic construct
  misc_feature 1..20: note = CRISPR gRNA sequence
  source 1..20: mol_type = other DNA
gggaggcggcccatgaggcg

SEQ ID NO: 213 - DNA, 20 bp, synthetic construct
  misc_feature 1..20: note = CRISPR gRNA sequence
  source 1..20: mol_type = other DNA
aggcggcccatgaggcggag

SEQ ID NO: 214 - DNA, 20 bp, synthetic construct
  misc_feature 1..20: note = CRISPR gRNA sequence
  source 1..20: mol_type = other DNA
gcccatgaggcggagcagtt

SEQ ID NO: 215 - DNA, 20 bp, synthetic construct
  misc_feature 1..20: note = CRISPR gRNA sequence
  source 1..20: mol_type = other DNA
ccatgaggcggagcagttga

SEQ ID NO: 216 - DNA, 20 bp, synthetic construct
  misc_feature 1..20: note = CRISPR gRNA sequence
  source 1..20: mol_type = other DNA
ggagcagttgagagcctacc

SEQ ID NO: 217 - DNA, 20 bp, synthetic construct
  misc_feature 1..20: note = CRISPR gRNA sequence
  source 1..20: mol_type = other DNA
cagttgagagcctacctgga

SEQ ID NO: 218 - DNA, 20 bp, synthetic construct
  misc_feature 1..20: note = CRISPR gRNA sequence
  source 1..20: mol_type = other DNA
ctacctggatggcacgtgcg

SEQ ID NO: 219 - DNA, 20 bp, synthetic construct
  misc_feature 1..20: note = CRISPR gRNA sequence
  source 1..20: mol_type = other DNA
acctggatggcacgtgcgtg

SEQ ID NO: 220 - DNA, 20 bp, synthetic construct
  misc_feature 1..20: note = CRISPR gRNA sequence
  source 1..20: mol_type = other DNA
tggatggcacgtgcgtggag

SEQ ID NO: 221 - DNA, 20 bp, synthetic construct
  misc_feature 1..20: note = CRISPR gRNA sequence
  source 1..20: mol_type = other DNA
acgtgcgtggagtggctccg

SEQ ID NO: 222 - DNA, 20 bp, synthetic construct
  misc_feature 1..20: note = CRISPR gRNA sequence
  source 1..20: mol_type = other DNA
ggagtggctccgcagatacc

SEQ ID NO: 223 - DNA, 20 bp, synthetic construct
  misc_feature 1..20: note = CRISPR gRNA sequence
  source 1..20: mol_type = other DNA
agtggctccgcagatacctg

SEQ ID NO: 224 - DNA, 20 bp, synthetic construct
  misc_feature 1..20: note = CRISPR gRNA sequence
  source 1..20: mol_type = other DNA
ctccgcagatacctggagaa

SEQ ID NO: 225 - DNA, 20 bp, synthetic construct
  misc_feature 1..20: note = CRISPR gRNA sequence
  source 1..20: mol_type = other DNA
tccgcagatacctggagaac

SEQ ID NO: 226 - DNA, 20 bp, synthetic construct
  misc_feature 1..20: note = CRISPR gRNA sequence
  source 1..20: mol_type = other DNA
gcagatacctggagaacggg

SEQ ID NO: 227 - DNA, 20 bp, synthetic construct
  misc_feature 1..20: note = CRISPR gRNA sequence
  source 1..20: mol_type = other DNA
cagatacctggagaacggga

SEQ ID NO: 228 - DNA, 20 bp, synthetic construct
  misc_feature 1..20: note = CRISPR gRNA sequence
  source 1..20: mol_type = other DNA
gatacctggagaacgggaag

SEQ ID NO: 229 - DNA, 20 bp, synthetic construct
  misc_feature 1..20: note = CRISPR gRNA sequence
  source 1..20: mol_type = other DNA
agaacgggaaggagacgctg

SEQ ID NO: 230 - DNA, 20 bp, synthetic construct
  misc_feature 1..20: note = CRISPR gRNA sequence
  source 1..20: mol_type = other DNA
gaaggagacgctgcagcgca

SEQ ID NO: 231 - DNA, 20 bp, synthetic construct
  misc_feature 1..20: note = CRISPR gRNA sequence
  source 1..20: mol_type = other DNA
aaggagacgctgcagcgcac

SEQ ID NO: 232 - DNA, 20 bp, synthetic construct
  misc_feature 1..20: note = CRISPR gRNA sequence
  source 1..20: mol_type = other DNA
acgctgcagcgcacgggtac

SEQ ID NO: 233 - DNA, 20 bp, synthetic construct
  misc_feature 1..20: note = CRISPR gRNA sequence
  source 1..20: mol_type = other DNA
cgctgcagcgcacgggtacc

SEQ ID NO: 234 - DNA, 20 bp, synthetic construct
  misc_feature 1..20: note = CRISPR gRNA sequence
  source 1..20: mol_type = other DNA
gctgcagcgcacgggtacca

SEQ ID NO: 235 - DNA, 20 bp, synthetic construct
  misc_feature 1..20: note = CRISPR gRNA sequence
  source 1..20: mol_type = other DNA
ctgcagcgcacgggtaccag

SEQ ID NO: 236 - DNA, 20 bp, synthetic construct
  misc_feature 1..20: note = CRISPR gRNA sequence
  source 1..20: mol_type = other DNA
cgcacgggtaccaggggcca

SEQ ID NO: 237 - DNA, 20 bp, synthetic construct
  misc_feature 1..20: note = CRISPR gRNA sequence
  source 1..20: mol_type = other DNA
gcacgggtaccaggggccac

SEQ ID NO: 238 - DNA, 20 bp, synthetic construct
  misc_feature 1..20: note = CRISPR gRNA sequence
  source 1..20: mol_type = other DNA
cacgggtaccaggggccacg

SEQ ID NO: 239 - DNA, 20 bp, synthetic construct
  misc_feature 1..20: note = CRISPR gRNA sequence
  source 1..20: mol_type = other DNA
ggcgcctccctgatcgcctg

SEQ ID NO: 240 - DNA, 20 bp, synthetic construct
  misc_feature 1..20: note = CRISPR gRNA sequence
  source 1..20: mol_type = other DNA
ctgatcgcctgtagatctcc

SEQ ID NO: 241 - DNA, 20 bp, synthetic construct
  misc_feature 1..20: note = CRISPR gRNA sequence
  source 1..20: mol_type = other DNA
tgatcgcctgtagatctccc

SEQ ID NO: 242 - DNA, 20 bp, synthetic construct
  misc_feature 1..20: note = CRISPR gRNA sequence
  source 1..20: mol_type = other DNA
cgcctgtagatctcccgggc

SEQ ID NO: 243 - DNA, 20 bp, synthetic construct
  misc_feature 1..20: note = CRISPR gRNA sequence
  source 1..20: mol_type = other DNA
ctcccgggctggcctcccac

SEQ ID NO: 244 - DNA, 20 bp, synthetic construct
  misc_feature 1..20: note = CRISPR gRNA sequence
  source 1..20: mol_type = other DNA
tcccgggctggcctcccaca

SEQ ID NO: 245 - DNA, 20 bp, synthetic construct
  misc_feature 1..20: note = CRISPR gRNA sequence
  source 1..20: mol_type = other DNA
ccgggctggcctcccacaag

SEQ ID NO: 246 - DNA, 20 bp, synthetic construct
  misc_feature 1..20: note = CRISPR gRNA sequence
  source 1..20: mol_type = other DNA
cgggctggcctcccacaagg

SEQ ID NO: 247 - DNA, 20 bp, synthetic construct
  misc_feature 1..20: note = CRISPR gRNA sequence
  source 1..20: mol_type = other DNA
gggctggcctcccacaagga

SEQ ID NO: 248 - DNA, 20 bp, synthetic construct
  misc_feature 1..20: note = CRISPR gRNA sequence
  source 1..20: mol_type = other DNA
ggctggcctcccacaaggag

SEQ ID NO: 249 - DNA, 20 bp, synthetic construct
  misc_feature 1..20: note = CRISPR gRNA sequence
  source 1..20: mol_type = other DNA
ctggcctcccacaaggaggg

SEQ ID NO: 250 - DNA, 20 bp, synthetic construct
  misc_feature 1..20: note = CRISPR gRNA sequence
  source 1..20: mol_type = other DNA
ccacaaggaggggagacaat

SEQ ID NO: 251 - DNA, 20 bp, synthetic construct
  misc_feature 1..20: note = CRISPR gRNA sequence
  source 1..20: mol_type = other DNA
cacaaggaggggagacaatt

SEQ ID NO: 252 - DNA, 20 bp, synthetic construct
  misc_feature 1..20: note = CRISPR gRNA sequence
  source 1..20: mol_type = other DNA
gagacaattgggaccaacac

SEQ ID NO: 253 - DNA, 20 bp, synthetic construct
  misc_feature 1..20: note = CRISPR gRNA sequence
  source 1..20: mol_type = other DNA
ctagaatatcaccctccctc

SEQ ID NO: 254 - DNA, 20 bp, synthetic construct
  misc_feature 1..20: note = CRISPR gRNA sequence
  source 1..20: mol_type = other DNA
atcaccctccctctggtcct

SEQ ID NO: 255 - DNA, 20 bp, synthetic construct
  misc_feature 1..20: note = CRISPR gRNA sequence
  source 1..20: mol_type = other DNA
tcaccctccctctggtcctg

SEQ ID NO: 256 - DNA, 20 bp, synthetic construct
  misc_feature 1..20: note = CRISPR gRNA sequence
  source 1..20: mol_type = other DNA
caccctccctctggtcctga

SEQ ID NO: 257 - DNA, 20 bp, synthetic construct
  misc_feature 1..20: note = CRISPR gRNA sequence
  source 1..20: mol_type = other DNA
ccctccctctggtcctgagg

SEQ ID NO: 258 - DNA, 20 bp, synthetic construct
  misc_feature 1..20: note = CRISPR gRNA sequence
  source 1..20: mol_type = other DNA
ctccctctggtcctgaggga

SEQ ID NO: 259 - DNA, 20 bp, synthetic construct
  misc_feature 1..20: note = CRISPR gRNA sequence
  source 1..20: mol_type = other DNA
tccctctggtcctgagggag

SEQ ID NO: 260 - DNA, 20 bp, synthetic construct
  misc_feature 1..20: note = CRISPR gRNA sequence
  source 1..20: mol_type = other DNA
ctgagggagaggaatcctcc

SEQ ID NO: 261 - DNA, 20 bp, synthetic construct
  misc_feature 1..20: note = CRISPR gRNA sequence
  source 1..20: mol_type = other DNA
tgagggagaggaatcctcct

SEQ ID NO: 262 - DNA, 20 bp, synthetic construct
  misc_feature 1..20: note = CRISPR gRNA sequence
  source 1..20: mol_type = other DNA
agaggaatcctcctgggttc

SEQ ID NO: 263 - DNA, 20 bp, synthetic construct
  misc_feature 1..20: note = CRISPR gRNA sequence
  source 1..20: mol_type = other DNA
ctgggttccagatcctgtac

SEQ ID NO: 264 - DNA, 20 bp, synthetic construct
  misc_feature 1..20: note = CRISPR gRNA sequence
  source 1..20: mol_type = other DNA
gggttccagatcctgtacca

SEQ ID NO: 265 - DNA, 20 bp, synthetic construct
  misc_feature 1..20: note = CRISPR gRNA sequence
  source 1..20: mol_type = other DNA
gttccagatcctgtaccaga

SEQ ID NO: 266 - DNA, 20 bp, synthetic construct
  misc_feature 1..20: note = CRISPR gRNA sequence
  source 1..20: mol_type = other DNA
ctgtaccagagagtgactct

SEQ ID NO: 267 - DNA, 20 bp, synthetic construct
  misc_feature 1..20: note = CRISPR gRNA sequence
  source 1..20: mol_type = other DNA
tgtaccagagagtgactctg

SEQ ID NO: 268 - DNA, 20 bp, synthetic construct
  misc_feature 1..20: note = CRISPR gRNA sequence
  source 1..20: mol_type = other DNA
ccctgctctctgacacaatt

SEQ ID NO: 269 - DNA, 20 bp, synthetic construct
  misc_feature 1..20: note = CRISPR gRNA sequence
  source 1..20: mol_type = other DNA
cctgctctctgacacaatta

SEQ ID NO: 270 - DNA, 20 bp, synthetic construct
  misc_feature 1..20: note = CRISPR gRNA sequence
  source 1..20: mol_type = other DNA
ctgctctctgacacaattaa

SEQ ID NO: 271 - DNA, 20 bp, synthetic construct
  misc_feature 1..20: note = CRISPR gRNA sequence
  source 1..20: mol_type = other DNA
attaagggataaaatctctg

SEQ ID NO: 272 - DNA, 20 bp, synthetic construct
  misc_feature 1..20: note = CRISPR gRNA sequence
  source 1..20: mol_type = other DNA
ttaagggataaaatctctga

SEQ ID NO: 273 - DNA, 20 bp, synthetic construct
  misc_feature 1..20: note = CRISPR gRNA sequence
  source 1..20: mol_type = other DNA
aagggataaaatctctgaag

SEQ ID NO: 274 - DNA, 20 bp, synthetic construct
  misc_feature 1..20: note = CRISPR gRNA sequence
  source 1..20: mol_type = other DNA
taaaatctctgaaggagtga

SEQ ID NO: 275 - DNA, 20 bp, synthetic construct
  misc_feature 1..20: note = CRISPR gRNA sequence
  source 1..20: mol_type = other DNA
aaaatctctgaaggagtgac

SEQ ID NO: 276 - DNA, 20 bp, synthetic construct
  misc_feature 1..20: note = CRISPR gRNA sequence
  source 1..20: mol_type = other DNA
atctctgaaggagtgacggg

SEQ ID NO: 277 - DNA, 20 bp, synthetic construct
  misc_feature 1..20: note = CRISPR gRNA sequence
  source 1..20: mol_type = other DNA
acgatccctcgaatactgat

SEQ ID NO: 278 - DNA, 20 bp, synthetic construct
  misc_feature 1..20: note = CRISPR gRNA sequence
  source 1..20: mol_type = other DNA
atccctcgaatactgatgag

SEQ ID NO: 279 - DNA, 20 bp, synthetic construct
  misc_feature 1..20: note = CRISPR gRNA sequence
  source 1..20: mol_type = other DNA
tgagtggttccctttgacac

SEQ ID NO: 280 - DNA, 20 bp, synthetic construct
  misc_feature 1..20: note = CRISPR gRNA sequence
  source 1..20: mol_type = other DNA
gtggttccctttgacaccgg

SEQ ID NO: 281 - DNA, 20 bp, synthetic construct
  misc_feature 1..20: note = CRISPR gRNA sequence
  source 1..20: mol_type = other DNA
gttccctttgacaccggcag

SEQ ID NO: 282 - DNA, 20 bp, synthetic construct
  misc_feature 1..20: note = CRISPR gRNA sequence
  source 1..20: mol_type = other DNA
tttgacaccggcagcagcct

SEQ ID NO: 283 - DNA, 20 bp, synthetic construct
  misc_feature 1..20: note = CRISPR gRNA sequence
  source 1..20: mol_type = other DNA
ttgacaccggcagcagcctt

SEQ ID NO: 284 - DNA, 20 bp, synthetic construct
  misc_feature 1..20: note = CRISPR gRNA sequence
  source 1..20: mol_type = other DNA
gggcccgtgacttttcctct

SEQ ID NO: 285 - DNA, 20 bp, synthetic construct
  misc_feature 1..20: note = CRISPR gRNA sequence
  source 1..20: mol_type = other DNA
ggcccgtgacttttcctctc

SEQ ID NO: 286 - DNA, 20 bp, synthetic construct
  misc_feature 1..20: note = CRISPR gRNA sequence
  source 1..20: mol_type = other DNA
tgcttcacactcaatgtgtg

SEQ ID NO: 287 - DNA, 20 bp, synthetic construct
  misc_feature 1..20: note = CRISPR gRNA sequence
  source 1..20: mol_type = other DNA
gcttcacactcaatgtgtgt

SEQ ID NO: 288 - DNA, 20 bp, synthetic construct
  misc_feature 1..20: note = CRISPR gRNA sequence
  source 1..20: mol_type = other DNA
cttcacactcaatgtgtgtg

SEQ ID NO: 289 - DNA, 20 bp, synthetic construct
  misc_feature 1..20: note = CRISPR gRNA sequence
  source 1..20: mol_type = other DNA
ttcacactcaatgtgtgtgg

SEQ ID NO: 290 - DNA, 20 bp, synthetic construct
  misc_feature 1..20: note = CRISPR gRNA sequence
  source 1..20: mol_type = other DNA
ctcaatgtgtgtgggggtct

SEQ ID NO: 291 - DNA, 20 bp, synthetic construct
  misc_feature 1..20: note = CRISPR gRNA sequence
  source 1..20: mol_type = other DNA
tgtgtgtgggggtctgagtc

SEQ ID NO: 292 - DNA, 20 bp, synthetic construct
  misc_feature 1..20: note = CRISPR gRNA sequence
  source 1..20: mol_type = other DNA
ggtctgagtccagcacttct

SEQ ID NO: 293 - DNA, 20 bp, synthetic construct
  misc_feature 1..20: note = CRISPR gRNA sequence
  source 1..20: mol_type = other DNA
tccagcacttctgagtccct

SEQ ID NO: 294 - DNA, 20 bp, synthetic construct
  misc_feature 1..20: note = CRISPR gRNA sequence
  source 1..20: mol_type = other DNA
tgagtccctcagcctccact

SEQ ID NO: 295 - DNA, 20 bp, synthetic construct
  misc_feature 1..20: note = CRISPR gRNA sequence
  source 1..20: mol_type = other DNA
gagtccctcagcctccactc

SEQ ID NO: 296 - DNA, 20 bp, synthetic construct
  misc_feature 1..20: note = CRISPR gRNA sequence
  source 1..20: mol_type = other DNA
ccctcagcctccactcaggt

SEQ ID NO: 297 - DNA, 20 bp, synthetic construct
  misc_feature 1..20: note = CRISPR gRNA sequence
  source 1..20: mol_type = other DNA
cctcagcctccactcaggtc

SEQ ID NO: 298 - DNA, 20 bp, synthetic construct
  misc_feature 1..20: note = CRISPR gRNA sequence
  source 1..20: mol_type = other DNA
gcctccactcaggtcaggac

SEQ ID NO: 299 - DNA, 20 bp, synthetic construct
  misc_feature 1..20: note = CRISPR gRNA sequence
  source 1..20: mol_type = other DNA
tccactcaggtcaggaccag

SEQ ID NO: 300 - DNA, 20 bp, synthetic construct
  misc_feature 1..20: note = CRISPR gRNA sequence
  source 1..20: mol_type = other DNA
agaagtcgctgttcccttct

SEQ ID NO: 301 - DNA, 20 bp, synthetic construct
  misc_feature 1..20: note = CRISPR gRNA sequence
  source 1..20: mol_type = other DNA
gaagtcgctgttcccttctc

SEQ ID NO: 302 - DNA, 20 bp, synthetic construct
  misc_feature 1..20: note = CRISPR gRNA sequence
  source 1..20: mol_type = other DNA
aagtcgctgttcccttctca

SEQ ID NO: 303 - DNA, 20 bp, synthetic construct
  misc_feature 1..20: note = CRISPR gRNA sequence
  source 1..20: mol_type = other DNA
gctgttcccttctcagggaa

SEQ ID NO: 304 - DNA, 20 bp, synthetic construct
  misc_feature 1..20: note = CRISPR gRNA sequence
  source 1..20: mol_type = other DNA
gttcccttctcagggaatag

SEQ ID NO: 305 - DNA, 20 bp, synthetic construct
  misc_feature 1..20: note = CRISPR gRNA sequence
  source 1..20: mol_type = other DNA
cagggaatagaagattatcc

SEQ ID NO: 306 - DNA, 20 bp, synthetic construct
  misc_feature 1..20: note = CRISPR gRNA sequence
  source 1..20: mol_type = other DNA
agggaatagaagattatccc

SEQ ID NO: 307 - DNA, 20 bp, synthetic construct
  misc_feature 1..20: note = CRISPR gRNA sequence
  source 1..20: mol_type = other DNA
ttatcccaggtgcctgtgtc

SEQ ID NO: 308 - DNA, 20 bp, synthetic construct
  misc_feature 1..20: note = CRISPR gRNA sequence
  source 1..20: mol_type = other DNA
tatcccaggtgcctgtgtcc

SEQ ID NO: 309 - DNA, 20 bp, synthetic construct
  misc_feature 1..20: note = CRISPR gRNA sequence
  source 1..20: mol_type = other DNA
ccaggtgcctgtgtccaggc

SEQ ID NO: 310 - DNA, 20 bp, synthetic construct
  misc_feature 1..20: note = CRISPR gRNA sequence
  source 1..20: mol_type = other DNA
cctgtgtccaggctggtgtc

SEQ ID NO: 311 - DNA, 20 bp, synthetic construct
  misc_feature 1..20: note = CRISPR gRNA sequence
  source 1..20: mol_type = other DNA
ctgtgtccaggctggtgtct

SEQ ID NO: 312 - DNA, 20 bp, synthetic construct
  misc_feature 1..20: note = CRISPR gRNA sequence
  source 1..20: mol_type = other DNA
ctgtgctctcttccccatcc

SEQ ID NO: 313 - DNA, 20 bp, synthetic construct
  misc_feature 1..20: note = CRISPR gRNA sequence
  source 1..20: mol_type = other DNA
tgtgctctcttccccatccc

SEQ ID NO: 314 - DNA, 20 bp, synthetic construct
  misc_feature 1..20: note = CRISPR gRNA sequence
  source 1..20: mol_type = other DNA
cgggtgtcctgtccattctc

SEQ ID NO: 315 - DNA, 20 bp, synthetic construct
  misc_feature 1..20: note = CRISPR gRNA sequence
  source 1..20: mol_type = other DNA
tgtcctgtccattctcaaga

SEQ ID NO: 316 - DNA, 20 bp, synthetic construct
  misc_feature 1..20: note = CRISPR gRNA sequence
  source 1..20: mol_type = other DNA
caagatggccacatgcgtgc

SEQ ID NO: 317 - DNA, 20 bp, synthetic construct
  misc_feature 1..20: note = CRISPR gRNA sequence
  source 1..20: mol_type = other DNA
gatggccacatgcgtgctgg

SEQ ID NO: 318 - DNA, 20 bp, synthetic construct
  misc_feature 1..20: note = CRISPR gRNA sequence
  source 1..20: mol_type = other DNA
tggccacatgcgtgctggtg

SEQ ID NO: 319 - DNA, 20 bp, synthetic construct
  misc_feature 1..20: note = CRISPR gRNA sequence
  source 1..20: mol_type = other DNA
gctggtggagtgtcccatga

SEQ ID NO: 320 - DNA, 20 bp, synthetic construct
  misc_feature 1..20: note = CRISPR gRNA sequence
  source 1..20: mol_type = other DNA
aattttctgactcttcccgt

SEQ ID NO: 321 - DNA, 20 bp, synthetic construct
  misc_feature 1..20: note = CRISPR gRNA sequence
  source 1..20: mol_type = other DNA
tcttcccgtcagaccccccc

SEQ ID NO: 322 - DNA, 20 bp, synthetic construct
  misc_feature 1..20: note = CRISPR gRNA sequence
  source 1..20: mol_type = other DNA
accaccccatctctgaccat

SEQ ID NO: 323 - DNA, 20 bp, synthetic construct
  misc_feature 1..20: note = CRISPR gRNA sequence
  source 1..20: mol_type = other DNA
ccaccccatctctgaccatg

SEQ ID NO: 324 - DNA, 20 bp, synthetic construct
  misc_feature 1..20: note = CRISPR gRNA sequence
  source 1..20: mol_type = other DNA
tctgaccatgaggccaccct

SEQ ID NO: 325 - DNA, 20 bp, synthetic construct
  misc_feature 1..20: note = CRISPR gRNA sequence
  source 1..20: mol_type = other DNA
ctgaccatgaggccaccctg

SEQ ID NO: 326 - DNA, 20 bp, synthetic construct
  misc_feature 1..20: note = CRISPR gRNA sequence
  source 1..20: mol_type = other DNA
atgaggccaccctgaggtgc

SEQ ID NO: 327 - DNA, 20 bp, synthetic construct
  misc_feature 1..20: note = CRISPR gRNA sequence
  source 1..20: mol_type = other DNA
tgaggccaccctgaggtgct

SEQ ID NO: 328 - DNA, 20 bp, synthetic construct
  misc_feature 1..20: note = CRISPR gRNA sequence
  source 1..20: mol_type = other DNA
caccctgaggtgctgggccc

SEQ ID NO: 329 - DNA, 20 bp, synthetic construct
  misc_feature 1..20: note = CRISPR gRNA sequence
  source 1..20: mol_type = other DNA
accctgaggtgctgggccct

SEQ ID NO: 330 - DNA, 20 bp, synthetic construct
  misc_feature 1..20: note = CRISPR gRNA sequence
  source 1..20: mol_type = other DNA
ggccctgggcttctaccctg

SEQ ID NO: 331 - DNA, 20 bp, synthetic construct
  misc_feature 1..20: note = CRISPR gRNA sequence
  source 1..20: mol_type = other DNA
ccctgggcttctaccctgcg

SEQ ID NO: 332 - DNA, 20 bp, synthetic construct
  misc_feature 1..20: note = CRISPR gRNA sequence
  source 1..20: mol_type = other DNA
ctgcggagatcacactgacc

SEQ ID NO: 333 - DNA, 20 bp, synthetic construct
  misc_feature 1..20: note = CRISPR gRNA sequence
  source 1..20: mol_type = other DNA
cggagatcacactgacctgg

SEQ ID NO: 334 - DNA, 20 bp, synthetic construct
  misc_feature 1..20: note = CRISPR gRNA sequence
  source 1..20: mol_type = other DNA
agatcacactgacctggcag

SEQ ID NO: 335 - DNA, 20 bp, synthetic construct
  misc_feature 1..20: note = CRISPR gRNA sequence
  source 1..20: mol_type = other DNA
gatcacactgacctggcagc

SEQ ID NO: 336 - DNA, 20 bp, synthetic construct
  misc_feature 1..20: note = CRISPR gRNA sequence
  source 1..20: mol_type = other DNA
acactgacctggcagcggga

SEQ ID NO: 337 - DNA, 20 bp, synthetic construct
  misc_feature 1..20: note = CRISPR gRNA sequence
  source 1..20: mol_type = other DNA
cactgacctggcagcgggat

SEQ ID NO: 338 - DNA, 20 bp, synthetic construct
  misc_feature 1..20: note = CRISPR gRNA sequence
  source 1..20: mol_type = other DNA
actgacctggcagcgggatg

SEQ ID NO: 339 - DNA, 20 bp, synthetic construct
  misc_feature 1..20: note = CRISPR gRNA sequence
  source 1..20: mol_type = other DNA
tgacctggcagcgggatggg

SEQ ID NO: 340 - DNA, 20 bp, synthetic construct
  misc_feature 1..20: note = CRISPR gRNA sequence
  source 1..20: mol_type = other DNA
gacctggcagcgggatgggg

SEQ ID NO: 341 - DNA, 20 bp, synthetic construct
  misc_feature 1..20: note = CRISPR gRNA sequence
  source 1..20: mol_type = other DNA
ggcagcgggatggggaggac

SEQ ID NO: 342 - DNA, 20 bp, synthetic construct
  misc_feature 1..20: note = CRISPR gRNA sequence
  source 1..20: mol_type = other DNA
gggatggggaggaccagacc

SEQ ID NO: 343 - DNA, 20 bp, synthetic construct
  misc_feature 1..20: note = CRISPR gRNA sequence
  source 1..20: mol_type = other DNA
ggatggggaggaccagaccc

SEQ ID NO: 344 - DNA, 20 bp, synthetic construct
  misc_feature 1..20: note = CRISPR gRNA sequence
  source 1..20: mol_type = other DNA
ggaggaccagacccaggaca

SEQ ID NO: 345 - DNA, 20 bp, synthetic construct
  misc_feature 1..20: note = CRISPR gRNA sequence
  source 1..20: mol_type = other DNA
aggaccagacccaggacacg

SEQ ID NO: 346 - DNA, 20 bp, synthetic construct
  misc_feature 1..20: note = CRISPR gRNA sequence
  source 1..20: mol_type = other DNA
gacccaggacacggagctcg

SEQ ID NO: 347 - DNA, 20 bp, synthetic construct
  misc_feature 1..20: note = CRISPR gRNA sequence
  source 1..20: mol_type = other DNA
cccaggacacggagctcgtg

SEQ ID NO: 348 - DNA, 20 bp, synthetic construct
  misc_feature 1..20: note = CRISPR gRNA sequence
  source 1..20: mol_type = other DNA
gacacggagctcgtggagac

SEQ ID NO: 349 - DNA, 20 bp, synthetic construct
  misc_feature 1..20: note = CRISPR gRNA sequence
  source 1..20: mol_type = other DNA
acacggagctcgtggagacc

SEQ ID NO: 350 - DNA, 20 bp, synthetic construct
  misc_feature 1..20: note = CRISPR gRNA sequence
  source 1..20: mol_type = other DNA
gctcgtggagaccaggcctg

SEQ ID NO: 351 - DNA, 20 bp, synthetic construct
  misc_feature 1..20: note = CRISPR gRNA sequence
  source 1..20: mol_type = other DNA
ctcgtggagaccaggcctgc

SEQ ID NO: 352 - DNA, 20 bp, synthetic construct
  misc_feature 1..20: note = CRISPR gRNA sequence
  source 1..20: mol_type = other DNA
tcgtggagaccaggcctgca

SEQ ID NO: 353 - DNA, 20 bp, synthetic construct
  misc_feature 1..20: note = CRISPR gRNA sequence
  source 1..20: mol_type = other DNA
cgtggagaccaggcctgcag

SEQ ID NO: 354 - DNA, 20 bp, synthetic construct
  misc_feature 1..20: note = CRISPR gRNA sequence
  source 1..20: mol_type = other DNA
gagaccaggcctgcagggga

SEQ ID NO: 355 - DNA, 20 bp, synthetic construct
  misc_feature 1..20: note = CRISPR gRNA sequence
  source 1..20: mol_type = other DNA
ctgcaggggatggaaccttc

SEQ ID NO: 356 - DNA, 20 bp, synthetic construct
  misc_feature 1..20: note = CRISPR gRNA sequence
  source 1..20: mol_type = other DNA
caggggatggaaccttccag

SEQ ID NO: 357 - DNA, 20 bp, synthetic construct
  misc_feature 1..20: note = CRISPR gRNA sequence
  source 1..20: mol_type = other DNA
gggatggaaccttccagaag

SEQ ID NO: 358 - DNA, 20 bp, synthetic construct
  misc_feature 1..20: note = CRISPR gRNA sequence
  source 1..20: mol_type = other DNA
ggatggaaccttccagaagt

SEQ ID NO: 359 - DNA, 20 bp, synthetic construct
  misc_feature 1..20: note = CRISPR gRNA sequence
  source 1..20: mol_type = other DNA
tggaaccttccagaagtggg

SEQ ID NO: 360 - DNA, 20 bp, synthetic construct
  misc_feature 1..20: note = CRISPR gRNA sequence
  source 1..20: mol_type = other DNA
cttccagaagtgggcggctg

SEQ ID NO: 361 - DNA, 20 bp, synthetic construct
  misc_feature 1..20: note = CRISPR gRNA sequence
  source 1..20: mol_type = other DNA
ccagaagtgggcggctgtgg

SEQ ID NO: 362 - DNA, 20 bp, synthetic construct
  misc_feature 1..20: note = CRISPR gRNA sequence
  source 1..20: mol_type = other DNA
gcggctgtggtggtgccttc

SEQ ID NO: 363 - DNA, 20 bp, synthetic construct
  misc_feature 1..20: note = CRISPR gRNA sequence
  source 1..20: mol_type = other DNA
ggctgtggtggtgccttctg

SEQ ID NO: 364 - DNA, 20 bp, synthetic construct
  misc_feature 1..20: note = CRISPR gRNA sequence
  source 1..20: mol_type = other DNA
ctgtggtggtgccttctgga

SEQ ID NO: 365 - DNA, 20 bp, synthetic construct
  misc_feature 1..20: note = CRISPR gRNA sequence
  source 1..20: mol_type = other DNA
tgtggtggtgccttctggag

SEQ ID NO: 366 - DNA, 20 bp, synthetic construct
  misc_feature 1..20: note = CRISPR gRNA sequence
  source 1..20: mol_type = other DNA
tggtggtgccttctggagag

SEQ ID NO: 367 - DNA, 20 bp, synthetic construct
  misc_feature 1..20: note = CRISPR gRNA sequence
  source 1..20: mol_type = other DNA
tggtgccttctggagaggag

SEQ ID NO: 368 - DNA, 20 bp, synthetic construct
  misc_feature 1..20: note = CRISPR gRNA sequence
  source 1..20: mol_type = other DNA
gtgccttctggagaggagca

SEQ ID NO: 369 - DNA, 20 bp, synthetic construct
  misc_feature 1..20: note = CRISPR gRNA sequence
  source 1..20: mol_type = other DNA
agagatacacctgccatgtg

SEQ ID NO: 370 - DNA, 20 bp, synthetic construct
  misc_feature 1..20: note = CRISPR gRNA sequence
  source 1..20: mol_type = other DNA
acacctgccatgtgcagcat

SEQ ID NO: 371 - DNA, 20 bp, synthetic construct
  misc_feature 1..20: note = CRISPR gRNA sequence
  source 1..20: mol_type = other DNA
cacctgccatgtgcagcatg

SEQ ID NO: 372 - DNA, 20 bp, synthetic construct
  misc_feature 1..20: note = CRISPR gRNA sequence
  source 1..20: mol_type = other DNA
acctgccatgtgcagcatga

SEQ ID NO: 373 - DNA, 20 bp, synthetic construct
  misc_feature 1..20: note = CRISPR gRNA sequence
  source 1..20: mol_type = other DNA
tgcagcatgagggtctgccc

SEQ ID NO: 374 - DNA, 20 bp, synthetic construct
  misc_feature 1..20: note = CRISPR gRNA sequence
  source 1..20: mol_type = other DNA
ctgcccaagcccctcaccct

SEQ ID NO: 375 - DNA, 20 bp, synthetic construct
  misc_feature 1..20: note = CRISPR gRNA sequence
  source 1..20: mol_type = other DNA
ccaagcccctcaccctgaga

SEQ ID NO: 376 - DNA, 20 bp, synthetic construct
  misc_feature 1..20: note = CRISPR gRNA sequence
  source 1..20: mol_type = other DNA
caagcccctcaccctgagat

SEQ ID NO: 377 - DNA, 20 bp, synthetic construct
  misc_feature 1..20: note = CRISPR gRNA sequence
  source 1..20: mol_type = other DNA
aagcccctcaccctgagatg

SEQ ID NO: 378 - DNA, 20 bp, synthetic construct
  misc_feature 1..20: note = CRISPR gRNA sequence
  source 1..20: mol_type = other DNA
ccctcaccctgagatggggt

SEQ ID NO: 379 - DNA, 20 bp, synthetic construct
  misc_feature 1..20: note = CRISPR gRNA sequence
  source 1..20: mol_type = other DNA
cctcaccctgagatggggta

SEQ ID NO: 380 - DNA, 20 bp, synthetic construct
  misc_feature 1..20: note = CRISPR gRNA sequence
  source 1..20: mol_type = other DNA
tcaccctgagatggggtaag

SEQ ID NO: 381 - DNA, 20 bp, synthetic construct
  misc_feature 1..20: note = CRISPR gRNA sequence
  source 1..20: mol_type = other DNA
caccctgagatggggtaagg

SEQ ID NO: 382 - DNA, 20 bp, synthetic construct
  misc_feature 1..20: note = CRISPR gRNA sequence
  source 1..20: mol_type = other DNA
accctgagatggggtaagga

SEQ ID NO: 383 - DNA, 20 bp, synthetic construct
  misc_feature 1..20: note = CRISPR gRNA sequence
  source 1..20: mol_type = other DNA
cctgagatggggtaaggagg

SEQ ID NO: 384 - DNA, 20 bp, synthetic construct
  misc_feature 1..20: note = CRISPR gRNA sequence
  source 1..20: mol_type = other DNA
agatggggtaaggagggaga

SEQ ID NO: 385 - DNA, 20 bp, synthetic construct
  misc_feature 1..20: note = CRISPR gRNA sequence
  source 1..20: mol_type = other DNA
gatggggtaaggagggagat

SEQ ID NO: 386 - DNA, 20 bp, synthetic construct
  misc_feature 1..20: note = CRISPR gRNA sequence
  source 1..20: mol_type = other DNA
atggggtaaggagggagatg

SEQ ID NO: 387 - DNA, 20 bp, synthetic construct
  misc_feature 1..20: note = CRISPR gRNA sequence
  source 1..20: mol_type = other DNA
tggggtaaggagggagatgg

SEQ ID NO: 388 - DNA, 20 bp, synthetic construct
  misc_feature 1..20: note = CRISPR gRNA sequence
  source 1..20: mol_type = other DNA
gatgggggtgtcatgtctct

SEQ ID NO: 389 - DNA, 20 bp, synthetic construct
  misc_feature 1..20: note = CRISPR gRNA sequence
  source 1..20: mol_type = other DNA
atgggggtgtcatgtctctt

SEQ ID NO: 390 - DNA, 20 bp, synthetic construct
  misc_feature 1..20: note = CRISPR gRNA sequence
  source 1..20: mol_type = other DNA
tgggggtgtcatgtctctta

SEQ ID NO: 391 - DNA, 20 bp, synthetic construct
  misc_feature 1..20: note = CRISPR gRNA sequence
  source 1..20: mol_type = other DNA
ggtgtcatgtctcttaggga

SEQ ID NO: 392 - DNA, 20 bp, synthetic construct
  misc_feature 1..20: note = CRISPR gRNA sequence
  source 1..20: mol_type = other DNA
gtcatgtctcttagggaaag

SEQ ID NO: 393 - DNA, 20 bp, synthetic construct
  misc_feature 1..20: note = CRISPR gRNA sequence
  source 1..20: mol_type = other DNA
tcatgtctcttagggaaagc

SEQ ID NO: 394 - DNA, 20 bp, synthetic construct
  misc_feature 1..20: note = CRISPR gRNA sequence
  source 1..20: mol_type = other DNA
atgtctcttagggaaagcag

SEQ ID NO: 395 - DNA, 20 bp, synthetic construct
  misc_feature 1..20: note = CRISPR gRNA sequence
  source 1..20: mol_type = other DNA
agggaaagcaggagcctctc

SEQ ID NO: 396 - DNA, 20 bp, synthetic construct
  misc_feature 1..20: note = CRISPR gRNA sequence
  source 1..20: mol_type = other DNA
ggaaagcaggagcctctctg

SEQ ID NO: 397 - DNA, 20 bp, synthetic construct
  misc_feature 1..20: note = CRISPR gRNA sequence
  source 1..20: mol_type = other DNA
ggagcctctctggagacctt

SEQ ID NO: 398 - DNA, 20 bp, synthetic construct
  misc_feature 1..20: note = CRISPR gRNA sequence
  source 1..20: mol_type = other DNA
gcctctctggagacctttag

SEQ ID NO: 399 - DNA, 20 bp, synthetic construct
  misc_feature 1..20: note = CRISPR gRNA sequence
  source 1..20: mol_type = other DNA
cctctctggagacctttagc

SEQ ID NO: 400 - DNA, 20 bp, synthetic construct
  misc_feature 1..20: note = CRISPR gRNA sequence
  source 1..20: mol_type = other DNA
ctctctggagacctttagca

SEQ ID NO: 401 - DNA, 20 bp, synthetic construct
  misc_feature 1..20: note = CRISPR gRNA sequence
  source 1..20: mol_type = other DNA
ctggagacctttagcagggt

SEQ ID NO: 402 - DNA, 20 bp, synthetic construct
  misc_feature 1..20: note = CRISPR gRNA sequence
  source 1..20: mol_type = other DNA
tggagacctttagcagggtc

SEQ ID NO: 403 - DNA, 20 bp, synthetic construct
  misc_feature 1..20: note = CRISPR gRNA sequence
  source 1..20: mol_type = other DNA
ggagacctttagcagggtca

SEQ ID NO: 404 - DNA, 20 bp, synthetic construct
  misc_feature 1..20: note = CRISPR gRNA sequence
  source 1..20: mol_type = other DNA
ctcaccttcccctcttttcc

SEQ ID NO: 405 - DNA, 20 bp, synthetic construct
  misc_feature 1..20: note = CRISPR gRNA sequence
  source 1..20: mol_type = other DNA
caccttcccctcttttccca

SEQ ID NO: 406 - DNA, 20 bp, synthetic construct
  misc_feature 1..20: note = CRISPR gRNA sequence
  source 1..20: mol_type = other DNA
ttttcccagagctgtcttcc

SEQ ID NO: 407 - DNA, 20 bp, synthetic construct
  misc_feature 1..20: note = CRISPR gRNA sequence
  source 1..20: mol_type = other DNA
ccagcccaccatccccatcg

SEQ ID NO: 408 - DNA, 20 bp, synthetic construct
  misc_feature 1..20: note = CRISPR gRNA sequence
  source 1..20: mol_type = other DNA
cagcccaccatccccatcgt

SEQ ID NO: 409 - DNA, 20 bp, synthetic construct
  misc_feature 1..20: note = CRISPR gRNA sequence
  source 1..20: mol_type = other DNA
cccatcgtgggcatcattgc

SEQ ID NO: 410 - DNA, 20 bp, synthetic construct
  misc_feature 1..20: note = CRISPR gRNA sequence
  source 1..20: mol_type = other DNA
cgtgggcatcattgctggcc

SEQ ID NO: 411 - DNA, 20 bp, synthetic construct
  misc_feature 1..20: note = CRISPR gRNA sequence
  source 1..20: mol_type = other DNA
attgctggcctggttctcct

SEQ ID NO: 412 - DNA, 20 bp, synthetic construct
  misc_feature 1..20: note = CRISPR gRNA sequence
  source 1..20: mol_type = other DNA
tgctggcctggttctccttg

SEQ ID NO: 413 - DNA, 20 bp, synthetic construct
  misc_feature 1..20: note = CRISPR gRNA sequence
  source 1..20: mol_type = other DNA
ctccttggagctgtgatcac

SEQ ID NO: 414 - DNA, 20 bp, synthetic construct
  misc_feature 1..20: note = CRISPR gRNA sequence
  source 1..20: mol_type = other DNA
ccttggagctgtgatcactg

SEQ ID NO: 415 - DNA, 20 bp, synthetic construct
  misc_feature 1..20: note = CRISPR gRNA sequence
  source 1..20: mol_type = other DNA
agctgtgatcactggagctg

SEQ ID NO: 416 - DNA, 20 bp, synthetic construct
  misc_feature 1..20: note = CRISPR gRNA sequence
  source 1..20: mol_type = other DNA
ctgtggtcgctgccgtgatg

SEQ ID NO: 417 - DNA, 20 bp, synthetic construct
  misc_feature 1..20: note = CRISPR gRNA sequence
  source 1..20: mol_type = other DNA
gtggtcgctgccgtgatgtg

SEQ ID NO: 418 - DNA, 20 bp, synthetic construct
  misc_feature 1..20: note = CRISPR gRNA sequence
  source 1..20: mol_type = other DNA
tggtcgctgccgtgatgtgg

SEQ ID NO: 419 - DNA, 20 bp, synthetic construct
  misc_feature 1..20: note = CRISPR gRNA sequence
  source 1..20: mol_type = other DNA
gtcgctgccgtgatgtggag

SEQ ID NO: 420 - DNA, 20 bp, synthetic construct
  misc_feature 1..20: note = CRISPR gRNA sequence
  source 1..20: mol_type = other DNA
tcgctgccgtgatgtggagg

SEQ ID NO: 421 - DNA, 20 bp, synthetic construct
  misc_feature 1..20: note = CRISPR gRNA sequence
  source 1..20: mol_type = other DNA
ctgccgtgatgtggaggagg

SEQ ID NO: 422 - DNA, 20 bp, synthetic construct
  misc_feature 1..20: note = CRISPR gRNA sequence
  source 1..20: mol_type = other DNA
gccgtgatgtggaggaggaa

SEQ ID NO: 423 - DNA, 20 bp, synthetic construct
  misc_feature 1..20: note = CRISPR gRNA sequence
  source 1..20: mol_type = other DNA
gatgtggaggaggaagagct

SEQ ID NO: 424 - DNA, 20 bp, synthetic construct
  misc_feature 1..20: note = CRISPR gRNA sequence
  source 1..20: mol_type = other DNA
atgtggaggaggaagagctc

SEQ ID NO: 425 - DNA, 20 bp, synthetic construct
  misc_feature 1..20: note = CRISPR gRNA sequence
  source 1..20: mol_type = other DNA
tggaggaggaagagctcagg

SEQ ID NO: 426 - DNA, 20 bp, synthetic construct
  misc_feature 1..20: note = CRISPR gRNA sequence
  source 1..20: mol_type = other DNA
gaggaggaagagctcaggtg

SEQ ID NO: 427 - DNA, 20 bp, synthetic construct
  misc_feature 1..20: note = CRISPR gRNA sequence
  source 1..20: mol_type = other DNA
gaggaagagctcaggtggag

SEQ ID NO: 428 - DNA, 20 bp, synthetic construct
  misc_feature 1..20: note = CRISPR gRNA sequence
  source 1..20: mol_type = other DNA
aggaagagctcaggtggaga

SEQ ID NO: 429 - DNA, 20 bp, synthetic construct
  misc_feature 1..20: note = CRISPR gRNA sequence
  source 1..20: mol_type = other DNA
ggaagagctcaggtggagaa

SEQ ID NO: 430 - DNA, 20 bp, synthetic construct
  misc_feature 1..20: note = CRISPR gRNA sequence
  source 1..20: mol_type = other DNA
gaagagctcaggtggagaag

SEQ ID NO: 431 - DNA, 20 bp, synthetic construct
  misc_feature 1..20: note = CRISPR gRNA sequence
  source 1..20: mol_type = other DNA
gctcaggtggagaaggggtg

SEQ ID NO: 432 - DNA, 20 bp, synthetic construct
  misc_feature 1..20: note = CRISPR gRNA sequence
  source 1..20: mol_type = other DNA
ctcaggtggagaaggggtga

SEQ ID NO: 433 - DNA, 20 bp, synthetic construct
  misc_feature 1..20: note = CRISPR gRNA sequence
  source 1..20: mol_type = other DNA
tcaggtggagaaggggtgaa

SEQ ID NO: 434 - DNA, 20 bp, synthetic construct
  misc_feature 1..20: note = CRISPR gRNA sequence
  source 1..20: mol_type = other DNA
ggtggagaaggggtgaaggg

SEQ ID NO: 435 - DNA, 20 bp, synthetic construct
  misc_feature 1..20: note = CRISPR gRNA sequence
  source 1..20: mol_type = other DNA
gtggagaaggggtgaagggt

SEQ ID NO: 436 - DNA, 20 bp, synthetic construct
  misc_feature 1..20: note = CRISPR gRNA sequence
  source 1..20: mol_type = other DNA
tggagaaggggtgaagggtg

SEQ ID NO: 437 - DNA, 20 bp, synthetic construct
  misc_feature 1..20: note = CRISPR gRNA sequence
  source 1..20: mol_type = other DNA
aggggtgaagggtggggtct

SEQ ID NO: 438 - DNA, 20 bp, synthetic construct
  misc_feature 1..20: note = CRISPR gRNA sequence
  source 1..20: mol_type = other DNA
ctgagatttcttgtctcact

SEQ ID NO: 439 - DNA, 20 bp, synthetic construct
  misc_feature 1..20: note = CRISPR gRNA sequence
  source 1..20: mol_type = other DNA
tgagatttcttgtctcactg

SEQ ID NO: 440 - DNA, 20 bp, synthetic construct
  misc_feature 1..20: note = CRISPR gRNA sequence
  source 1..20: mol_type = other DNA
gagatttcttgtctcactga

SEQ ID NO: 441 - DNA, 20 bp, synthetic construct
  misc_feature 1..20: note = CRISPR gRNA sequence
  source 1..20: mol_type = other DNA
cttgtctcactgagggttcc

SEQ ID NO: 442 - DNA, 20 bp, synthetic construct
  misc_feature 1..20: note = CRISPR gRNA sequence
  source 1..20: mol_type = other DNA
tcactgagggttccaagccc

SEQ ID NO: 443 - DNA, 20 bp, synthetic construct
  misc_feature 1..20: note = CRISPR gRNA sequence
  source 1..20: mol_type = other DNA
tgagggttccaagccccagc

SEQ ID NO: 444 - DNA, 20 bp, synthetic construct
  misc_feature 1..20: note = CRISPR gRNA sequence
  source 1..20: mol_type = other DNA
aatgtgccctgtctcattac

SEQ ID NO: 445 - DNA, 20 bp, synthetic construct
  misc_feature 1..20: note = CRISPR gRNA sequence
  source 1..20: mol_type = other DNA
atgtgccctgtctcattact

SEQ ID NO: 446 - DNA, 20 bp, synthetic construct
  misc_feature 1..20: note = CRISPR gRNA sequence
  source 1..20: mol_type = other DNA
tgccctgtctcattactggg

SEQ ID NO: 447 - DNA, 20 bp, synthetic construct
  misc_feature 1..20: note = CRISPR gRNA sequence
  source 1..20: mol_type = other DNA
ggtgcttcccagtaatgaga

SEQ ID NO: 448 - DNA, 20 bp, synthetic construct
  misc_feature 1..20: note = CRISPR gRNA sequence
  source 1..20: mol_type = other DNA
gtgcttcccagtaatgagac

SEQ ID NO: 449 - DNA, 20 bp, synthetic construct
  misc_feature 1..20: note = CRISPR gRNA sequence
  source 1..20: mol_type = other DNA
tgcttcccagtaatgagaca

SEQ ID NO: 450 - DNA, 20 bp, synthetic construct
  misc_feature 1..20: note = CRISPR gRNA sequence
  source 1..20: mol_type = other DNA
aatgagacagggcacatttc

SEQ ID NO: 451 - DNA, 20 bp, synthetic construct
  misc_feature 1..20: note = CRISPR gRNA sequence
  source 1..20: mol_type = other DNA
agacagggcacatttctagc

SEQ ID NO: 452 - DNA, 20 bp, synthetic construct
  misc_feature 1..20: note = CRISPR gRNA sequence
  source 1..20: mol_type = other DNA
gacagggcacatttctagct

SEQ ID NO: 453 - DNA, 20 bp, synthetic construct
  misc_feature 1..20: note = CRISPR gRNA sequence
  source 1..20: mol_type = other DNA
acagggcacatttctagctg

SEQ ID NO: 454 - DNA, 20 bp, synthetic construct
  misc_feature 1..20: note = CRISPR gRNA sequence
  source 1..20: mol_type = other DNA
gcacatttctagctggggct

SEQ ID NO: 455 - DNA, 20 bp, synthetic construct
  misc_feature 1..20: note = CRISPR gRNA sequence
  source 1..20: mol_type = other DNA
tagctggggcttggaaccct

SEQ ID NO: 456 - DNA, 20 bp, synthetic construct
  misc_feature 1..20: note = CRISPR gRNA sequence
  source 1..20: mol_type = other DNA
tggggcttggaaccctcagt

SEQ ID NO: 457 - DNA, 20 bp, synthetic construct
  misc_feature 1..20: note = CRISPR gRNA sequence
  source 1..20: mol_type = other DNA
cttggaaccctcagtgagac

SEQ ID NO: 458 - DNA, 20 bp, synthetic construct
  misc_feature 1..20: note = CRISPR gRNA sequence
  source 1..20: mol_type = other DNA
ctcagtgagacaagaaatct

SEQ ID NO: 459 - DNA, 20 bp, synthetic construct
  misc_feature 1..20: note = CRISPR gRNA sequence
  source 1..20: mol_type = other DNA
ccttcaccccttctccacct

SEQ ID NO: 460 - DNA, 20 bp, synthetic construct
  misc_feature 1..20: note = CRISPR gRNA sequence
  source 1..20: mol_type = other DNA
gctcttcctcctccacatca

SEQ ID NO: 461 - DNA, 20 bp, synthetic construct
  misc_feature 1..20: note = CRISPR gRNA sequence
  source 1..20: mol_type = other DNA
cttcctcctccacatcacgg

SEQ ID NO: 462 - DNA, 20 bp, synthetic construct
  misc_feature 1..20: note = CRISPR gRNA sequence
  source 1..20: mol_type = other DNA
ccacatcacggcagcgacca

SEQ ID NO: 463 - DNA, 20 bp, synthetic construct
  misc_feature 1..20: note = CRISPR gRNA sequence
  source 1..20: mol_type = other DNA
cacggcagcgaccacagctc

SEQ ID NO: 464 - DNA, 20 bp, synthetic construct
  misc_feature 1..20: note = CRISPR gRNA sequence
  source 1..20: mol_type = other DNA
gaccacagctccagtgatca

SEQ ID NO: 465 - DNA, 20 bp, synthetic construct
  misc_feature 1..20: note = CRISPR gRNA sequence
  source 1..20: mol_type = other DNA
gctccagtgatcacagctcc

SEQ ID NO: 466 - DNA, 20 bp, synthetic construct
  misc_feature 1..20: note = CRISPR gRNA sequence
  source 1..20: mol_type = other DNA
ctccagtgatcacagctcca

SEQ ID NO: 467 - DNA, 20 bp, synthetic construct
  misc_feature 1..20: note = CRISPR gRNA sequence
  source 1..20: mol_type = other DNA
ccagtgatcacagctccaag

SEQ ID NO: 468 - DNA, 20 bp, synthetic construct
  misc_feature 1..20: note = CRISPR gRNA sequence
  source 1..20: mol_type = other DNA
atcacagctccaaggagaac

SEQ ID NO: 469 - DNA, 20 bp, synthetic construct
  misc_feature 1..20: note = CRISPR gRNA sequence
  source 1..20: mol_type = other DNA
tcacagctccaaggagaacc

SEQ ID NO: 470 - DNA, 20 bp, synthetic construct
  misc_feature 1..20: note = CRISPR gRNA sequence
  source 1..20: mol_type = other DNA
agctccaaggagaaccaggc

SEQ ID NO: 471 - DNA, 20 bp, synthetic construct
  misc_feature 1..20: note = CRISPR gRNA sequence
  source 1..20: mol_type = other DNA
gccagcaatgatgcccacga

SEQ ID NO: 472 - DNA, 20 bp, synthetic construct
  misc_feature 1..20: note = CRISPR gRNA sequence
  source 1..20: mol_type = other DNA
ccagcaatgatgcccacgat

SEQ ID NO: 473 - DNA, 20 bp, synthetic construct
  misc_feature 1..20: note = CRISPR gRNA sequence
  source 1..20: mol_type = other DNA
cagcaatgatgcccacgatg

SEQ ID NO: 474 - DNA, 20 bp, synthetic construct
  misc_feature 1..20: note = CRISPR gRNA sequence
  source 1..20: mol_type = other DNA
aatgatgcccacgatgggga

SEQ ID NO: 475 - DNA, 20 bp, synthetic construct
  misc_feature 1..20: note = CRISPR gRNA sequence
  source 1..20: mol_type = other DNA
gatgcccacgatggggatgg

SEQ ID NO: 476 - DNA, 20 bp, synthetic construct
  misc_feature 1..20: note = CRISPR gRNA sequence
  source 1..20: mol_type = other DNA
atgcccacgatggggatggt

SEQ ID NO: 477 - DNA, 20 bp, synthetic construct
  misc_feature 1..20: note = CRISPR gRNA sequence
  source 1..20: mol_type = other DNA
ccacgatggggatggtgggc

SEQ ID NO: 478 - DNA, 20 bp, synthetic construct
  misc_feature 1..20: note = CRISPR gRNA sequence
  source 1..20: mol_type = other DNA
cacgatggggatggtgggct

SEQ ID NO: 479 - DNA, 20 bp, synthetic construct
  misc_feature 1..20: note = CRISPR gRNA sequence
  source 1..20: mol_type = other DNA
gatggggatggtgggctggg

SEQ ID NO: 480 - DNA, 20 bp, synthetic construct
  misc_feature 1..20: note = CRISPR gRNA sequence
  source 1..20: mol_type = other DNA
gggatggtgggctgggaaga

SEQ ID NO: 481 - DNA, 20 bp, synthetic construct
  misc_feature 1..20: note = CRISPR gRNA sequence
  source 1..20: mol_type = other DNA
gtgggctgggaagacagctc

SEQ ID NO: 482 - DNA, 20 bp, synthetic construct
  misc_feature 1..20: note = CRISPR gRNA sequence
  source 1..20: mol_type = other DNA
tgggctgggaagacagctct

SEQ ID NO: 483 - DNA, 20 bp, synthetic construct
  misc_feature 1..20: note = CRISPR gRNA sequence
  source 1..20: mol_type = other DNA
tgggaagacagctctgggaa

SEQ ID NO: 484 - DNA, 20 bp, synthetic construct
  misc_feature 1..20: note = CRISPR gRNA sequence
  source 1..20: mol_type = other DNA
ggaagacagctctgggaaaa

SEQ ID NO: 485 - DNA, 20 bp, synthetic construct
  misc_feature 1..20: note = CRISPR gRNA sequence
  source 1..20: mol_type = other DNA
gaagacagctctgggaaaag

SEQ ID NO: 486 - DNA, 20 bp, synthetic construct
  misc_feature 1..20: note = CRISPR gRNA sequence
  source 1..20: mol_type = other DNA
aagacagctctgggaaaaga

SEQ ID NO: 487 - DNA, 20 bp, synthetic construct
  misc_feature 1..20: note = CRISPR gRNA sequence
  source 1..20: mol_type = other DNA
agacagctctgggaaaagag

SEQ ID NO: 488 - DNA, 20 bp, synthetic construct
  misc_feature 1..20: note = CRISPR gRNA sequence
  source 1..20: mol_type = other DNA
cagctctgggaaaagagggg

SEQ ID NO: 489 - DNA, 20 bp, synthetic construct
  misc_feature 1..20: note = CRISPR gRNA sequence
  source 1..20: mol_type = other DNA
agctctgggaaaagagggga

SEQ ID NO: 490 - DNA, 20 bp, synthetic construct
  misc_feature 1..20: note = CRISPR gRNA sequence
  source 1..20: mol_type = other DNA
ctgggaaaagaggggaaggt

SEQ ID NO: 491 - DNA, 20 bp, synthetic construct
  misc_feature 1..20: note = CRISPR gRNA sequence
  source 1..20: mol_type = other DNA
tgggaaaagaggggaaggtg

SEQ ID NO: 492 - DNA, 20 bp, synthetic construct
  misc_feature 1..20: note = CRISPR gRNA sequence
  source 1..20: mol_type = other DNA
gggaaaagaggggaaggtga

SEQ ID NO: 493 - DNA, 20 bp, synthetic construct
  misc_feature 1..20: note = CRISPR gRNA sequence
  source 1..20: mol_type = other DNA
ggaaaagaggggaaggtgag

SEQ ID NO: 494 - DNA, 20 bp, synthetic construct
  misc_feature 1..20: note = CRISPR gRNA sequence
  source 1..20: mol_type = other DNA
gaggggccctgaccctgcta

SEQ ID NO: 495 - DNA, 20 bp, synthetic construct
  misc_feature 1..20: note = CRISPR gRNA sequence
  source 1..20: mol_type = other DNA
aggggccctgaccctgctaa

SEQ ID NO: 496 - DNA, 20 bp, synthetic construct
  misc_feature 1..20: note = CRISPR gRNA sequence
  source 1..20: mol_type = other DNA
ctgaccctgctaaaggtctc

SEQ ID NO: 497 - DNA, 20 bp, synthetic construct
  misc_feature 1..20: note = CRISPR gRNA sequence
  source 1..20: mol_type = other DNA
gaccctgctaaaggtctcca

SEQ ID NO: 498 - DNA, 20 bp, synthetic construct
  misc_feature 1..20: note = CRISPR gRNA sequence
  source 1..20: mol_type = other DNA
ccctgctaaaggtctccaga

SEQ ID NO: 499 - DNA, 20 bp, synthetic construct
  misc_feature 1..20: note = CRISPR gRNA sequence
  source 1..20: mol_type = other DNA
cctgctaaaggtctccagag

SEQ ID NO: 500 - DNA, 20 bp, synthetic construct
  misc_feature 1..20: note = CRISPR gRNA sequence
  source 1..20: mol_type = other DNA
gagaggctcctgctttccct

SEQ ID NO: 501 - DNA, 20 bp, synthetic construct
  misc_feature 1..20: note = CRISPR gRNA sequence
  source 1..20: mol_type = other DNA
gaggctcctgctttccctaa

SEQ ID NO: 502 - DNA, 20 bp, synthetic construct
  misc_feature 1..20: note = CRISPR gRNA sequence
  source 1..20: mol_type = other DNA
tctccctccttaccccatct

SEQ ID NO: 503 - DNA, 20 bp, synthetic construct
  misc_feature 1..20: note = CRISPR gRNA sequence
  source 1..20: mol_type = other DNA
ctccctccttaccccatctc

SEQ ID NO: 504 - DNA, 20 bp, synthetic construct
  misc_feature 1..20: note = CRISPR gRNA sequence
  source 1..20: mol_type = other DNA
tccctccttaccccatctca

SEQ ID NO: 505 - DNA, 20 bp, synthetic construct
  misc_feature 1..20: note = CRISPR gRNA sequence
  source 1..20: mol_type = other DNA
tccttaccccatctcagggt

SEQ ID NO: 506 - DNA, 20 bp, synthetic construct
  misc_feature 1..20: note = CRISPR gRNA sequence
  source 1..20: mol_type = other DNA
ccttaccccatctcagggtg

SEQ ID NO: 507 - DNA, 20 bp, synthetic construct
  misc_feature 1..20: note = CRISPR gRNA sequence
  source 1..20: mol_type = other DNA
cttaccccatctcagggtga

SEQ ID NO: 508 - DNA, 20 bp, synthetic construct
  misc_feature 1..20: note = CRISPR gRNA sequence
  source 1..20: mol_type = other DNA
ttaccccatctcagggtgag

SEQ ID NO: 509 - DNA, 20 bp, synthetic construct
  misc_feature 1..20: note = CRISPR gRNA sequence
  source 1..20: mol_type = other DNA
ccatctcagggtgaggggct

SEQ ID NO: 510 - DNA, 20 bp, synthetic construct
  misc_feature 1..20: note = CRISPR gRNA sequence
  source 1..20: mol_type = other DNA
catctcagggtgaggggctt

SEQ ID NO: 511 - DNA, 20 bp, synthetic construct
  misc_feature 1..20: note = CRISPR gRNA sequence
  source 1..20: mol_type = other DNA
ctcagggtgaggggcttggg

SEQ ID NO: 512 - DNA, 20 bp, synthetic construct
  misc_feature 1..20: note = CRISPR gRNA sequence
  source 1..20: mol_type = other DNA
gcagaccctcatgctgcaca

SEQ ID NO: 513 - DNA, 20 bp, synthetic construct
  misc_feature 1..20: note = CRISPR gRNA sequence
  source 1..20: mol_type = other DNA
gaccctcatgctgcacatgg

SEQ ID NO: 514 - DNA, 20 bp, synthetic construct
  misc_feature 1..20: note = CRISPR gRNA sequence
  source 1..20: mol_type = other DNA
accctcatgctgcacatggc

SEQ ID NO: 515 - DNA, 20 bp, synthetic construct
  misc_feature 1..20: note = CRISPR gRNA sequence
  source 1..20: mol_type = other DNA
ggtgtatctctgctcctctc

SEQ ID NO: 516 - DNA, 20 bp, synthetic construct
  misc_feature 1..20: note = CRISPR gRNA sequence
  source 1..20: mol_type = other DNA
gtatctctgctcctctccag

SEQ ID NO: 517 - DNA, 20 bp, synthetic construct
  misc_feature 1..20: note = CRISPR gRNA sequence
  source 1..20: mol_type = other DNA
tatctctgctcctctccaga

SEQ ID NO: 518 - DNA, 20 bp, synthetic construct
  misc_feature 1..20: note = CRISPR gRNA sequence
  source 1..20: mol_type = other DNA
ctctccagaaggcaccacca

SEQ ID NO: 519 - DNA, 20 bp, synthetic construct
  misc_feature 1..20: note = CRISPR gRNA sequence
  source 1..20: mol_type = other DNA
ccaccacagccgcccacttc

SEQ ID NO: 520 - DNA, 20 bp, synthetic construct
  misc_feature 1..20: note = CRISPR gRNA sequence
  source 1..20: mol_type = other DNA
ccacagccgcccacttctgg

SEQ ID NO: 521 - DNA, 20 bp, synthetic construct
  misc_feature 1..20: note = CRISPR gRNA sequence
  source 1..20: mol_type = other DNA
cacagccgcccacttctgga

SEQ ID NO: 522 - DNA, 20 bp, synthetic construct
  misc_feature 1..20: note = CRISPR gRNA sequence
  source 1..20: mol_type = other DNA
ctggaaggttccatcccctg

SEQ ID NO: 523 - DNA, 20 bp, synthetic construct
  misc_feature 1..20: note = CRISPR gRNA sequence
  source 1..20: mol_type = other DNA
tggaaggttccatcccctgc

SEQ ID NO: 524 - DNA, 20 bp, synthetic construct
  misc_feature 1..20: note = CRISPR gRNA sequence
  source 1..20: mol_type = other DNA
ggttccatcccctgcaggcc

SEQ ID NO: 525 - DNA, 20 bp, synthetic construct
  misc_feature 1..20: note = CRISPR gRNA sequence
  source 1..20: mol_type = other DNA
cctgcaggcctggtctccac

SEQ ID NO: 526 - DNA, 20 bp, synthetic construct
  misc_feature 1..20: note = CRISPR gRNA sequence
  source 1..20: mol_type = other DNA
tctccacgagctccgtgtcc

SEQ ID NO: 527 - DNA, 20 bp, synthetic construct
  misc_feature 1..20: note = CRISPR gRNA sequence
  source 1..20: mol_type = other DNA
ctccacgagctccgtgtcct

SEQ ID NO: 528 - DNA, 20 bp, synthetic construct
  misc_feature 1..20: note = CRISPR gRNA sequence
  source 1..20: mol_type = other DNA
cgagctccgtgtcctgggtc

SEQ ID NO: 529 - DNA, 20 bp, synthetic construct
  misc_feature 1..20: note = CRISPR gRNA sequence
  source 1..20: mol_type = other DNA
ggtcctccccatcccgctgc

SEQ ID NO: 530 - DNA, 20 bp, synthetic construct
  misc_feature 1..20: note = CRISPR gRNA sequence
  source 1..20: mol_type = other DNA
gtcctccccatcccgctgcc

SEQ ID NO: 531 - DNA, 20 bp, synthetic construct
  misc_feature 1..20: note = CRISPR gRNA sequence
  source 1..20: mol_type = other DNA
tccccatcccgctgccaggt

SEQ ID NO: 532 - DNA, 20 bp, synthetic construct
  misc_feature 1..20: note = CRISPR gRNA sequence
  source 1..20: mol_type = other DNA
ccaggtcagtgtgatctccg

SEQ ID NO: 533 - DNA, 20 bp, synthetic construct
  misc_feature 1..20: note = CRISPR gRNA sequence
  source 1..20: mol_type = other DNA
caggtcagtgtgatctccgc

SEQ ID NO: 534 - DNA, 20 bp, synthetic construct
  misc_feature 1..20: note = CRISPR gRNA sequence
  source 1..20: mol_type = other DNA
aggtcagtgtgatctccgca

SEQ ID NO: 535 - DNA, 20 bp, synthetic construct
  misc_feature 1..20: note = CRISPR gRNA sequence
  source 1..20: mol_type = other DNA
tcagtgtgatctccgcaggg

SEQ ID NO: 536 - DNA, 20 bp, synthetic construct
  misc_feature 1..20: note = CRISPR gRNA sequence
  source 1..20: mol_type = other DNA
gtgtgatctccgcagggtag

SEQ ID NO: 537 - DNA, 20 bp, synthetic construct
  misc_feature 1..20: note = CRISPR gRNA sequence
  source 1..20: mol_type = other DNA
atctccgcagggtagaagcc

SEQ ID NO: 538 - DNA, 20 bp, synthetic construct
  misc_feature 1..20: note = CRISPR gRNA sequence
  source 1..20: mol_type = other DNA
tctccgcagggtagaagccc

SEQ ID NO: 539 - DNA, 20 bp, synthetic construct
  misc_feature 1..20: note = CRISPR gRNA sequence
  source 1..20: mol_type = other DNA
ctccgcagggtagaagccca

SEQ ID NO: 540 - DNA, 20 bp, synthetic construct
  misc_feature 1..20: note = CRISPR gRNA sequence
  source 1..20: mol_type = other DNA
cagggtagaagcccagggcc

SEQ ID NO: 541 - DNA, 20 bp, synthetic construct
  misc_feature 1..20: note = CRISPR gRNA sequence
  source 1..20: mol_type = other DNA
aagcccagggcccagcacct

SEQ ID NO: 542 - DNA, 20 bp, synthetic construct
  misc_feature 1..20: note = CRISPR gRNA sequence
  source 1..20: mol_type = other DNA
agcccagggcccagcacctc

SEQ ID NO: 543 - DNA, 20 bp, synthetic construct
  misc_feature 1..20: note = CRISPR gRNA sequence
  source 1..20: mol_type = other DNA
gcccagggcccagcacctca

SEQ ID NO: 544 - DNA, 20 bp, synthetic construct
  misc_feature 1..20: note = CRISPR gRNA sequence
  source 1..20: mol_type = other DNA
cagggcccagcacctcaggg

SEQ ID NO: 545 - DNA, 20 bp, synthetic construct
  misc_feature 1..20: note = CRISPR gRNA sequence
  source 1..20: mol_type = other DNA
agcacctcagggtggcctca

SEQ ID NO: 546 - DNA, 20 bp, synthetic construct
  misc_feature 1..20: note = CRISPR gRNA sequence
  source 1..20: mol_type = other DNA
cctcagggtggcctcatggt

SEQ ID NO: 547 - DNA, 20 bp, synthetic construct
  misc_feature 1..20: note = CRISPR gRNA sequence
  source 1..20: mol_type = other DNA
tcagggtggcctcatggtca

SEQ ID NO: 548 - DNA, 20 bp, synthetic construct
  misc_feature 1..20: note = CRISPR gRNA sequence
  source 1..20: mol_type = other DNA
ggtggcctcatggtcagaga

SEQ ID NO: 549 - DNA, 20 bp, synthetic construct
  misc_feature 1..20: note = CRISPR gRNA sequence
  source 1..20: mol_type = other DNA
gtggcctcatggtcagagat

SEQ ID NO: 550 - DNA, 20 bp, synthetic construct
  misc_feature 1..20: note = CRISPR gRNA sequence
  source 1..20: mol_type = other DNA
tggcctcatggtcagagatg

SEQ ID NO: 551 - DNA, 20 bp, synthetic construct
  misc_feature 1..20: note = CRISPR gRNA sequence
  source 1..20: mol_type = other DNA
cctcatggtcagagatgggg

SEQ ID NO: 552 - DNA, 20 bp, synthetic construct
  misc_feature 1..20: note = CRISPR gRNA sequence
  source 1..20: mol_type = other DNA
catggtcagagatggggtgg

SEQ ID NO: 553 - DNA, 20 bp, synthetic construct
  misc_feature 1..20: note = CRISPR gRNA sequence
  source 1..20: mol_type = other DNA
atggtcagagatggggtggt

SEQ ID NO: 554 - DNA, 20 bp, synthetic construct
  misc_feature 1..20: note = CRISPR gRNA sequence
  source 1..20: mol_type = other DNA
gtggtgggtcatatgtgtct

SEQ ID NO: 555 - DNA, 20 bp, synthetic construct
  misc_feature 1..20: note = CRISPR gRNA sequence
  source 1..20: mol_type = other DNA
tggtgggtcatatgtgtctt

SEQ ID NO: 556 - DNA, 20 bp, synthetic construct
  misc_feature 1..20: note = CRISPR gRNA sequence
  source 1..20: mol_type = other DNA
ggtgggtcatatgtgtcttg

SEQ ID NO: 557 - DNA, 20 bp, synthetic construct
  misc_feature 1..20: note = CRISPR gRNA sequence
  source 1..20: mol_type = other DNA
gtgggtcatatgtgtcttgg

SEQ ID NO: 558 - DNA, 20 bp, synthetic construct
  misc_feature 1..20: note = CRISPR gRNA sequence
  source 1..20: mol_type = other DNA
tgggtcatatgtgtcttggg

SEQ ID NO: 559 - DNA, 20 bp, synthetic construct
  misc_feature 1..20: note = CRISPR gRNA sequence
  source 1..20: mol_type = other DNA
gggtcatatgtgtcttgggg

SEQ ID NO: 560 - DNA, 20 bp, synthetic construct
  misc_feature 1..20: note = CRISPR gRNA sequence
  source 1..20: mol_type = other DNA
tgtgtcttgggggggtctga

SEQ ID NO: 561 - DNA, 20 bp, synthetic construct
  misc_feature 1..20: note = CRISPR gRNA sequence
  source 1..20: mol_type = other DNA
gtgtcttgggggggtctgac

SEQ ID NO: 562 - DNA, 20 bp, synthetic construct
  misc_feature 1..20: note = CRISPR gRNA sequence
  source 1..20: mol_type = other DNA
tcttgggggggtctgacggg

SEQ ID NO: 563 - DNA, 20 bp, synthetic construct
  misc_feature 1..20: note = CRISPR gRNA sequence
  source 1..20: mol_type = other DNA
ttgggggggtctgacgggaa

SEQ ID NO: 564 - DNA, 20 bp, synthetic construct
  misc_feature 1..20: note = CRISPR gRNA sequence
  source 1..20: mol_type = other DNA
gggggtctgacgggaagagt

SEQ ID NO: 565 - DNA, 20 bp, synthetic construct
  misc_feature 1..20: note = CRISPR gRNA sequence
  source 1..20: mol_type = other DNA
acgggaagagtcagaaaatt

SEQ ID NO: 566 - DNA, 20 bp, synthetic construct
  misc_feature 1..20: note = CRISPR gRNA sequence
  source 1..20: mol_type = other DNA
cgggaagagtcagaaaattc

SEQ ID NO: 567 - DNA, 20 bp, synthetic construct
  misc_feature 1..20: note = CRISPR gRNA sequence
  source 1..20: mol_type = other DNA
caggcattttgcatctgtca

SEQ ID NO: 568 - DNA, 20 bp, synthetic construct
  misc_feature 1..20: note = CRISPR gRNA sequence
  source 1..20: mol_type = other DNA
aggcattttgcatctgtcat

SEQ ID NO: 569 - DNA, 20 bp, synthetic construct
  misc_feature 1..20: note = CRISPR gRNA sequence
  source 1..20: mol_type = other DNA
tctgtcatgggacactccac

SEQ ID NO: 570 - DNA, 20 bp, synthetic construct
  misc_feature 1..20: note = CRISPR gRNA sequence
  source 1..20: mol_type = other DNA
acactccaccagcacgcatg

SEQ ID NO: 571 - DNA, 20 bp, synthetic construct
  misc_feature 1..20: note = CRISPR gRNA sequence
  source 1..20: mol_type = other DNA
agcacgcatgtggccatctt

SEQ ID NO: 572 - DNA, 20 bp, synthetic construct
  misc_feature 1..20: note = CRISPR gRNA sequence
  source 1..20: mol_type = other DNA
gcatgtggccatcttgagaa

SEQ ID NO: 573 - DNA, 20 bp, synthetic construct
  misc_feature 1..20: note = CRISPR gRNA sequence
  source 1..20: mol_type = other DNA
gtggccatcttgagaatgga

SEQ ID NO: 574 - DNA, 20 bp, synthetic construct
  misc_feature 1..20: note = CRISPR gRNA sequence
  source 1..20: mol_type = other DNA
tggccatcttgagaatggac

SEQ ID NO: 575 - DNA, 20 bp, synthetic construct
  misc_feature 1..20: note = CRISPR gRNA sequence
  source 1..20: mol_type = other DNA
ttgagaatggacaggacacc

SEQ ID NO: 576 - DNA, 20 bp, synthetic construct
  misc_feature 1..20: note = CRISPR gRNA sequence
  source 1..20: mol_type = other DNA
tgagaatggacaggacaccc

SEQ ID NO: 577 - DNA, 20 bp, synthetic construct
  misc_feature 1..20: note = CRISPR gRNA sequence
  source 1..20: mol_type = other DNA
aatggacaggacacccggga

SEQ ID NO: 578 - DNA, 20 bp, synthetic construct
  misc_feature 1..20: note = CRISPR gRNA sequence
  source 1..20: mol_type = other DNA
atggacaggacacccgggat

SEQ ID NO: 579 - DNA, 20 bp, synthetic construct
  misc_feature 1..20: note = CRISPR gRNA sequence
  source 1..20: mol_type = other DNA
tggacaggacacccgggatg

SEQ ID NO: 580 - DNA, 20 bp, synthetic construct
  misc_feature 1..20: note = CRISPR gRNA sequence
  source 1..20: mol_type = other DNA
acaggacacccgggatgggg

SEQ ID NO: 581 - DNA, 20 bp, synthetic construct
  misc_feature 1..20: note = CRISPR gRNA sequence
  source 1..20: mol_type = other DNA
aggacacccgggatggggaa

SEQ ID NO: 582 - DNA, 20 bp, synthetic construct
  misc_feature 1..20: note = CRISPR gRNA sequence
  source 1..20: mol_type = other DNA
gacacccgggatggggaaga

SEQ ID NO: 583 - DNA, 20 bp, synthetic construct
  misc_feature 1..20: note = CRISPR gRNA sequence
  source 1..20: mol_type = other DNA
ccgggatggggaagagagca

SEQ ID NO: 584 - DNA, 20 bp, synthetic construct
  misc_feature 1..20: note = CRISPR gRNA sequence
  source 1..20: mol_type = other DNA
ggggaagagagcacagaacc

SEQ ID NO: 585 - DNA, 20 bp, synthetic construct
  misc_feature 1..20: note = CRISPR gRNA sequence
  source 1..20: mol_type = other DNA
agagcacagaacccagacac

SEQ ID NO: 586 - DNA, 20 bp, synthetic construct
  misc_feature 1..20: note = CRISPR gRNA sequence
  source 1..20: mol_type = other DNA
acagaacccagacaccagcc

SEQ ID NO: 587 - DNA, 20 bp, synthetic construct
  misc_feature 1..20: note = CRISPR gRNA sequence
  source 1..20: mol_type = other DNA
cccagacaccagcctggaca

SEQ ID NO: 588 - DNA, 20 bp, synthetic construct
  misc_feature 1..20: note = CRISPR gRNA sequence
  source 1..20: mol_type = other DNA
ccagacaccagcctggacac

SEQ ID NO: 589 - DNA, 20 bp, synthetic construct
  misc_feature 1..20: note = CRISPR gRNA sequence
  source 1..20: mol_type = other DNA
ccagcctggacacaggcacc

SEQ ID NO: 590 - DNA, 20 bp, synthetic construct
  misc_feature 1..20: note = CRISPR gRNA sequence
  source 1..20: mol_type = other DNA
cagcctggacacaggcacct

SEQ ID NO: 591 - DNA, 20 bp, synthetic construct
  misc_feature 1..20: note = CRISPR gRNA sequence
  source 1..20: mol_type = other DNA
gggataatcttctattccct

SEQ ID NO: 592 - DNA, 20 bp, synthetic construct
  misc_feature 1..20: note = CRISPR gRNA sequence
  source 1..20: mol_type = other DNA
ataatcttctattccctgag

SEQ ID NO: 593 - DNA, 20 bp, synthetic construct
  misc_feature 1..20: note = CRISPR gRNA sequence
  source 1..20: mol_type = other DNA
taatcttctattccctgaga

SEQ ID NO: 594 - DNA, 20 bp, synthetic construct
  misc_feature 1..20: note = CRISPR gRNA sequence
  source 1..20: mol_type = other DNA
aatcttctattccctgagaa

SEQ ID NO: 595 - DNA, 20 bp, synthetic construct
  misc_feature 1..20: note = CRISPR gRNA sequence
  source 1..20: mol_type = other DNA
tctattccctgagaagggaa

SEQ ID NO: 596 - DNA, 20 bp, synthetic construct
  misc_feature 1..20: note = CRISPR gRNA sequence
  source 1..20: mol_type = other DNA
gagaagggaacagcgacttc

SEQ ID NO: 597 - DNA, 20 bp, synthetic construct
  misc_feature 1..20: note = CRISPR gRNA sequence
  source 1..20: mol_type = other DNA
gcgacttctggtcctgacct

SEQ ID NO: 598 - DNA, 20 bp, synthetic construct
  misc_feature 1..20: note = CRISPR gRNA sequence
  source 1..20: mol_type = other DNA
acttctggtcctgacctgag

SEQ ID NO: 599 - DNA, 20 bp, synthetic construct
  misc_feature 1..20: note = CRISPR gRNA sequence
  source 1..20: mol_type = other DNA
ttctggtcctgacctgagtg

SEQ ID NO: 600 - DNA, 20 bp, synthetic construct
  misc_feature 1..20: note = CRISPR gRNA sequence
  source 1..20: mol_type = other DNA
tctggtcctgacctgagtgg

SEQ ID NO: 601 - DNA, 20 bp, synthetic construct
  misc_feature 1..20: note = CRISPR gRNA sequence
  source 1..20: mol_type = other DNA
tcctgacctgagtggaggct

SEQ ID NO: 602 - DNA, 20 bp, synthetic construct
  misc_feature 1..20: note = CRISPR gRNA sequence
  source 1..20: mol_type = other DNA
cctgacctgagtggaggctg

SEQ ID NO: 603 - DNA, 20 bp, synthetic construct
  misc_feature 1..20: note = CRISPR gRNA sequence
  source 1..20: mol_type = other DNA
ctgacctgagtggaggctga

SEQ ID NO: 604 - DNA, 20 bp, synthetic construct
  misc_feature 1..20: note = CRISPR gRNA sequence
  source 1..20: mol_type = other DNA
tgagtggaggctgagggact

SEQ ID NO: 605 - DNA, 20 bp, synthetic construct
  misc_feature 1..20: note = CRISPR gRNA sequence
  source 1..20: mol_type = other DNA
gtggaggctgagggactcag

SEQ ID NO: 606 - DNA, 20 bp, synthetic construct
  misc_feature 1..20: note = CRISPR gRNA sequence
  source 1..20: mol_type = other DNA
gctgagggactcagaagtgc

SEQ ID NO: 607 - DNA, 20 bp, synthetic construct
  misc_feature 1..20: note = CRISPR gRNA sequence
  source 1..20: mol_type = other DNA
ggactcagaagtgctggact

SEQ ID NO: 608 - DNA, 20 bp, synthetic construct
  misc_feature 1..20: note = CRISPR gRNA sequence
  source 1..20: mol_type = other DNA
ctcagacccccacacacatt

SEQ ID NO: 609 - DNA, 20 bp, synthetic construct
  misc_feature 1..20: note = CRISPR gRNA sequence
  source 1..20: mol_type = other DNA
ccccacacacattgagtgtg

SEQ ID NO: 610 - DNA, 20 bp, synthetic construct
  misc_feature 1..20: note = CRISPR gRNA sequence
  source 1..20: mol_type = other DNA
cacacacattgagtgtgaag

SEQ ID NO: 611 - DNA, 20 bp, synthetic construct
  misc_feature 1..20: note = CRISPR gRNA sequence
  source 1..20: mol_type = other DNA
cacacattgagtgtgaagca

SEQ ID NO: 612 - DNA, 20 bp, synthetic construct
  misc_feature 1..20: note = CRISPR gRNA sequence
  source 1..20: mol_type = other DNA
ttgagtgtgaagcagagaac

SEQ ID NO: 613 - DNA, 20 bp, synthetic construct
  misc_feature 1..20: note = CRISPR gRNA sequence
  source 1..20: mol_type = other DNA
tgagtgtgaagcagagaaca

SEQ ID NO: 614 - DNA, 20 bp, synthetic construct
  misc_feature 1..20: note = CRISPR gRNA sequence
  source 1..20: mol_type = other DNA
tgaagcagagaacaaggcct

SEQ ID NO: 615 - DNA, 20 bp, synthetic construct
  misc_feature 1..20: note = CRISPR gRNA sequence
  source 1..20: mol_type = other DNA
aagcagagaacaaggcctga

SEQ ID NO: 616 - DNA, 20 bp, synthetic construct
  misc_feature 1..20: note = CRISPR gRNA sequence
  source 1..20: mol_type = other DNA
agcagagaacaaggcctgag

SEQ ID NO: 617 - DNA, 20 bp, synthetic construct
  misc_feature 1..20: note = CRISPR gRNA sequence
  source 1..20: mol_type = other DNA
agaacaaggcctgagaggaa

SEQ ID NO: 618 - DNA, 20 bp, synthetic construct
  misc_feature 1..20: note = CRISPR gRNA sequence
  source 1..20: mol_type = other DNA
aggcctgagaggaaaagtca

SEQ ID NO: 619 - DNA, 20 bp, synthetic construct
  misc_feature 1..20: note = CRISPR gRNA sequence
  source 1..20: mol_type = other DNA
ggcctgagaggaaaagtcac

SEQ ID NO: 620 - DNA, 20 bp, synthetic construct
  misc_feature 1..20: note = CRISPR gRNA sequence
  source 1..20: mol_type = other DNA
agaggaaaagtcacgggccc

SEQ ID NO: 621 - DNA, 20 bp, synthetic construct
  misc_feature 1..20: note = CRISPR gRNA sequence
  source 1..20: mol_type = other DNA
gaggaaaagtcacgggccca

SEQ ID NO: 622 - DNA, 20 bp, synthetic construct
  misc_feature 1..20: note = CRISPR gRNA sequence
  source 1..20: mol_type = other DNA
cacgggcccaaggctgctgc

SEQ ID NO: 623 - DNA, 20 bp, synthetic construct
  misc_feature 1..20: note = CRISPR gRNA sequence
  source 1..20: mol_type = other DNA
caaggctgctgccggtgtca

SEQ ID NO: 624 - DNA, 20 bp, synthetic construct
  misc_feature 1..20: note = CRISPR gRNA sequence
  source 1..20: mol_type = other DNA
aaggctgctgccggtgtcaa

SEQ ID NO: 625 - DNA, 20 bp, synthetic construct
  misc_feature 1..20: note = CRISPR gRNA sequence
  source 1..20: mol_type = other DNA
aggctgctgccggtgtcaaa

SEQ ID NO: 626 - DNA, 20 bp, synthetic construct
  misc_feature 1..20: note = CRISPR gRNA sequence
  source 1..20: mol_type = other DNA
tgtcaaagggaaccactcat

SEQ ID NO: 627 - DNA, 20 bp, synthetic construct
  misc_feature 1..20: note = CRISPR gRNA sequence
  source 1..20: mol_type = other DNA
ggaaccactcatcagtattc

SEQ ID NO: 628 - DNA, 20 bp, synthetic construct
  misc_feature 1..20: note = CRISPR gRNA sequence
  source 1..20: mol_type = other DNA
gaaccactcatcagtattcg

SEQ ID NO: 629 - DNA, 20 bp, synthetic construct
  misc_feature 1..20: note = CRISPR gRNA sequence
  source 1..20: mol_type = other DNA
aaccactcatcagtattcga

SEQ ID NO: 630 - DNA, 20 bp, synthetic construct
  misc_feature 1..20: note = CRISPR gRNA sequence
  source 1..20: mol_type = other DNA
tcgtcttcccgtcactcctt

SEQ ID NO: 631 - DNA, 20 bp, synthetic construct
  misc_feature 1..20: note = CRISPR gRNA sequence
  source 1..20: mol_type = other DNA
gtcttcccgtcactccttca

SEQ ID NO: 632 - DNA, 20 bp, synthetic construct
  misc_feature 1..20: note = CRISPR gRNA sequence
  source 1..20: mol_type = other DNA
attttatcccttaattgtgt

SEQ ID NO: 633 - DNA, 20 bp, synthetic construct
  misc_feature 1..20: note = CRISPR gRNA sequence
  source 1..20: mol_type = other DNA
tttatcccttaattgtgtca

SEQ ID NO: 634 - DNA, 20 bp, synthetic construct
  misc_feature 1..20: note = CRISPR gRNA sequence
  source 1..20: mol_type = other DNA
tatcccttaattgtgtcaga

SEQ ID NO: 635 - DNA, 20 bp, synthetic construct
  misc_feature 1..20: note = CRISPR gRNA sequence
  source 1..20: mol_type = other DNA
cccttaattgtgtcagagag

SEQ ID NO: 636 - DNA, 20 bp, synthetic construct
  misc_feature 1..20: note = CRISPR gRNA sequence
  source 1..20: mol_type = other DNA
ccttaattgtgtcagagagc

SEQ ID NO: 637 - DNA, 20 bp, synthetic construct
  misc_feature 1..20: note = CRISPR gRNA sequence
  source 1..20: mol_type = other DNA
cttaattgtgtcagagagca

SEQ ID NO: 638 - DNA, 20 bp, synthetic construct
  misc_feature 1..20: note = CRISPR gRNA sequence
  source 1..20: mol_type = other DNA
aattgtgtcagagagcaggg

SEQ ID NO: 639 - DNA, 20 bp, synthetic construct
  misc_feature 1..20: note = CRISPR gRNA sequence
  source 1..20: mol_type = other DNA
cagagagcagggcggaacct

SEQ ID NO: 640 - DNA, 20 bp, synthetic construct
  misc_feature 1..20: note = CRISPR gRNA sequence
  source 1..20: mol_type = other DNA
gagagcagggcggaacctca

SEQ ID NO: 641 - DNA, 20 bp, synthetic construct
  misc_feature 1..20: note = CRISPR gRNA sequence
  source 1..20: mol_type = other DNA
ggaacctcagagtcactctc

SEQ ID NO: 642 - DNA, 20 bp, synthetic construct
  misc_feature 1..20: note = CRISPR gRNA sequence
  source 1..20: mol_type = other DNA
ctcagagtcactctctggta

SEQ ID NO: 643 - DNA, 20 bp, synthetic construct
  misc_feature 1..20: note = CRISPR gRNA sequence
  source 1..20: mol_type = other DNA
tcagagtcactctctggtac

SEQ ID NO: 644 - DNA, 20 bp, synthetic construct
  misc_feature 1..20: note = CRISPR gRNA sequence
  source 1..20: mol_type = other DNA
tcactctctggtacaggatc

SEQ ID NO: 645 - DNA, 20 bp, synthetic construct
  misc_feature 1..20: note = CRISPR gRNA sequence
  source 1..20: mol_type = other DNA
ctggtacaggatctggaacc

SEQ ID NO: 646 - DNA, 20 bp, synthetic construct
  misc_feature 1..20: note = CRISPR gRNA sequence
  source 1..20: mol_type = other DNA
tggtacaggatctggaaccc

SEQ ID NO: 647 - DNA, 20 bp, synthetic construct
  misc_feature 1..20: note = CRISPR gRNA sequence
  source 1..20: mol_type = other DNA
gtacaggatctggaacccag

SEQ ID NO: 648 - DNA, 20 bp, synthetic construct
  misc_feature 1..20: note = CRISPR gRNA sequence
  source 1..20: mol_type = other DNA
tacaggatctggaacccagg

SEQ ID NO: 649 - DNA, 20 bp, synthetic construct
  misc_feature 1..20: note = CRISPR gRNA sequence
  source 1..20: mol_type = other DNA
ccaggaggattcctctccct

SEQ ID NO: 650 - DNA, 20 bp, synthetic construct
  misc_feature 1..20: note = CRISPR gRNA sequence
  source 1..20: mol_type = other DNA
caggaggattcctctccctc

SEQ ID NO: 651 - DNA, 20 bp, synthetic construct
  misc_feature 1..20: note = CRISPR gRNA sequence
  source 1..20: mol_type = other DNA
ggattcctctccctcaggac

SEQ ID NO: 652 - DNA, 20 bp, synthetic construct
  misc_feature 1..20: note = CRISPR gRNA sequence
  source 1..20: mol_type = other DNA
attcctctccctcaggacca

SEQ ID NO: 653 - DNA, 20 bp, synthetic construct
  misc_feature 1..20: note = CRISPR gRNA sequence
  source 1..20: mol_type = other DNA
ttcctctccctcaggaccag

SEQ ID NO: 654 - DNA, 20 bp, synthetic construct
  misc_feature 1..20: note = CRISPR gRNA sequence
  source 1..20: mol_type = other DNA
tcctctccctcaggaccaga

SEQ ID NO: 655 - DNA, 20 bp, synthetic construct
  misc_feature 1..20: note = CRISPR gRNA sequence
  source 1..20: mol_type = other DNA
ctctccctcaggaccagagg

SEQ ID NO: 656 - DNA, 20 bp, synthetic construct
  misc_feature 1..20: note = CRISPR gRNA sequence
  source 1..20: mol_type = other DNA
tctccctcaggaccagaggg

SEQ ID NO: 657 - DNA, 20 bp, synthetic construct
  misc_feature 1..20: note = CRISPR gRNA sequence
  source 1..20: mol_type = other DNA
ctccctcaggaccagaggga

SEQ ID NO: 658 - DNA, 20 bp, synthetic construct
  misc_feature 1..20: note = CRISPR gRNA sequence
  source 1..20: mol_type = other DNA
ccagagggagggtgatattc

SEQ ID NO: 659 - DNA, 20 bp, synthetic construct
  misc_feature 1..20: note = CRISPR gRNA sequence
  source 1..20: mol_type = other DNA
ggagggtgatattctagtgt

SEQ ID NO: 660 - DNA, 20 bp, synthetic construct
  misc_feature 1..20: note = CRISPR gRNA sequence
  source 1..20: mol_type = other DNA
ccaattgtctcccctccttg

SEQ ID NO: 661 - DNA, 20 bp, synthetic construct
  misc_feature 1..20: note = CRISPR gRNA sequence
  source 1..20: mol_type = other DNA
caattgtctcccctccttgt

SEQ ID NO: 662 - DNA, 20 bp, synthetic construct
  misc_feature 1..20: note = CRISPR gRNA sequence
  source 1..20: mol_type = other DNA
attgtctcccctccttgtgg

SEQ ID NO: 663 - DNA, 20 bp, synthetic construct
  misc_feature 1..20: note = CRISPR gRNA sequence
  source 1..20: mol_type = other DNA
ttgtctcccctccttgtggg

SEQ ID NO: 664 - DNA, 20 bp, synthetic construct
  misc_feature 1..20: note = CRISPR gRNA sequence
  source 1..20: mol_type = other DNA
ctcccctccttgtgggaggc

SEQ ID NO: 665 - DNA, 20 bp, synthetic construct
  misc_feature 1..20: note = CRISPR gRNA sequence
  source 1..20: mol_type = other DNA
ctccttgtgggaggccagcc

SEQ ID NO: 666 - DNA, 20 bp, synthetic construct
  misc_feature 1..20: note = CRISPR gRNA sequence
  source 1..20: mol_type = other DNA
tccttgtgggaggccagccc

SEQ ID NO: 667 - DNA, 20 bp, synthetic construct
  misc_feature 1..20: note = CRISPR gRNA sequence
  source 1..20: mol_type = other DNA
cttgtgggaggccagcccgg

SEQ ID NO: 668 - DNA, 20 bp, synthetic construct
  misc_feature 1..20: note = CRISPR gRNA sequence
  source 1..20: mol_type = other DNA
aggccagcccgggagatcta

SEQ ID NO: 669 - DNA, 20 bp, synthetic construct
  misc_feature 1..20: note = CRISPR gRNA sequence
  source 1..20: mol_type = other DNA
ggccagcccgggagatctac

SEQ ID NO: 670 - DNA, 20 bp, synthetic construct
  misc_feature 1..20: note = CRISPR gRNA sequence
  source 1..20: mol_type = other DNA
ccgggagatctacaggcgat

SEQ ID NO: 671 - DNA, 20 bp, synthetic construct
  misc_feature 1..20: note = CRISPR gRNA sequence
  source 1..20: mol_type = other DNA
cgggagatctacaggcgatc

SEQ ID NO: 672 - DNA, 20 bp, synthetic construct
  misc_feature 1..20: note = CRISPR gRNA sequence
  source 1..20: mol_type = other DNA
gggagatctacaggcgatca

SEQ ID NO: 673 - DNA, 20 bp, synthetic construct
  misc_feature 1..20: note = CRISPR gRNA sequence
  source 1..20: mol_type = other DNA
gagatctacaggcgatcagg

SEQ ID NO: 674 - DNA, 20 bp, synthetic construct
  misc_feature 1..20: note = CRISPR gRNA sequence
  source 1..20: mol_type = other DNA
agatctacaggcgatcaggg

SEQ ID NO: 675 - DNA, 20 bp, synthetic construct
  misc_feature 1..20: note = CRISPR gRNA sequence
  source 1..20: mol_type = other DNA
gcgatcagggaggcgccccg

SEQ ID NO: 676 - DNA, 20 bp, synthetic construct
  misc_feature 1..20: note = CRISPR gRNA sequence
  source 1..20: mol_type = other DNA
gggaggcgccccgtggcccc

SEQ ID NO: 677 - DNA, 20 bp, synthetic construct
  misc_feature 1..20: note = CRISPR gRNA sequence
  source 1..20: mol_type = other DNA
cccctggtacccgtgcgctg

SEQ ID NO: 678 - DNA, 20 bp, synthetic construct
  misc_feature 1..20: note = CRISPR gRNA sequence
  source 1..20: mol_type = other DNA
agcgtctccttcccgttctc

SEQ ID NO: 679 - DNA, 20 bp, synthetic construct
  misc_feature 1..20: note = CRISPR gRNA sequence
  source 1..20: mol_type = other DNA
gcgtctccttcccgttctcc

SEQ ID NO: 680 - DNA, 20 bp, synthetic construct
  misc_feature 1..20: note = CRISPR gRNA sequence
  source 1..20: mol_type = other DNA
tcccgttctccaggtatctg

SEQ ID NO: 681 - DNA, 20 bp, synthetic construct
  misc_feature 1..20: note = CRISPR gRNA sequence
  source 1..20: mol_type = other DNA
ccgttctccaggtatctgcg

SEQ ID NO: 682 - DNA, 20 bp, synthetic construct
  misc_feature 1..20: note = CRISPR gRNA sequence
  source 1..20: mol_type = other DNA
cactccacgcacgtgccatc

SEQ ID NO: 683 - DNA, 20 bp, synthetic construct
  misc_feature 1..20: note = CRISPR gRNA sequence
  source 1..20: mol_type = other DNA
actccacgcacgtgccatcc

SEQ ID NO: 684 - DNA, 20 bp, synthetic construct
  misc_feature 1..20: note = CRISPR gRNA sequence
  source 1..20: mol_type = other DNA
ccacgcacgtgccatccagg

SEQ ID NO: 685 - DNA, 20 bp, synthetic construct
  misc_feature 1..20: note = CRISPR gRNA sequence
  source 1..20: mol_type = other DNA
cacgcacgtgccatccaggt

SEQ ID NO: 686 - DNA, 20 bp, synthetic construct
  misc_feature 1..20: note = CRISPR gRNA sequence
  source 1..20: mol_type = other DNA
ctctcaactgctccgcctca

SEQ ID NO: 687 - DNA, 20 bp, synthetic construct
  misc_feature 1..20: note = CRISPR gRNA sequence
  source 1..20: mol_type = other DNA
tctcaactgctccgcctcat

SEQ ID NO: 688 - DNA, 20 bp, synthetic construct
  misc_feature 1..20: note = CRISPR gRNA sequence
  source 1..20: mol_type = other DNA
ggccgcctcccacttgcgct

SEQ ID NO: 689 - DNA, 20 bp, synthetic construct
  misc_feature 1..20: note = CRISPR gRNA sequence
  source 1..20: mol_type = other DNA
ccacttgcgcttggtgatct

SEQ ID NO: 690 - DNA, 20 bp, synthetic construct
  misc_feature 1..20: note = CRISPR gRNA sequence
  source 1..20: mol_type = other DNA
ctgagccgccatgtccgccg

SEQ ID NO: 691 - DNA, 20 bp, synthetic construct
  misc_feature 1..20: note = CRISPR gRNA sequence
  source 1..20: mol_type = other DNA
cgccatgtccgccgcggtcc

SEQ ID NO: 692 - DNA, 20 bp, synthetic construct
  misc_feature 1..20: note = CRISPR gRNA sequence
  source 1..20: mol_type = other DNA
ccatgtccgccgcggtccaa

SEQ ID NO: 693 - DNA, 20 bp, synthetic construct
  misc_feature 1..20: note = CRISPR gRNA sequence
  source 1..20: mol_type = other DNA
tccgccgcggtccaagagcg

SEQ ID NO: 694 - DNA, 20 bp, synthetic construct
  misc_feature 1..20: note = CRISPR gRNA sequence
  source 1..20: mol_type = other DNA
ccgccgcggtccaagagcgc

SEQ ID NO: 695 - DNA, 20 bp, synthetic construct
  misc_feature 1..20: note = CRISPR gRNA sequence
  source 1..20: mol_type = other DNA
caagagcgcaggtcctcgtt

SEQ ID NO: 696 - DNA, 20 bp, synthetic construct
  misc_feature 1..20: note = CRISPR gRNA sequence
  source 1..20: mol_type = other DNA
aagagcgcaggtcctcgttc

SEQ ID NO: 697 - DNA, 20 bp, synthetic construct
  misc_feature 1..20: note = CRISPR gRNA sequence
  source 1..20: mol_type = other DNA
agagcgcaggtcctcgttca

SEQ ID NO: 698 - DNA, 20 bp, synthetic construct
  misc_feature 1..20: note = CRISPR gRNA sequence
  source 1..20: mol_type = other DNA
cgatgtaatccttgccgtcg

SEQ ID NO: 699 - DNA, 20 bp, synthetic construct
  misc_feature 1..20: note = CRISPR gRNA sequence
  source 1..20: mol_type = other DNA
gatgtaatccttgccgtcgt

SEQ ID NO: 700 - DNA, 20 bp, synthetic construct
  misc_feature 1..20: note = CRISPR gRNA sequence
  source 1..20: mol_type = other DNA
tgccgtcgtaggcgtcctgc

SEQ ID NO: 701 - DNA, 20 bp, synthetic construct
  misc_feature 1..20: note = CRISPR gRNA sequence
  source 1..20: mol_type = other DNA
aggcgtcctgccggtacccg

SEQ ID NO: 702 - DNA, 20 bp, synthetic construct
  misc_feature 1..20: note = CRISPR gRNA sequence
  source 1..20: mol_type = other DNA
gcgtcctgccggtacccgcg

SEQ ID NO: 703 - DNA, 20 bp, synthetic construct
  misc_feature 1..20: note = CRISPR gRNA sequence
  source 1..20: mol_type = other DNA
cgtcctgccggtacccgcgg

SEQ ID NO: 704 - DNA, 20 bp, synthetic construct
  misc_feature 1..20: note = CRISPR gRNA sequence
  source 1..20: mol_type = other DNA
cctgccggtacccgcggagg

SEQ ID NO: 705 - DNA, 20 bp, synthetic construct
  misc_feature 1..20: note = CRISPR gRNA sequence
  source 1..20: mol_type = other DNA
gcccgtccgaccccacgtcg

SEQ ID NO: 706 - DNA, 20 bp, synthetic construct
  misc_feature 1..20: note = CRISPR gRNA sequence
  source 1..20: mol_type = other DNA
cgtcgcagccatacattatc

SEQ ID NO: 707 - DNA, 20 bp, synthetic construct
  misc_feature 1..20: note = CRISPR gRNA sequence
  source 1..20: mol_type = other DNA
gcagccatacattatctgga

SEQ ID NO: 708 - DNA, 20 bp, synthetic construct
  misc_feature 1..20: note = CRISPR gRNA sequence
  source 1..20: mol_type = other DNA
atacattatctggatggtgt

SEQ ID NO: 709 - DNA, 20 bp, synthetic construct
  misc_feature 1..20: note = CRISPR gRNA sequence
  source 1..20: mol_type = other DNA
atctggatggtgtgagaacc

SEQ ID NO: 710 - DNA, 20 bp, synthetic construct
  misc_feature 1..20: note = CRISPR gRNA sequence
  source 1..20: mol_type = other DNA
agaacctggccccgaccccg

SEQ ID NO: 711 - DNA, 20 bp, synthetic construct
  misc_feature 1..20: note = CRISPR gRNA sequence
  source 1..20: mol_type = other DNA
cctggccccgaccccgcggt

SEQ ID NO: 712 - DNA, 20 bp, synthetic construct
  misc_feature 1..20: note = CRISPR gRNA sequence
  source 1..20: mol_type = other DNA
ccccgaccccgcggtcagcc

SEQ ID NO: 713 - DNA, 20 bp, synthetic construct
  misc_feature 1..20: note = CRISPR gRNA sequence
  source 1..20: mol_type = other DNA
cgcggtcagcccagtccccc

SEQ ID NO: 714 - DNA, 20 bp, synthetic construct
  misc_feature 1..20: note = CRISPR gRNA sequence
  source 1..20: mol_type = other DNA
ccagtcccccgagccccgcc

SEQ ID NO: 715 - DNA, 20 bp, synthetic construct
  misc_feature 1..20: note = CRISPR gRNA sequence
  source 1..20: mol_type = other DNA
ccgcccagccccgaccaacc

SEQ ID NO: 716 - DNA, 20 bp, synthetic construct
  misc_feature 1..20: note = CRISPR gRNA sequence
  source 1..20: mol_type = other DNA
cgcccagccccgaccaaccc

SEQ ID NO: 717 - DNA, 20 bp, synthetic construct
  misc_feature 1..20: note = CRISPR gRNA sequence
  source 1..20: mol_type = other DNA
gcccagccccgaccaacccg

SEQ ID NO: 718 - DNA, 20 bp, synthetic construct
  misc_feature 1..20: note = CRISPR gRNA sequence
  source 1..20: mol_type = other DNA
cccagccccgaccaacccgg

SEQ ID NO: 719 - DNA, 20 bp, synthetic construct
  misc_feature 1..20: note = CRISPR gRNA sequence
  source 1..20: mol_type = other DNA
ccagccccgaccaacccggg

SEQ ID NO: 720 - DNA, 20 bp, synthetic construct
  misc_feature 1..20: note = CRISPR gRNA sequence
  source 1..20: mol_type = other DNA
gaccaacccggggggatttt

SEQ ID NO: 721 - DNA, 20 bp, synthetic construct
  misc_feature 1..20: note = CRISPR gRNA sequence
  source 1..20: mol_type = other DNA
gcctaaactgaaaatgaaac

SEQ ID NO: 722 - DNA, 20 bp, synthetic construct
  misc_feature 1..20: note = CRISPR gRNA sequence
  source 1..20: mol_type = other DNA
cctaaactgaaaatgaaacc

SEQ ID NO: 723 - DNA, 20 bp, synthetic construct
  misc_feature 1..20: note = CRISPR gRNA sequence
  source 1..20: mol_type = other DNA
actgaaaatgaaaccgggta

SEQ ID NO: 724 - DNA, 20 bp, synthetic construct
  misc_feature 1..20: note = CRISPR gRNA sequence
  source 1..20: mol_type = other DNA
ctgaaaatgaaaccgggtaa

SEQ ID NO: 725 - DNA, 20 bp, synthetic construct
  misc_feature 1..20: note = CRISPR gRNA sequence
  source 1..20: mol_type = other DNA
tgaaaccgggtaaaggcgcc

SEQ ID NO: 726 - DNA, 20 bp, synthetic construct
  misc_feature 1..20: note = CRISPR gRNA sequence
  source 1..20: mol_type = other DNA
gaaaccgggtaaaggcgcct

SEQ ID NO: 727 - DNA, 20 bp, synthetic construct
  misc_feature 1..20: note = CRISPR gRNA sequence
  source 1..20: mol_type = other DNA
aaaggcgcctgggcctctcc

SEQ ID NO: 728 - DNA, 20 bp, synthetic construct
  misc_feature 1..20: note = CRISPR gRNA sequence
  source 1..20: mol_type = other DNA
aaggcgcctgggcctctccc

SEQ ID NO: 729 - DNA, 20 bp, synthetic construct
  misc_feature 1..20: note = CRISPR gRNA sequence
  source 1..20: mol_type = other DNA
aggcgcctgggcctctcccg

SEQ ID NO: 730 - DNA, 20 bp, synthetic construct
  misc_feature 1..20: note = CRISPR gRNA sequence
  source 1..20: mol_type = other DNA
gcctgggcctctcccggggc

SEQ ID NO: 731 - DNA, 20 bp, synthetic construct
  misc_feature 1..20: note = CRISPR gRNA sequence
  source 1..20: mol_type = other DNA
cctgggcctctcccggggca

SEQ ID NO: 732 - DNA, 20 bp, synthetic construct
  misc_feature 1..20: note = CRISPR gRNA sequence
  source 1..20: mol_type = other DNA
ctgggcctctcccggggcaa

SEQ ID NO: 733 - DNA, 20 bp, synthetic construct
  misc_feature 1..20: note = CRISPR gRNA sequence
  source 1..20: mol_type = other DNA
ctctcccggggcaagggtct

SEQ ID NO: 734 - DNA, 20 bp, synthetic construct
  misc_feature 1..20: note = CRISPR gRNA sequence
  source 1..20: mol_type = other DNA
tctcccggggcaagggtctc

SEQ ID NO: 735 - DNA, 20 bp, synthetic construct
  misc_feature 1..20: note = CRISPR gRNA sequence
  source 1..20: mol_type = other DNA
ctcccggggcaagggtctcg

SEQ ID NO: 736 - DNA, 20 bp, synthetic construct
  misc_feature 1..20: note = CRISPR gRNA sequence
  source 1..20: mol_type = other DNA
gcaagggtctcggggtcccg

SEQ ID NO: 737 - DNA, 20 bp, synthetic construct
  misc_feature 1..20: note = CRISPR gRNA sequence
  source 1..20: mol_type = other DNA
gtctcggggtcccgcggctt

SEQ ID NO: 738 - DNA, 20 bp, synthetic construct
  misc_feature 1..20: note = CRISPR gRNA sequence
  source 1..20: mol_type = other DNA
tctcggggtcccgcggcttc

SEQ ID NO: 739 - DNA, 20 bp, synthetic construct
  misc_feature 1..20: note = CRISPR gRNA sequence
  source 1..20: mol_type = other DNA
ctcggggtcccgcggcttcg

SEQ ID NO: 740 - DNA, 20 bp, synthetic construct
  misc_feature 1..20: note = CRISPR gRNA sequence
  source 1..20: mol_type = other DNA
ggggtcccgcggcttcgggg

SEQ ID NO: 741 - DNA, 20 bp, synthetic construct
  misc_feature 1..20: note = CRISPR gRNA sequence
  source 1..20: mol_type = other DNA
cgcggcttcggggtggatct

SEQ ID NO: 742 - DNA, 20 bp, synthetic construct
  misc_feature 1..20: note = CRISPR gRNA sequence
  source 1..20: mol_type = other DNA
ttcggggtggatctcggacc

SEQ ID NO: 743 - DNA, 20 bp, synthetic construct
  misc_feature 1..20: note = CRISPR gRNA sequence
  source 1..20: mol_type = other DNA
cggggtggatctcggacccg

SEQ ID NO: 744 - DNA, 20 bp, synthetic construct
  misc_feature 1..20: note = CRISPR gRNA sequence
  source 1..20: mol_type = other DNA
gatctcggacccggagactg

SEQ ID NO: 745 - DNA, 20 bp, synthetic construct
  misc_feature 1..20: note = CRISPR gRNA sequence
  source 1..20: mol_type = other DNA
atctcggacccggagactgt

SEQ ID NO: 746 - DNA, 20 bp, synthetic construct
  misc_feature 1..20: note = CRISPR gRNA sequence
  source 1..20: mol_type = other DNA
cccggagactgtgggcgacc

SEQ ID NO: 747 - DNA, 20 bp, synthetic construct
  misc_feature 1..20: note = CRISPR gRNA sequence
  source 1..20: mol_type = other DNA
tgggcgacctggcccgtccg

SEQ ID NO: 748 - DNA, 20 bp, synthetic construct
  misc_feature 1..20: note = CRISPR gRNA sequence
  source 1..20: mol_type = other DNA
gggcgacctggcccgtccgt

SEQ ID NO: 749 - DNA, 20 bp, synthetic construct
  misc_feature 1..20: note = CRISPR gRNA sequence
  source 1..20: mol_type = other DNA
ggcgacctggcccgtccgtg

SEQ ID NO: 750 - DNA, 20 bp, synthetic construct
  misc_feature 1..20: note = CRISPR gRNA sequence
  source 1..20: mol_type = other DNA
gcgacctggcccgtccgtgg

SEQ ID NO: 751 - DNA, 20 bp, synthetic construct
  misc_feature 1..20: note = CRISPR gRNA sequence
  source 1..20: mol_type = other DNA
ctggcccgtccgtgggggat

SEQ ID NO: 752 - DNA, 20 bp, synthetic construct
  misc_feature 1..20: note = CRISPR gRNA sequence
  source 1..20: mol_type = other DNA
tggcccgtccgtgggggatg

SEQ ID NO: 753 - DNA, 20 bp, synthetic construct
  misc_feature 1..20: note = CRISPR gRNA sequence
  source 1..20: mol_type = other DNA
ggcccgtccgtgggggatga

SEQ ID NO: 754 - DNA, 20 bp, synthetic construct
  misc_feature 1..20: note = CRISPR gRNA sequence
  source 1..20: mol_type = other DNA
gcccgtccgtgggggatgag

SEQ ID NO: 755 - DNA, 20 bp, synthetic construct
  misc_feature 1..20: note = CRISPR gRNA sequence
  source 1..20: mol_type = other DNA
ggggtcctgacctgcgcccc

SEQ ID NO: 756 - DNA, 20 bp, synthetic construct
  misc_feature 1..20: note = CRISPR gRNA sequence
  source 1..20: mol_type = other DNA
tcctgacctgcgcccccggc

SEQ ID NO: 757 - DNA, 20 bp, synthetic construct
  misc_feature 1..20: note = CRISPR gRNA sequence
  source 1..20: mol_type = other DNA
cctgacctgcgcccccggcc

SEQ ID NO: 758 - DNA, 20 bp, synthetic construct
  misc_feature 1..20: note = CRISPR gRNA sequence
  source 1..20: mol_type = other DNA
ctgacctgcgcccccggccg

SEQ ID NO: 759 - DNA, 20 bp, synthetic construct
  misc_feature 1..20: note = CRISPR gRNA sequence
  source 1..20: mol_type = other DNA
ccccggccggggtcactcac

SEQ ID NO: 760 - DNA, 20 bp, synthetic construct
  misc_feature 1..20: note = CRISPR gRNA sequence
  source 1..20: mol_type = other DNA
gtcactcaccggcctcgctc

SEQ ID NO: 761 - DNA, 20 bp, synthetic construct
  misc_feature 1..20: note = CRISPR gRNA sequence
  source 1..20: mol_type = other DNA
caccggcctcgctctggttg

SEQ ID NO: 762 - DNA, 20 bp, synthetic construct
  misc_feature 1..20: note = CRISPR gRNA sequence
  source 1..20: mol_type = other DNA
cggcctcgctctggttgtag

SEQ ID NO: 763 - DNA, 20 bp, synthetic construct
  misc_feature 1..20: note = CRISPR gRNA sequence
  source 1..20: mol_type = other DNA
ctctggttgtagtagccgcg

SEQ ID NO: 764 - DNA, 20 bp, synthetic construct
  misc_feature 1..20: note = CRISPR gRNA sequence
  source 1..20: mol_type = other DNA
tctggttgtagtagccgcgc

SEQ ID NO: 765 - DNA, 20 bp, synthetic construct
  misc_feature 1..20: note = CRISPR gRNA sequence
  source 1..20: mol_type = other DNA
ctggttgtagtagccgcgca

SEQ ID NO: 766 - DNA, 20 bp, synthetic construct
  misc_feature 1..20: note = CRISPR gRNA sequence
  source 1..20: mol_type = other DNA
tagtagccgcgcagggtccc

SEQ ID NO: 767 - DNA, 20 bp, synthetic construct
  misc_feature 1..20: note = CRISPR gRNA sequence
  source 1..20: mol_type = other DNA
agtagccgcgcagggtcccc

SEQ ID NO: 768 - DNA, 20 bp, synthetic construct
  misc_feature 1..20: note = CRISPR gRNA sequence
  source 1..20: mol_type = other DNA
gcagggtccccaggtccact

SEQ ID NO: 769 - DNA, 20 bp, synthetic construct
  misc_feature 1..20: note = CRISPR gRNA sequence
  source 1..20: mol_type = other DNA
ggtccccaggtccactcggt

SEQ ID NO: 770 - DNA, 20 bp, synthetic construct
  misc_feature 1..20: note = CRISPR gRNA sequence
  source 1..20: mol_type = other DNA
ccactcggtcagtctgtgac

SEQ ID NO: 771 - DNA, 20 bp, synthetic construct
  misc_feature 1..20: note = CRISPR gRNA sequence
  source 1..20: mol_type = other DNA
cactcggtcagtctgtgact

SEQ ID NO: 772 - DNA, 20 bp, synthetic construct
  misc_feature 1..20: note = CRISPR gRNA sequence
  source 1..20: mol_type = other DNA
ccttcacattccgtgtctcc

SEQ ID NO: 773 - DNA, 20 bp, synthetic construct
  misc_feature 1..20: note = CRISPR gRNA sequence
  source 1..20: mol_type = other DNA
gtctcctggtcccaatactc

SEQ ID NO: 774 - DNA, 20 bp, synthetic construct
  misc_feature 1..20: note = CRISPR gRNA sequence
  source 1..20: mol_type = other DNA
ggcccctcctgctctatcca

SEQ ID NO: 775 - DNA, 20 bp, synthetic construct
  misc_feature 1..20: note = CRISPR gRNA sequence
  source 1..20: mol_type = other DNA
tgctctatccacggcgcccg

SEQ ID NO: 776 - DNA, 20 bp, synthetic construct
  misc_feature 1..20: note = CRISPR gRNA sequence
  source 1..20: mol_type = other DNA
gcgcccgcggctccatcctc

SEQ ID NO: 777 - DNA, 20 bp, synthetic construct
  misc_feature 1..20: note = CRISPR gRNA sequence
  source 1..20: mol_type = other DNA
cggctccatcctctggctcg

SEQ ID NO: 778 - DNA, 20 bp, synthetic construct
  misc_feature 1..20: note = CRISPR gRNA sequence
  source 1..20: mol_type = other DNA
cgaactgcgtgtcgtccacg

SEQ ID NO: 779 - DNA, 20 bp, synthetic construct
  misc_feature 1..20: note = CRISPR gRNA sequence
  source 1..20: mol_type = other DNA
cgtgtcgtccacgtagccca

SEQ ID NO: 780 - DNA, 20 bp, synthetic construct
  misc_feature 1..20: note = CRISPR gRNA sequence
  source 1..20: mol_type = other DNA
ccacgtagcccacggcgatg

SEQ ID NO: 781 - DNA, 20 bp, synthetic construct
  misc_feature 1..20: note = CRISPR gRNA sequence
  source 1..20: mol_type = other DNA
cgtagcccacggcgatgaag

SEQ ID NO: 782 - DNA, 20 bp, synthetic construct
  misc_feature 1..20: note = CRISPR gRNA sequence
  source 1..20: mol_type = other DNA
gtagcccacggcgatgaagc

SEQ ID NO: 783 - DNA, 20 bp, synthetic construct
  misc_feature 1..20: note = CRISPR gRNA sequence
  source 1..20: mol_type = other DNA
tagcccacggcgatgaagcg

SEQ ID NO: 784 - DNA, 20 bp, synthetic construct
  misc_feature 1..20: note = CRISPR gRNA sequence
  source 1..20: mol_type = other DNA
cgatgaagcggggctccccg

SEQ ID NO: 785 - DNA, 20 bp, synthetic construct
  misc_feature 1..20: note = CRISPR gRNA sequence
  source 1..20: mol_type = other DNA
gaagcggggctccccgcggc

SEQ ID NO: 786 - DNA, 20 bp, synthetic construct
  misc_feature 1..20: note = CRISPR gRNA sequence
  source 1..20: mol_type = other DNA
aagcggggctccccgcggcc

SEQ ID NO: 787 - DNA, 20 bp, synthetic construct
  misc_feature 1..20: note = CRISPR gRNA sequence
  source 1..20: mol_type = other DNA
ggggctccccgcggccgggc

SEQ ID NO: 788 - DNA, 20 bp, synthetic construct
  misc_feature 1..20: note = CRISPR gRNA sequence
  source 1..20: mol_type = other DNA
gggctccccgcggccgggcc

SEQ ID NO: 789 - DNA, 20 bp, synthetic construct
  misc_feature 1..20: note = CRISPR gRNA sequence
  source 1..20: mol_type = other DNA
cccgcggccgggccgggaca

SEQ ID NO: 790 - DNA, 20 bp, synthetic construct
  misc_feature 1..20: note = CRISPR gRNA sequence
  source 1..20: mol_type = other DNA
cgggccgggacacggatgtg

SEQ ID NO: 791 - DNA, 20 bp, synthetic construct
  misc_feature 1..20: note = CRISPR gRNA sequence
  source 1..20: mol_type = other DNA
ggatgtgaagaaatacctca

SEQ ID NO: 792 - DNA, 20 bp, synthetic construct
  misc_feature 1..20: note = CRISPR gRNA sequence
  source 1..20: mol_type = other DNA
atgtgaagaaatacctcatg

SEQ ID NO: 793 - DNA, 20 bp, synthetic construct
  misc_feature 1..20: note = CRISPR gRNA sequence
  source 1..20: mol_type = other DNA
tgaagaaatacctcatggag

SEQ ID NO: 794 - DNA, 20 bp, synthetic construct
  misc_feature 1..20: note = CRISPR gRNA sequence
  source 1..20: mol_type = other DNA
gaagaaatacctcatggagt

SEQ ID NO: 795 - DNA, 20 bp, synthetic construct
  misc_feature 1..20: note = CRISPR gRNA sequence
  source 1..20: mol_type = other DNA
agaaatacctcatggagtgg

SEQ ID NO: 796 - DNA, 20 bp, synthetic construct
  misc_feature 1..20: note = CRISPR gRNA sequence
  source 1..20: mol_type = other DNA
tacctcatggagtgggagcc

SEQ ID NO: 797 - DNA, 20 bp, synthetic construct
  misc_feature 1..20: note = CRISPR gRNA sequence
  source 1..20: mol_type = other DNA
acctcatggagtgggagcct

SEQ ID NO: 798 - DNA, 20 bp, synthetic construct
  misc_feature 1..20: note = CRISPR gRNA sequence
  source 1..20: mol_type = other DNA
cctcatggagtgggagcctg

SEQ ID NO: 799 - DNA, 20 bp, synthetic construct
  misc_feature 1..20: note = CRISPR gRNA sequence
  source 1..20: mol_type = other DNA
ctcatggagtgggagcctgg

SEQ ID NO: 800 - DNA, 20 bp, synthetic construct
  misc_feature 1..20: note = CRISPR gRNA sequence
  source 1..20: mol_type = other DNA
tggagtgggagcctgggggc

SEQ ID NO: 801 - DNA, 20 bp, synthetic construct
  misc_feature 1..20: note = CRISPR gRNA sequence
  source 1..20: mol_type = other DNA
agtgggagcctgggggcgag

SEQ ID NO: 802 - DNA, 20 bp, synthetic construct
  misc_feature 1..20: note = CRISPR gRNA sequence
  source 1..20: mol_type = other DNA
gggagcctgggggcgagcag

SEQ ID NO: 803 - DNA, 20 bp, synthetic construct
  misc_feature 1..20: note = CRISPR gRNA sequence
  source 1..20: mol_type = other DNA
cctgggggcgagcagtggct

SEQ ID NO: 804 - DNA, 20 bp, synthetic construct
  misc_feature 1..20: note = CRISPR gRNA sequence
  source 1..20: mol_type = other DNA
gacctgcccgaccctcgtcc

SEQ ID NO: 805 - DNA, 20 bp, synthetic construct
  misc_feature 1..20: note = CRISPR gRNA sequence
  source 1..20: mol_type = other DNA
gcccgaccctcgtcccggcg

SEQ ID NO: 806 - DNA, 20 bp, synthetic construct
  misc_feature 1..20: note = CRISPR gRNA sequence
  source 1..20: mol_type = other DNA
tcgtcccggcgcggctcccc

SEQ ID NO: 807 - DNA, 20 bp, synthetic construct
  misc_feature 1..20: note = CRISPR gRNA sequence
  source 1..20: mol_type = other DNA
ccccggtcctgcgcccccgc

SEQ ID NO: 808 - DNA, 20 bp, synthetic construct
  misc_feature 1..20: note = CRISPR gRNA sequence
  source 1..20: mol_type = other DNA
cccggtcctgcgcccccgcc

SEQ ID NO: 809 - DNA, 20 bp, synthetic construct
  misc_feature 1..20: note = CRISPR gRNA sequence
  source 1..20: mol_type = other DNA
cggtcctgcgcccccgccag

SEQ ID NO: 810 - DNA, 20 bp, synthetic construct
  misc_feature 1..20: note = CRISPR gRNA sequence
  source 1..20: mol_type = other DNA
ggtcctgcgcccccgccagg

SEQ ID NO: 811 - DNA, 20 bp, synthetic construct
  misc_feature 1..20: note = CRISPR gRNA sequence
  source 1..20: mol_type = other DNA
gtcctgcgcccccgccagga

SEQ ID NO: 812 - DNA, 20 bp, synthetic construct
  misc_feature 1..20: note = CRISPR gRNA sequence
  source 1..20: mol_type = other DNA
gggccccttgcttctccccg

SEQ ID NO: 813 - DNA, 20 bp, synthetic construct
  misc_feature 1..20: note = CRISPR gRNA sequence
  source 1..20: mol_type = other DNA
gccccttgcttctccccgca

SEQ ID NO: 814 - DNA, 20 bp, synthetic construct
  misc_feature 1..20: note = CRISPR gRNA sequence
  source 1..20: mol_type = other DNA
ccccttgcttctccccgcag

SEQ ID NO: 815 - DNA, 20 bp, synthetic construct
  misc_feature 1..20: note = CRISPR gRNA sequence
  source 1..20: mol_type = other DNA
cttgcttctccccgcagagg

SEQ ID NO: 816 - DNA, 20 bp, synthetic construct
  misc_feature 1..20: note = CRISPR gRNA sequence
  source 1..20: mol_type = other DNA
cgaccccgcactcacccgcc

SEQ ID NO: 817 - DNA, 20 bp, synthetic construct
  misc_feature 1..20: note = CRISPR gRNA sequence
  source 1..20: mol_type = other DNA
gaccccgcactcacccgccc

SEQ ID NO: 818 - DNA, 20 bp, synthetic construct
  misc_feature 1..20: note = CRISPR gRNA sequence
  source 1..20: mol_type = other DNA
cgcactcacccgcccaggtc

SEQ ID NO: 819 - DNA, 20 bp, synthetic construct
  misc_feature 1..20: note = CRISPR gRNA sequence
  source 1..20: mol_type = other DNA
gcactcacccgcccaggtct

SEQ ID NO: 820 - DNA, 20 bp, synthetic construct
  misc_feature 1..20: note = CRISPR gRNA sequence
  source 1..20: mol_type = other DNA
tcacccgcccaggtctgggt

SEQ ID NO: 821 - DNA, 20 bp, synthetic construct
  misc_feature 1..20: note = CRISPR gRNA sequence
  source 1..20: mol_type = other DNA
cacccgcccaggtctgggtc

SEQ ID NO: 822 - DNA, 20 bp, synthetic construct
  misc_feature 1..20: note = CRISPR gRNA sequence
  source 1..20: mol_type = other DNA
acccgcccaggtctgggtca

SEQ ID NO: 823 - DNA, 20 bp, synthetic construct
  misc_feature 1..20: note = CRISPR gRNA sequence
  source 1..20: mol_type = other DNA
gcccaggtctgggtcagggc

SEQ ID NO: 824 - DNA, 20 bp, synthetic construct
  misc_feature 1..20: note = CRISPR gRNA sequence
  source 1..20: mol_type = other DNA
cccaggtctgggtcagggcc

SEQ ID NO: 825 - DNA, 20 bp, synthetic construct
  misc_feature 1..20: note = CRISPR gRNA sequence
  source 1..20: mol_type = other DNA
ccaggtctgggtcagggcca

SEQ ID NO: 826 - DNA, 20 bp, synthetic construct
  misc_feature 1..20: note = CRISPR gRNA sequence
  source 1..20: mol_type = other DNA
gggtcagggccagggccccc

SEQ ID NO: 827 - DNA, 20 bp, synthetic construct
  misc_feature 1..20: note = CRISPR gRNA sequence
  source 1..20: mol_type = other DNA
gtcagggccagggcccccga

SEQ ID NO: 828 - DNA, 20 bp, synthetic construct
  misc_feature 1..20: note = CRISPR gRNA sequence
  source 1..20: mol_type = other DNA
agggccagggcccccgagag

SEQ ID NO: 829 - DNA, 20 bp, synthetic construct
  misc_feature 1..20: note = CRISPR gRNA sequence
  source 1..20: mol_type = other DNA
gccagggcccccgagagtag

SEQ ID NO: 830 - DNA, 20 bp, synthetic construct
  misc_feature 1..20: note = CRISPR gRNA sequence
  source 1..20: mol_type = other DNA
ccagggcccccgagagtagc

SEQ ID NO: 831 - DNA, 20 bp, synthetic construct
  misc_feature 1..20: note = CRISPR gRNA sequence
  source 1..20: mol_type = other DNA
agggcccccgagagtagcag

SEQ ID NO: 832 - DNA, 20 bp, synthetic construct
  misc_feature 1..20: note = CRISPR gRNA sequence
  source 1..20: mol_type = other DNA
gggcccccgagagtagcagg

SEQ ID NO: 833 - DNA, 20 bp, synthetic construct
  misc_feature 1..20: note = CRISPR gRNA sequence
  source 1..20: mol_type = other DNA
gcccccgagagtagcaggag

SEQ ID NO: 834 - DNA, 20 bp, synthetic construct
  misc_feature 1..20: note = CRISPR gRNA sequence
  source 1..20: mol_type = other DNA
cccccgagagtagcaggagg

SEQ ID NO: 835 - DNA, 20 bp, synthetic construct
  misc_feature 1..20: note = CRISPR gRNA sequence
  source 1..20: mol_type = other DNA
ccccgagagtagcaggagga

SEQ ID NO: 836 - DNA, 20 bp, synthetic construct
  misc_feature 1..20: note = CRISPR gRNA sequence
  source 1..20: mol_type = other DNA
agagtagcaggaggagggtt

SEQ ID NO: 837 - DNA, 20 bp, synthetic construct
  misc_feature 1..20: note = CRISPR gRNA sequence
  source 1..20: mol_type = other DNA
gagtagcaggaggagggttc

SEQ ID NO: 838 - DNA, 20 bp, synthetic construct
  misc_feature 1..20: note = CRISPR gRNA sequence
  source 1..20: mol_type = other DNA
agtagcaggaggagggttcg

SEQ ID NO: 839 - DNA, 20 bp, synthetic construct
  misc_feature 1..20: note = CRISPR gRNA sequence
  source 1..20: mol_type = other DNA
gagggttcggggcgccatga

SEQ ID NO: 840 - DNA, 20 bp, synthetic construct
  misc_feature 1..20: note = CRISPR gRNA sequence
  source 1..20: mol_type = other DNA
ggcgccatgacggccatcct

SEQ ID NO: 841 - DNA, 20 bp, synthetic construct
  misc_feature 1..20: note = CRISPR gRNA sequence
  source 1..20: mol_type = other DNA
tgacggccatcctcggcgtc

SEQ ID NO: 842 - DNA, 20 bp, synthetic construct
  misc_feature 1..20: note = CRISPR gRNA sequence
  source 1..20: mol_type = other DNA
gacggccatcctcggcgtct

SEQ ID NO: 843 - DNA, 20 bp, synthetic construct
  misc_feature 1..20: note = CRISPR gRNA sequence
  source 1..20: mol_type = other DNA
acggccatcctcggcgtctg

SEQ ID NO: 844 - DNA, 20 bp, synthetic construct
  misc_feature 1..20: note = CRISPR gRNA sequence
  source 1..20: mol_type = other DNA
ggccatcctcggcgtctggg

SEQ ID NO: 845 - DNA, 20 bp, synthetic construct
  misc_feature 1..20: note = CRISPR gRNA sequence
  source 1..20: mol_type = other DNA
tcggcgtctggggagaatct

SEQ ID NO: 846 - DNA, 20 bp, synthetic construct
  misc_feature 1..20: note = CRISPR gRNA sequence
  source 1..20: mol_type = other DNA
tctggggagaatctgagtcc

SEQ ID NO: 847 - DNA, 20 bp, synthetic construct
  misc_feature 1..20: note = CRISPR gRNA sequence
  source 1..20: mol_type = other DNA
ggggagaatctgagtcccgg

SEQ ID NO: 848 - DNA, 20 bp, synthetic construct
  misc_feature 1..20: note = CRISPR gRNA sequence
  source 1..20: mol_type = other DNA
gggagaatctgagtcccggt

SEQ ID NO: 849 - DNA, 20 bp, synthetic construct
  misc_feature 1..20: note = CRISPR gRNA sequence
  source 1..20: mol_type = other DNA
tgagtcccggtgggtgcgtg

SEQ ID NO: 850 - DNA, 20 bp, synthetic construct
  misc_feature 1..20: note = CRISPR gRNA sequence
  source 1..20: mol_type = other DNA
gagtcccggtgggtgcgtgc

SEQ ID NO: 851 - DNA, 20 bp, synthetic construct
  misc_feature 1..20: note = CRISPR gRNA sequence
  source 1..20: mol_type = other DNA
cggtgggtgcgtgcgggctt

SEQ ID NO: 852 - DNA, 20 bp, synthetic construct
  misc_feature 1..20: note = CRISPR gRNA sequence
  source 1..20: mol_type = other DNA
ggtgcgtgcgggctttagaa

SEQ ID NO: 853 - DNA, 20 bp, synthetic construct
  misc_feature 1..20: note = CRISPR gRNA sequence
  source 1..20: mol_type = other DNA
gcgaccgcgacgacactgat

SEQ ID NO: 854 - DNA, 20 bp, synthetic construct
  misc_feature 1..20: note = CRISPR gRNA sequence
  source 1..20: mol_type = other DNA
acgacactgattggcttctc

SEQ ID NO: 855 - DNA, 20 bp, synthetic construct
  misc_feature 1..20: note = CRISPR gRNA sequence
  source 1..20: mol_type = other DNA
tcagattctccccagacgcc

SEQ ID NO: 856 - DNA, 20 bp, synthetic construct
  misc_feature 1..20: note = CRISPR gRNA sequence
  source 1..20: mol_type = other DNA
tggccctgacccagacctgg

SEQ ID NO: 857 - DNA, 20 bp, synthetic construct
  misc_feature 1..20: note = CRISPR gRNA sequence
  source 1..20: mol_type = other DNA
cctgacccagacctgggcgg

SEQ ID NO: 858 - DNA, 20 bp, synthetic construct
  misc_feature 1..20: note = CRISPR gRNA sequence
  source 1..20: mol_type = other DNA
cagacctgggcgggtgagtg

SEQ ID NO: 859 - DNA, 20 bp, synthetic construct
  misc_feature 1..20: note = CRISPR gRNA sequence
  source 1..20: mol_type = other DNA
cgggggagccgcgccgggac

SEQ ID NO: 860 - DNA, 20 bp, synthetic construct
  misc_feature 1..20: note = CRISPR gRNA sequence
  source 1..20: mol_type = other DNA
gacagcgacgccgcgagcca

SEQ ID NO: 861 - DNA, 20 bp, synthetic construct
  misc_feature 1..20: note = CRISPR gRNA sequence
  source 1..20: mol_type = other DNA
aggatggagccgcgggcgcc

SEQ ID NO: 862 - DNA, 20 bp, synthetic construct
  misc_feature 1..20: note = CRISPR gRNA sequence
  source 1..20: mol_type = other DNA
gtggatagagcaggaggggc

SEQ ID NO: 863 - DNA, 20 bp, synthetic construct
  misc_feature 1..20: note = CRISPR gRNA sequence
  source 1..20: mol_type = other DNA
agtattgggaccaggagaca

SEQ ID NO: 864 - DNA, 20 bp, synthetic construct
  misc_feature 1..20: note = CRISPR gRNA sequence
  source 1..20: mol_type = other DNA
aaggcccagtcacagactga

SEQ ID NO: 865 - DNA, 20 bp, synthetic construct
  misc_feature 1..20: note = CRISPR gRNA sequence
  source 1..20: mol_type = other DNA
ctacaaccagagcgaggccg

SEQ ID NO: 866 - DNA, 20 bp, synthetic construct
  misc_feature 1..20: note = CRISPR gRNA sequence
  source 1..20: mol_type = other DNA
ggccaggtcgcccacagtct

SEQ ID NO: 867 - DNA, 20 bp, synthetic construct
  misc_feature 1..20: note = CRISPR gRNA sequence
  source 1..20: mol_type = other DNA
agtttaggccaaaaatcccc

SEQ ID NO: 868 - DNA, 20 bp, synthetic construct
  misc_feature 1..20: note = CRISPR gRNA sequence
  source 1..20: mol_type = other DNA
tcgggggactgggctgaccg

SEQ ID NO: 869 - DNA, 20 bp, synthetic construct
  misc_feature 1..20: note = CRISPR gRNA sequence
  source 1..20: mol_type = other DNA
gataatgtatggctgcgacg

SEQ ID NO: 870 - DNA, 20 bp, synthetic construct
  misc_feature 1..20: note = CRISPR gRNA sequence
  source 1..20: mol_type = other DNA
gtcggacgggcgcttcctcc

SEQ ID NO: 871 - DNA, 20 bp, synthetic construct
  misc_feature 1..20: note = CRISPR gRNA sequence
  source 1..20: mol_type = other DNA
ggcaggacgcctacgacggc

SEQ ID NO: 872 - DNA, 20 bp, synthetic construct
  misc_feature 1..20: note = CRISPR gRNA sequence
  source 1..20: mol_type = other DNA
cggagcagttgagagcctac

SEQ ID NO: 873 - DNA, 20 bp, synthetic construct
  misc_feature 1..20: note = CRISPR gRNA sequence
  source 1..20: mol_type = other DNA
ctacctggatggcacgtgcg

SEQ ID NO: 874 - DNA, 20 bp, synthetic construct
  misc_feature 1..20: note = CRISPR gRNA sequence
  source 1..20: mol_type = other DNA
ggaaggagacgctgcagcgc

SEQ ID NO: 875 - DNA, 20 bp, synthetic construct
  misc_feature 1..20: note = CRISPR gRNA sequence
  source 1..20: mol_type = other DNA
gagacaattgggaccaacac

SEQ ID NO: 876 - DNA, 20 bp, synthetic construct
  misc_feature 1..20: note = CRISPR gRNA sequence
  source 1..20: mol_type = other DNA
tccctctggtcctgagggag

SEQ ID NO: 877 - DNA, 20 bp, synthetic construct
  misc_feature 1..20: note = CRISPR gRNA sequence
  source 1..20: mol_type = other DNA
cctgagggagaggaatcctc

SEQ ID NO: 878 - DNA, 20 bp, synthetic construct
  misc_feature 1..20: note = CRISPR gRNA sequence
  source 1..20: mol_type = other DNA
gggttccagatcctgtacca

SEQ ID NO: 879 - DNA, 20 bp, synthetic construct
  misc_feature 1..20: note = CRISPR gRNA sequence
  source 1..20: mol_type = other DNA
cctgctctctgacacaatta

SEQ ID NO: 880 - DNA, 20 bp, synthetic construct
  misc_feature 1..20: note = CRISPR gRNA sequence
  source 1..20: mol_type = other DNA
ttaagggataaaatctctga

SEQ ID NO: 881 - DNA, 20 bp, synthetic construct
  misc_feature 1..20: note = CRISPR gRNA sequence
  source 1..20: mol_type = other DNA
agtgacgggaagacgatccc

SEQ ID NO: 882 - DNA, 20 bp, synthetic construct
  misc_feature 1..20: note = CRISPR gRNA sequence
  source 1..20: mol_type = other DNA
agacgatccctcgaatactg

SEQ ID NO: 883 - DNA, 20 bp, synthetic construct
  misc_feature 1..20: note = CRISPR gRNA sequence
  source 1..20: mol_type = other DNA
gcttcacactcaatgtgtgt

SEQ ID NO: 884 - DNA, 20 bp, synthetic construct
  misc_feature 1..20: note = CRISPR gRNA sequence
  source 1..20: mol_type = other DNA
cactcaatgtgtgtgggggt

SEQ ID NO: 885 - DNA, 20 bp, synthetic construct
  misc_feature 1..20: note = CRISPR gRNA sequence
  source 1..20: mol_type = other DNA
ggggtctgagtccagcactt

SEQ ID NO: 886 - DNA, 20 bp, synthetic construct
  misc_feature 1..20: note = CRISPR gRNA sequence
  source 1..20: mol_type = other DNA
aagtcgctgttcccttctca

SEQ ID NO: 887 - DNA, 20 bp, synthetic construct
  misc_feature 1..20: note = CRISPR gRNA sequence
  source 1..20: mol_type = other DNA
gcctgtgtccaggctggtgt

SEQ ID NO: 888 - DNA, 20 bp, synthetic construct
  misc_feature 1..20: note = CRISPR gRNA sequence
  source 1..20: mol_type = other DNA
tctgtgctctcttccccatc

SEQ ID NO: 889 - DNA, 20 bp, synthetic construct
  misc_feature 1..20: note = CRISPR gRNA sequence
  source 1..20: mol_type = other DNA
gatggccacatgcgtgctgg

SEQ ID NO: 890 - DNA, 20 bp, synthetic construct
  misc_feature 1..20: note = CRISPR gRNA sequence
  source 1..20: mol_type = other DNA
ccatgacagatgcaaaatgc

SEQ ID NO: 891 - DNA, 20 bp, synthetic construct
  misc_feature 1..20: note = CRISPR gRNA sequence
  source 1..20: mol_type = other DNA
agatcacactgacctggcag

SEQ ID NO: 892 - DNA, 20 bp, synthetic construct
  misc_feature 1..20: note = CRISPR gRNA sequence
  source 1..20: mol_type = other DNA
tcgtggagaccaggcctgca

SEQ ID NO: 893 - DNA, 20 bp, synthetic construct
  misc_feature 1..20: note = CRISPR gRNA sequence
  source 1..20: mol_type = other DNA
acacctgccatgtgcagcat

SEQ ID NO: 894 - DNA, 20 bp, synthetic construct
  misc_feature 1..20: note = CRISPR gRNA sequence
  source 1..20: mol_type = other DNA
ccaagcccctcaccctgaga

SEQ ID NO: 895 - DNA, 20 bp, synthetic construct
  misc_feature 1..20: note = CRISPR gRNA sequence
  source 1..20: mol_type = other DNA
gatggggtaaggagggagat

SEQ ID NO: 896 - DNA, 20 bp, synthetic construct
  misc_feature 1..20: note = CRISPR gRNA sequence
  source 1..20: mol_type = other DNA
gcctctctggagacctttag

SEQ ID NO: 897 - DNA, 20 bp, synthetic construct
  misc_feature 1..20: note = CRISPR gRNA sequence
  source 1..20: mol_type = other DNA
aggaagagctcaggtggaga

SEQ ID NO: 898 - DNA, 20 bp, synthetic construct
  misc_feature 1..20: note = CRISPR gRNA sequence
  source 1..20: mol_type = other DNA
gctcaggtggagaaggggtg

SEQ ID NO: 899 - DNA, 20 bp, synthetic construct
  misc_feature 1..20: note = CRISPR gRNA sequence
  source 1..20: mol_type = other DNA
ggtggagaaggggtgaaggg

SEQ ID NO: 900 - DNA, 20 bp, synthetic construct
  misc_feature 1..20: note = CRISPR gRNA sequence
  source 1..20: mol_type = other DNA
ctgagatttcttgtctcact

SEQ ID NO: 901 - DNA, 20 bp, synthetic construct
  misc_feature 1..20: note = CRISPR gRNA sequence
  source 1..20: mol_type = other DNA
ccagcaatgatgcccacgat

SEQ ID NO: 902 - DNA, 20 bp, synthetic construct
  misc_feature 1..20: note = CRISPR gRNA sequence
  source 1..20: mol_type = other DNA
tctccctccttaccccatct

SEQ ID NO: 903 - DNA, 20 bp, synthetic construct
  misc_feature 1..20: note = CRISPR gRNA sequence
  source 1..20: mol_type = other DNA
gtctccacgagctccgtgtc

SEQ ID NO: 904 - DNA, 20 bp, synthetic construct
  misc_feature 1..20: note = CRISPR gRNA sequence
  source 1..20: mol_type = other DNA
ccaggtcagtgtgatctccg

SEQ ID NO: 905 - DNA, 20 bp, synthetic construct
  misc_feature 1..20: note = CRISPR gRNA sequence
  source 1..20: mol_type = other DNA
aagcccagggcccagcacct

SEQ ID NO: 906 - DNA, 20 bp, synthetic construct
  misc_feature 1..20: note = CRISPR gRNA sequence
  source 1..20: mol_type = other DNA
ggtggcctcatggtcagaga

SEQ ID NO: 907 - DNA, 20 bp, synthetic construct
  misc_feature 1..20: note = CRISPR gRNA sequence
  source 1..20: mol_type = other DNA
tcatggtcagagatggggtg

SEQ ID NO: 908 - DNA, 20 bp, synthetic construct
  misc_feature 1..20: note = CRISPR gRNA sequence
  source 1..20: mol_type = other DNA
gtgggtcatatgtgtcttgg

SEQ ID NO: 909 - DNA, 20 bp, synthetic construct
  misc_feature 1..20: note = CRISPR gRNA sequence
  source 1..20: mol_type = other DNA
tcttgggggggtctgacggg

SEQ ID NO: 910 - DNA, 20 bp, synthetic construct
  misc_feature 1..20: note = CRISPR gRNA sequence
  source 1..20: mol_type = other DNA
agcacgcatgtggccatctt

SEQ ID NO: 911 - DNA, 20 bp, synthetic construct
  misc_feature 1..20: note = CRISPR gRNA sequence
  source 1..20: mol_type = other DNA
ttgagaatggacaggacacc

SEQ ID NO: 912 - DNA, 20 bp, synthetic construct
  misc_feature 1..20: note = CRISPR gRNA sequence
  source 1..20: mol_type = other DNA
ccagcctggacacaggcacc

SEQ ID NO: 913 - DNA, 20 bp, synthetic construct
  misc_feature 1..20: note = CRISPR gRNA sequence
  source 1..20: mol_type = other DNA
cagcgacttctggtcctgac

SEQ ID NO: 914 - DNA, 20 bp, synthetic construct
  misc_feature 1..20: note = CRISPR gRNA sequence
  source 1..20: mol_type = other DNA
gactcagacccccacacaca

SEQ ID NO: 915 - DNA, 20 bp, synthetic construct
  misc_feature 1..20: note = CRISPR gRNA sequence
  source 1..20: mol_type = other DNA
gaaccactcatcagtattcg

SEQ ID NO: 916 - DNA, 20 bp, synthetic construct
  misc_feature 1..20: note = CRISPR gRNA sequence
  source 1..20: mol_type = other DNA
cagagagcagggcggaacct

SEQ ID NO: 917 - DNA, 20 bp, synthetic construct
  misc_feature 1..20: note = CRISPR gRNA sequence
  source 1..20: mol_type = other DNA
ctcagagtcactctctggta

SEQ ID NO: 918 - DNA, 20 bp, synthetic construct
  misc_feature 1..20: note = CRISPR gRNA sequence
  source 1..20: mol_type = other DNA
gtacaggatctggaacccag

SEQ ID NO: 919 - DNA, 20 bp, synthetic construct
  misc_feature 1..20: note = CRISPR gRNA sequence
  source 1..20: mol_type = other DNA
ctctccctcaggaccagagg

SEQ ID NO: 920 - DNA, 20 bp, synthetic construct
  misc_feature 1..20: note = CRISPR gRNA sequence
  source 1..20: mol_type = other DNA
acgtcgcagccatacattat

SEQ ID NO: 921 - DNA, 20 bp, synthetic construct
  misc_feature 1..20: note = CRISPR gRNA sequence
  source 1..20: mol_type = other DNA
cccagccccgaccaacccgg

SEQ ID NO: 922 - DNA, 20 bp, synthetic construct
  misc_feature 1..20: note = CRISPR gRNA sequence
  source 1..20: mol_type = other DNA
ggcctaaactgaaaatgaaa

SEQ ID NO: 923 - DNA, 20 bp, synthetic construct
  misc_feature 1..20: note = CRISPR gRNA sequence
  source 1..20: mol_type = other DNA
gcctgggcctctcccggggc

SEQ ID NO: 924 - DNA, 20 bp, synthetic construct
  misc_feature 1..20: note = CRISPR gRNA sequence
  source 1..20: mol_type = other DNA
ctctcccggggcaagggtct

SEQ ID NO: 925 - DNA, 20 bp, synthetic construct
  misc_feature 1..20: note = CRISPR gRNA sequence
  source 1..20: mol_type = other DNA
gtctcggggtcccgcggctt

SEQ ID NO: 926 - DNA, 20 bp, synthetic construct
  misc_feature 1..20: note = CRISPR gRNA sequence
  source 1..20: mol_type = other DNA
cggggtcccgcggcttcggg

SEQ ID NO: 927 - DNA, 20 bp, synthetic construct
  misc_feature 1..20: note = CRISPR gRNA sequence
  source 1..20: mol_type = other DNA
ggcgacctggcccgtccgtg

SEQ ID NO: 928 - DNA, 20 bp, synthetic construct
  misc_feature 1..20: note = CRISPR gRNA sequence
  source 1..20: mol_type = other DNA
tggcccgtccgtgggggatg

SEQ ID NO: 929 - DNA, 20 bp, synthetic construct
  misc_feature 1..20: note = CRISPR gRNA sequence
  source 1..20: mol_type = other DNA
tcctgacctgcgcccccggc

SEQ ID NO: 930 - DNA, 20 bp, synthetic construct
  misc_feature 1..20: note = CRISPR gRNA sequence
  source 1..20: mol_type = other DNA
ctctggttgtagtagccgcg

SEQ ID NO: 931 - DNA, 20 bp, synthetic construct
  misc_feature 1..20: note = CRISPR gRNA sequence
  source 1..20: mol_type = other DNA
ccccgcggccgggccgggac

SEQ ID NO: 932 - DNA, 20 bp, synthetic construct
  misc_feature 1..20: note = CRISPR gRNA sequence
  source 1..20: mol_type = other DNA
ggatgtgaagaaatacctca

SEQ ID NO: 933 - DNA, 20 bp, synthetic construct
  misc_feature 1..20: note = CRISPR gRNA sequence
  source 1..20: mol_type = other DNA
ccgcactcacccgcccaggt

SEQ ID NO: 934 - DNA, 20 bp, synthetic construct
  misc_feature 1..20: note = CRISPR gRNA sequence
  source 1..20: mol_type = other DNA
gggtcagggccagggccccc

SEQ ID NO: 935 - DNA, 20 bp, synthetic construct
  misc_feature 1..20: note = CRISPR gRNA sequence
  source 1..20: mol_type = other DNA
gcccccgagagtagcaggag

SEQ ID NO: 936 - DNA, 20 bp, synthetic construct
  misc_feature 1..20: note = CRISPR gRNA sequence
  source 1..20: mol_type = other DNA
ggccatcctcggcgtctggg

SEQ ID NO: 937 - DNA, 20 bp, synthetic construct
  misc_feature 1..20: note = CRISPR gRNA sequence
  source 1..20: mol_type = other DNA
cctcggcgtctggggagaat

SEQ ID NO: 938 - DNA, 20 bp, synthetic construct
  misc_feature 1..20: note = CRISPR gRNA sequence
  source 1..20: mol_type = other DNA
tggggagaatctgagtcccg

SEQ ID NO: 939 - DNA, 20 bp, synthetic construct
  misc_feature 1..20: note = CRISPR gRNA sequence
  source 1..20: mol_type = other DNA
cccgcacgcacccaccggga

SEQ ID NO: 940 - DNA, 20 bp, synthetic construct
  misc_feature 1..20: note = CRISPR gRNA sequence
  source 1..20: mol_type = other DNA
cccggcccggccgcggggag

SEQ ID NO: 941 - DNA, 20 bp, synthetic construct
  misc_feature 1..20: note = CRISPR gRNA sequence
  source 1..20: mol_type = other DNA
gagaggcccaggcgccttta

SEQ ID NO: 942 - DNA, 20 bp, synthetic construct
  misc_feature 1..20: note = CRISPR gRNA sequence
  source 1..20: mol_type = other DNA
cgcctttacccggtttcatt

SEQ ID NO: 943 - DNA, 20 bp, synthetic construct
  misc_feature 1..20: note = CRISPR gRNA sequence
  source 1..20: mol_type = other DNA
gctgcgacgtggggtcggac

SEQ ID NO: 944 - DNA, 20 bp, synthetic construct
  misc_feature 1..20: note = CRISPR gRNA sequence
  source 1..20: mol_type = other DNA
cggcaggacgcctacgacgg

SEQ ID NO: 945 - DNA, 20 bp, synthetic construct
  misc_feature 1..20: note = CRISPR gRNA sequence
  source 1..20: mol_type = other DNA
ttttcctctcaggccttgtt

SEQ ID NO: 946 - DNA, 20 bp, synthetic construct
  misc_feature 1..20: note = CRISPR gRNA sequence
  source 1..20: mol_type = other DNA
ctgttcccttctcagggaat

SEQ ID NO: 947 - DNA, 20 bp, synthetic construct
  misc_feature 1..20: note = CRISPR gRNA sequence
  source 1..20: mol_type = other DNA
ccaccctgaggtgctgggcc

SEQ ID NO: 948 - DNA, 20 bp, synthetic construct
  misc_feature 1..20: note = CRISPR gRNA sequence
  source 1..20: mol_type = other DNA
gaaggggtgaagggtggggt

SEQ ID NO: 949 - DNA, 20 bp, synthetic construct
  misc_feature 1..20: note = CRISPR gRNA sequence
  source 1..20: mol_type = other DNA
agacagggcacatttctagc

SEQ ID NO: 950 - DNA, 20 bp, synthetic construct
  misc_feature 1..20: note = CRISPR gRNA sequence
  source 1..20: mol_type = other DNA
ctaaaggtctccagagaggc

SEQ ID NO: 951 - DNA, 20 bp, synthetic construct
  misc_feature 1..20: note = CRISPR gRNA sequence
  source 1..20: mol_type = other DNA
ccttaccccatctcagggtg

SEQ ID NO: 952 - DNA, 20 bp, synthetic construct
  misc_feature 1..20: note = CRISPR gRNA sequence
  source 1..20: mol_type = other DNA
tcgtcttcccgtcactcctt

SEQ ID NO: 953 - DNA, 20 bp, synthetic construct
  misc_feature 1..20: note = CRISPR gRNA sequence
  source 1..20: mol_type = other DNA
ggtacaggatctggaaccca

SEQ ID NO: 954 - DNA, 20 bp, synthetic construct
  misc_feature 1..20: note = CRISPR gRNA sequence
  source 1..20: mol_type = other DNA
cctcatgggccgcctcccac

SEQ ID NO: 955 - DNA, 20 bp, synthetic construct
  misc_feature 1..20: note = CRISPR gRNA sequence
  source 1..20: mol_type = other DNA
gcccagccccgaccaacccg

SEQ ID NO: 956 - DNA, 20 bp, synthetic construct
  misc_feature 1..20: note = CRISPR gRNA sequence
  source 1..20: mol_type = other DNA
gggcaagggtctcggggtcc

SEQ ID NO: 957 - DNA, 20 bp, synthetic construct
  misc_feature 1..20: note = CRISPR gRNA sequence
  source 1..20: mol_type = other DNA
gcgcccccgccaggagggcc

SEQ ID NO: 958 - DNA, 20 bp, synthetic construct
  misc_feature 1..20: note = CRISPR gRNA sequence
  source 1..20: mol_type = other DNA
cccttgcttctccccgcaga

SEQ ID NO: 959 - DNA, 20 bp, synthetic construct
  misc_feature 1..20: note = CRISPR gRNA sequence
  source 1..20: mol_type = other DNA
ctgagtcccggtgggtgcgt

SEQ ID NO: 960 - DNA, 20 bp, synthetic construct
  misc_feature 1..20: note = CRISPR gRNA sequence
  source 1..20: mol_type = other DNA
tagaacagcgaccgcgacga

SEQ ID NO: 961 - DNA, 20 bp, synthetic construct
  misc_feature 1..20: note = CRISPR gRNA sequence
  source 1..20: mol_type = other DNA
cagcgaccgcgacgacactg

SEQ ID NO: 962 - DNA, 20 bp, synthetic construct
  misc_feature 1..20: note = CRISPR gRNA sequence
  source 1..20: mol_type = other DNA
ggagacaattgggaccaaca

SEQ ID NO: 963 - DNA, 20 bp, synthetic construct
  misc_feature 1..20: note = CRISPR gRNA sequence
  source 1..20: mol_type = other DNA
ctgagggttccaagccccag

SEQ ID NO: 964 - DNA, 20 bp, synthetic construct
  misc_feature 1..20: note = CRISPR gRNA sequence
  source 1..20: mol_type = other DNA
gcttggaaccctcagtgaga

SEQ ID NO: 965 - DNA, 20 bp, synthetic construct
  misc_feature 1..20: note = CRISPR gRNA sequence
  source 1..20: mol_type = other DNA
ggggggtctgacgggaagag

SEQ ID NO: 966 - DNA, 20 bp, synthetic construct
  misc_feature 1..20: note = CRISPR gRNA sequence
  source 1..20: mol_type = other DNA
cagcacgcatgtggccatct

SEQ ID NO: 967 - DNA, 20 bp, synthetic construct
  misc_feature 1..20: note = CRISPR gRNA sequence
  source 1..20: mol_type = other DNA
ccgggccgggacacggatgt

SEQ ID NO: 968 - DNA, 20 bp, synthetic construct
  misc_feature 1..20: note = CRISPR gRNA sequence
  source 1..20: mol_type = other DNA
cggccatcctcggcgtctgg

SEQ ID NO: 969 - DNA, 20 bp, synthetic construct
  misc_feature 1..20: note = CRISPR gRNA sequence
  source 1..20: mol_type = other DNA
ccagagaagccaatcagtgt

SEQ ID NO: 970 - DNA, 20 bp, synthetic construct
  misc_feature 1..20: note = CRISPR gRNA sequence
  source 1..20: mol_type = other DNA
cagagaagccaatcagtgtc

SEQ ID NO: 971 - DNA, 20 bp, synthetic construct
  misc_feature 1..20: note = CRISPR gRNA sequence
  source 1..20: mol_type = other DNA
ttctaaagcccgcacgcacc

SEQ ID NO: 972 - DNA, 20 bp, synthetic construct
  misc_feature 1..20: note = CRISPR gRNA sequence
  source 1..20: mol_type = other DNA
taaagcccgcacgcacccac

SEQ ID NO: 973 - DNA, 20 bp, synthetic construct
  misc_feature 1..20: note = CRISPR gRNA sequence
  source 1..20: mol_type = other DNA
aagcccgcacgcacccaccg

SEQ ID NO: 974 - DNA, 20 bp, synthetic construct
  misc_feature 1..20: note = CRISPR gRNA sequence
  source 1..20: mol_type = other DNA
agattctccccagacgccga

SEQ ID NO: 975 - DNA, 20 bp, synthetic construct
  misc_feature 1..20: note = CRISPR gRNA sequence
  source 1..20: mol_type = other DNA
tccccagacgccgaggatgg

SEQ ID NO: 976 - DNA, 20 bp, synthetic construct
  misc_feature 1..20: note = CRISPR gRNA sequence
  source 1..20: mol_type = other DNA
cccagacgccgaggatggcc

SEQ ID NO: 977 - DNA, 20 bp, synthetic construct
  misc_feature 1..20: note = CRISPR gRNA sequence
  source 1..20: mol_type = other DNA
ctcctgctactctcgggggc

SEQ ID NO: 978 - DNA, 20 bp, synthetic construct
  misc_feature 1..20: note = CRISPR gRNA sequence
  source 1..20: mol_type = other DNA
ctgctactctcgggggccct

SEQ ID NO: 979 - DNA, 20 bp, synthetic construct
  misc_feature 1..20: note = CRISPR gRNA sequence
  source 1..20: mol_type = other DNA
ctactctcgggggccctggc

SEQ ID NO: 980 - DNA, 20 bp, synthetic construct
  misc_feature 1..20: note = CRISPR gRNA sequence
  source 1..20: mol_type = other DNA
ctctcgggggccctggccct

SEQ ID NO: 981 - DNA, 20 bp, synthetic construct
  misc_feature 1..20: note = CRISPR gRNA sequence
  source 1..20: mol_type = other DNA
tcgggggccctggccctgac

SEQ ID NO: 982 - DNA, 20 bp, synthetic construct
  misc_feature 1..20: note = CRISPR gRNA sequence
  source 1..20: mol_type = other DNA
gggggccctggccctgaccc

SEQ ID NO: 983 - DNA, 20 bp, synthetic construct
  misc_feature 1..20: note = CRISPR gRNA sequence
  source 1..20: mol_type = other DNA
gccctgacccagacctgggc

SEQ ID NO: 984 - DNA, 20 bp, synthetic construct
  misc_feature 1..20: note = CRISPR gRNA sequence
  source 1..20: mol_type = other DNA
acccagacctgggcgggtga

SEQ ID NO: 985 - DNA, 20 bp, synthetic construct
  misc_feature 1..20: note = CRISPR gRNA sequence
  source 1..20: mol_type = other DNA
ggcgggtgagtgcggggtcg

SEQ ID NO: 986 - DNA, 20 bp, synthetic construct
  misc_feature 1..20: note = CRISPR gRNA sequence
  source 1..20: mol_type = other DNA
tgcggggagaagcaaggggc

SEQ ID NO: 987 - DNA, 20 bp, synthetic construct
  misc_feature 1..20: note = CRISPR gRNA sequence
  source 1..20: mol_type = other DNA
cggggagaagcaaggggccc

SEQ ID NO: 988 - DNA, 20 bp, synthetic construct
  misc_feature 1..20: note = CRISPR gRNA sequence
  source 1..20: mol_type = other DNA
ctggcgggggcgcaggaccg

SEQ ID NO: 989 - DNA, 20 bp, synthetic construct
  misc_feature 1..20: note = CRISPR gRNA sequence
  source 1..20: mol_type = other DNA
gcgggggcgcaggaccgggg

SEQ ID NO: 990 - DNA, 20 bp, synthetic construct
  misc_feature 1..20: note = CRISPR gRNA sequence
  source 1..20: mol_type = other DNA
agccactgctcgcccccagg

SEQ ID NO: 991 - DNA, 20 bp, synthetic construct
  misc_feature 1..20: note = CRISPR gRNA sequence
  source 1..20: mol_type = other DNA
ctcgcccccaggctcccact

SEQ ID NO: 992 - DNA, 20 bp, synthetic construct
  misc_feature 1..20: note = CRISPR gRNA sequence
  source 1..20: mol_type = other DNA
gcccccaggctcccactcca

SEQ ID NO: 993 - DNA, 20 bp, synthetic construct
  misc_feature 1..20: note = CRISPR gRNA sequence
  source 1..20: mol_type = other DNA
ccactccatgaggtatttct

SEQ ID NO: 994 - DNA, 20 bp, synthetic construct
  misc_feature 1..20: note = CRISPR gRNA sequence
  source 1..20: mol_type = other DNA
catgaggtatttcttcacat

SEQ ID NO: 995 - DNA, 20 bp, synthetic construct
  misc_feature 1..20: note = CRISPR gRNA sequence
  source 1..20: mol_type = other DNA
cttcacatccgtgtcccggc

SEQ ID NO: 996 - DNA, 20 bp, synthetic construct
  misc_feature 1..20: note = CRISPR gRNA sequence
  source 1..20: mol_type = other DNA
ttcacatccgtgtcccggcc

SEQ ID NO: 997 - DNA, 20 bp, synthetic construct
  misc_feature 1..20: note = CRISPR gRNA sequence
  source 1..20: mol_type = other DNA
cacatccgtgtcccggcccg

SEQ ID NO: 998 - DNA, 20 bp, synthetic construct
  misc_feature 1..20: note = CRISPR gRNA sequence
  source 1..20: mol_type = other DNA
acatccgtgtcccggcccgg

SEQ ID NO: 999 - DNA, 20 bp, synthetic construct
  misc_feature 1..20: note = CRISPR gRNA sequence
  source 1..20: mol_type = other DNA
catcgccgtgggctacgtgg

SEQ ID NO: 1000 - DNA, 20 bp, synthetic construct
  misc_feature 1..20: note = CRISPR gRNA sequence
  source 1..20: mol_type = other DNA
atcgccgtgggctacgtgga

SEQ ID NO: 1001 - DNA, 20 bp, synthetic construct
  misc_feature 1..20: note = CRISPR gRNA sequence
  source 1..20: mol_type = other DNA
cgtggacgacacgcagttcg

SEQ ID NO: 1002 - DNA, 20 bp, synthetic construct
  misc_feature 1..20: note = CRISPR gRNA sequence
  source 1..20: mol_type = other DNA
gtgcggttcgacagcgacgc

SEQ ID NO: 1003 - DNA, 20 bp, synthetic construct
  misc_feature 1..20: note = CRISPR gRNA sequence
  source 1..20: mol_type = other DNA
gacagcgacgccgcgagcca

SEQ ID NO: 1004 - DNA, 20 bp, synthetic construct
  misc_feature 1..20: note = CRISPR gRNA sequence
  source 1..20: mol_type = other DNA
ggaccaggagacacggaatg

SEQ ID NO: 1005 - DNA, 20 bp, synthetic construct
  misc_feature 1..20: note = CRISPR gRNA sequence
  source 1..20: mol_type = other DNA
accgagtggacctggggacc

SEQ ID NO: 1006 - DNA, 20 bp, synthetic construct
  misc_feature 1..20: note = CRISPR gRNA sequence
  source 1..20: mol_type = other DNA
gggaccctgcgcggctacta

SEQ ID NO: 1007 - DNA, 20 bp, synthetic construct
  misc_feature 1..20: note = CRISPR gRNA sequence
  source 1..20: mol_type = other DNA
cgcggctactacaaccagag

SEQ ID NO: 1008 - DNA, 20 bp, synthetic construct
  misc_feature 1..20: note = CRISPR gRNA sequence
  source 1..20: mol_type = other DNA
ctacaaccagagcgaggccg

SEQ ID NO: 1009 - DNA, 20 bp, synthetic construct
  misc_feature 1..20: note = CRISPR gRNA sequence
  source 1..20: mol_type = other DNA
caaccagagcgaggccggtg

SEQ ID NO: 1010 - DNA, 20 bp, synthetic construct
  misc_feature 1..20: note = CRISPR gRNA sequence
  source 1..20: mol_type = other DNA
atcccccacggacgggccag

SEQ ID NO: 1011 - DNA, 20 bp, synthetic construct
  misc_feature 1..20: note = CRISPR gRNA sequence
  source 1..20: mol_type = other DNA
cgggtccgagatccaccccg

SEQ ID NO: 1012 - DNA, 20 bp, synthetic construct
  misc_feature 1..20: note = CRISPR gRNA sequence
  source 1..20: mol_type = other DNA
gccccgggagaggcccaggc

SEQ ID NO: 1013 - DNA, 20 bp, synthetic construct
  misc_feature 1..20: note = CRISPR gRNA sequence
  source 1..20: mol_type = other DNA
ccccgggagaggcccaggcg

SEQ ID NO: 1014 - DNA, 20 bp, synthetic construct
  misc_feature 1..20: note = CRISPR gRNA sequence
  source 1..20: mol_type = other DNA
tacccggtttcattttcagt

SEQ ID NO: 1015 - DNA, 20 bp, synthetic construct
  misc_feature 1..20: note = CRISPR gRNA sequence
  source 1..20: mol_type = other DNA
acccggtttcattttcagtt

SEQ ID NO: 1016 - DNA, 20 bp, synthetic construct
  misc_feature 1..20: note = CRISPR gRNA sequence
  source 1..20: mol_type = other DNA
cccggtttcattttcagttt

SEQ ID NO: 1017 - DNA, 20 bp, synthetic construct
  misc_feature 1..20: note = CRISPR gRNA sequence
  source 1..20: mol_type = other DNA
cattttcagtttaggccaaa

SEQ ID NO: 1018 - DNA, 20 bp, synthetic construct
  misc_feature 1..20: note = CRISPR gRNA sequence
  source 1..20: mol_type = other DNA
attttcagtttaggccaaaa

SEQ ID NO: 1019 - DNA, 20 bp, synthetic construct
  misc_feature 1..20: note = CRISPR gRNA sequence
  source 1..20: mol_type = other DNA
tcagtttaggccaaaaatcc

SEQ ID NO: 1020 - DNA, 20 bp, synthetic construct
  misc_feature 1..20: note = CRISPR gRNA sequence
  source 1..20: mol_type = other DNA
cagtttaggccaaaaatccc

SEQ ID NO: 1021 - DNA, 20 bp, synthetic construct
  misc_feature 1..20: note = CRISPR gRNA sequence
  source 1..20: mol_type = other DNA
agtttaggccaaaaatcccc

SEQ ID NO: 1022 - DNA, 20 bp, synthetic construct
  misc_feature 1..20: note = CRISPR gRNA sequence
  source 1..20: mol_type = other DNA
aggccaaaaatccccccggg

SEQ ID NO: 1023 - DNA, 20 bp, synthetic construct
  misc_feature 1..20: note = CRISPR gRNA sequence
  source 1..20: mol_type = other DNA
ggccaaaaatccccccgggt

SEQ ID NO: 1024 - DNA, 20 bp, synthetic construct
  misc_feature 1..20: note = CRISPR gRNA sequence
  source 1..20: mol_type = other DNA
gtcggggctgggcggggctc

SEQ ID NO: 1025 - DNA, 20 bp, synthetic construct
  misc_feature 1..20: note = CRISPR gRNA sequence
  source 1..20: mol_type = other DNA
ggcggggctcgggggactgg

SEQ ID NO: 1026 - DNA, 20 bp, synthetic construct
  misc_feature 1..20: note = CRISPR gRNA sequence
  source 1..20: mol_type = other DNA
gggggactgggctgaccgcg

SEQ ID NO: 1027 - DNA, 20 bp, synthetic construct
  misc_feature 1..20: note = CRISPR gRNA sequence
  source 1..20: mol_type = other DNA
ggctgaccgcggggtcgggg

SEQ ID NO: 1028 - DNA, 20 bp, synthetic construct
  misc_feature 1..20: note = CRISPR gRNA sequence
  source 1..20: mol_type = other DNA
accgcggggtcggggccagg

SEQ ID NO: 1029 - DNA, 20 bp, synthetic construct
  misc_feature 1..20: note = CRISPR gRNA sequence
  source 1..20: mol_type = other DNA
tcacaccatccagataatgt

SEQ ID NO: 1030 - DNA, 20 bp, synthetic construct
  misc_feature 1..20: note = CRISPR gRNA sequence
  source 1..20: mol_type = other DNA
acaccatccagataatgtat

SEQ ID NO: 1031 - DNA, 20 bp, synthetic construct
  misc_feature 1..20: note = CRISPR gRNA sequence
  source 1..20: mol_type = other DNA
cgacgtggggtcggacgggc

SEQ ID NO: 1032 - DNA, 20 bp, synthetic construct
  misc_feature 1..20: note = CRISPR gRNA sequence
  source 1..20: mol_type = other DNA
cctccgcgggtaccggcagg

SEQ ID NO: 1033 - DNA, 20 bp, synthetic construct
  misc_feature 1..20: note = CRISPR gRNA sequence
  source 1..20: mol_type = other DNA
ctccgcgggtaccggcagga

SEQ ID NO: 1034 - DNA, 20 bp, synthetic construct
  misc_feature 1..20: note = CRISPR gRNA sequence
  source 1..20: mol_type = other DNA
cgcgggtaccggcaggacgc

SEQ ID NO: 1035 - DNA, 20 bp, synthetic construct
  misc_feature 1..20: note = CRISPR gRNA sequence
  source 1..20: mol_type = other DNA
cgacggcaaggattacatcg

SEQ ID NO: 1036 - DNA, 20 bp, synthetic construct
  misc_feature 1..20: note = CRISPR gRNA sequence
  source 1..20: mol_type = other DNA
catcgccctgaacgaggacc

SEQ ID NO: 1037 - DNA, 20 bp, synthetic construct
  misc_feature 1..20: note = CRISPR gRNA sequence
  source 1..20: mol_type = other DNA
aacgaggacctgcgctcttg

SEQ ID NO: 1038 - DNA, 20 bp, synthetic construct
  misc_feature 1..20: note = CRISPR gRNA sequence
  source 1..20: mol_type = other DNA
cgctcttggaccgcggcgga

SEQ ID NO: 1039 - DNA, 20 bp, synthetic construct
  misc_feature 1..20: note = CRISPR gRNA sequence
  source 1..20: mol_type = other DNA
ttggaccgcggcggacatgg

SEQ ID NO: 1040 - DNA, 20 bp, synthetic construct
  misc_feature 1..20: note = CRISPR gRNA sequence
  source 1..20: mol_type = other DNA
ggaccgcggcggacatggcg

SEQ ID NO: 1041 - DNA, 20 bp, synthetic construct
  misc_feature 1..20: note = CRISPR gRNA sequence
  source 1..20: mol_type = other DNA
gaccgcggcggacatggcgg

SEQ ID NO: 1042 - DNA, 20 bp, synthetic construct
  misc_feature 1..20: note = CRISPR gRNA sequence
  source 1..20: mol_type = other DNA
agatcaccaagcgcaagtgg

SEQ ID NO: 1043 - DNA, 20 bp, synthetic construct
  misc_feature 1..20: note = CRISPR gRNA sequence
  source 1..20: mol_type = other DNA
agagcctacctggatggcac

SEQ ID NO: 1044 - DNA, 20 bp, synthetic construct
  misc_feature 1..20: note = CRISPR gRNA sequence
  source 1..20: mol_type = other DNA
cctggatggcacgtgcgtgg

SEQ ID NO: 1045 - DNA, 20 bp, synthetic construct
  misc_feature 1..20: note = CRISPR gRNA sequence
  source 1..20: mol_type = other DNA
gatggcacgtgcgtggagtg

SEQ ID NO: 1046 - DNA, 20 bp, synthetic construct
  misc_feature 1..20: note = CRISPR gRNA sequence
  source 1..20: mol_type = other DNA
cgcagatacctggagaacgg

SEQ ID NO: 1047 - DNA, 20 bp, synthetic construct
  misc_feature 1..20: note = CRISPR gRNA sequence
  source 1..20: mol_type = other DNA
gagaacgggaaggagacgct

SEQ ID NO: 1048 - DNA, 20 bp, synthetic construct
  misc_feature 1..20: note = CRISPR gRNA sequence
  source 1..20: mol_type = other DNA
cagcgcacgggtaccagggg

SEQ ID NO: 1049 - DNA, 20 bp, synthetic construct
  misc_feature 1..20: note = CRISPR gRNA sequence
  source 1..20: mol_type = other DNA
cctgatcgcctgtagatctc

SEQ ID NO: 1050 - DNA, 20 bp, synthetic construct
  misc_feature 1..20: note = CRISPR gRNA sequence
  source 1..20: mol_type = other DNA
atcgcctgtagatctcccgg

SEQ ID NO: 1051 - DNA, 20 bp, synthetic construct
  misc_feature 1..20: note = CRISPR gRNA sequence
  source 1..20: mol_type = other DNA
tagatctcccgggctggcct

SEQ ID NO: 1052 - DNA, 20 bp, synthetic construct
  misc_feature 1..20: note = CRISPR gRNA sequence
  source 1..20: mol_type = other DNA
ccgggctggcctcccacaag

SEQ ID NO: 1053 - DNA, 20 bp, synthetic construct
  misc_feature 1..20: note = CRISPR gRNA sequence
  source 1..20: mol_type = other DNA
gcctcccacaaggaggggag

SEQ ID NO: 1054 - DNA, 20 bp, synthetic construct
  misc_feature 1..20: note = CRISPR gRNA sequence
  source 1..20: mol_type = other DNA
ccacaaggaggggagacaat

SEQ ID NO: 1055 - DNA, 20 bp, synthetic construct
  misc_feature 1..20: note = CRISPR gRNA sequence
  source 1..20: mol_type = other DNA
ggaccaacactagaatatca

SEQ ID NO: 1056 - DNA, 20 bp, synthetic construct
  misc_feature 1..20: note = CRISPR gRNA sequence
  source 1..20: mol_type = other DNA
gaatatcaccctccctctgg

SEQ ID NO: 1057 - DNA, 20 bp, synthetic construct
  misc_feature 1..20: note = CRISPR gRNA sequence
  source 1..20: mol_type = other DNA
cctctggtcctgagggagag

SEQ ID NO: 1058 - DNA, 20 bp, synthetic construct
  misc_feature 1..20: note = CRISPR gRNA sequence
  source 1..20: mol_type = other DNA
tggtcctgagggagaggaat

SEQ ID NO: 1059 - DNA, 20 bp, synthetic construct
  misc_feature 1..20: note = CRISPR gRNA sequence
  source 1..20: mol_type = other DNA
gtcctgagggagaggaatcc

SEQ ID NO: 1060 - DNA, 20 bp, synthetic construct
  misc_feature 1..20: note = CRISPR gRNA sequence
  source 1..20: mol_type = other DNA
agggagaggaatcctcctgg

SEQ ID NO: 1061 - DNA, 20 bp, synthetic construct
  misc_feature 1..20: note = CRISPR gRNA sequence
  source 1..20: mol_type = other DNA
ctgggttccagatcctgtac

SEQ ID NO: 1062 - DNA, 20 bp, synthetic construct
  misc_feature 1..20: note = CRISPR gRNA sequence
  source 1..20: mol_type = other DNA
ggttccagatcctgtaccag

SEQ ID NO: 1063 - DNA, 20 bp, synthetic construct
  misc_feature 1..20: note = CRISPR gRNA sequence
  source 1..20: mol_type = other DNA
cagatcctgtaccagagagt

SEQ ID NO: 1064 - DNA, 20 bp, synthetic construct
  misc_feature 1..20: note = CRISPR gRNA sequence
  source 1..20: mol_type = other DNA
taccagagagtgactctgag

SEQ ID NO: 1065 - DNA, 20 bp, synthetic construct
  misc_feature 1..20: note = CRISPR gRNA sequence
  source 1..20: mol_type = other DNA
tgaggttccgccctgctctc

SEQ ID NO: 1066 - DNA, 20 bp, synthetic construct
  misc_feature 1..20: note = CRISPR gRNA sequence
  source 1..20: mol_type = other DNA
aggttccgccctgctctctg

SEQ ID NO: 1067 - DNA, 20 bp, synthetic construct
  misc_feature 1..20: note = CRISPR gRNA sequence
  source 1..20: mol_type = other DNA
cgccctgctctctgacacaa

SEQ ID NO: 1068 - DNA, 20 bp, synthetic construct
  misc_feature 1..20: note = CRISPR gRNA sequence
  source 1..20: mol_type = other DNA
ctctctgacacaattaaggg

SEQ ID NO: 1069 - DNA, 20 bp, synthetic construct
  misc_feature 1..20: note = CRISPR gRNA sequence
  source 1..20: mol_type = other DNA
tctgacacaattaagggata

SEQ ID NO: 1070 - DNA, 20 bp, synthetic construct
  misc_feature 1..20: note = CRISPR gRNA sequence
  source 1..20: mol_type = other DNA
tgacacaattaagggataaa

SEQ ID NO: 1071 - DNA, 20 bp, synthetic construct
  misc_feature 1..20: note = CRISPR gRNA sequence
  source 1..20: mol_type = other DNA
acacaattaagggataaaat

SEQ ID NO: 1072 - DNA, 20 bp, synthetic construct
  misc_feature 1..20: note = CRISPR gRNA sequence
  source 1..20: mol_type = other DNA
agggataaaatctctgaagg

SEQ ID NO: 1073 - DNA, 20 bp, synthetic construct
  misc_feature 1..20: note = CRISPR gRNA sequence
  source 1..20: mol_type = other DNA
tgaaggagtgacgggaagac

SEQ ID NO: 1074 - DNA, 20 bp, synthetic construct
  misc_feature 1..20: note = CRISPR gRNA sequence
  source 1..20: mol_type = other DNA
aaggagtgacgggaagacga

SEQ ID NO: 1075 - DNA, 20 bp, synthetic construct
  misc_feature 1..20: note = CRISPR gRNA sequence
  source 1..20: mol_type = other DNA
gaatactgatgagtggttcc

SEQ ID NO: 1076 - DNA, 20 bp, synthetic construct
  misc_feature 1..20: note = CRISPR gRNA sequence
  source 1..20: mol_type = other DNA
atgagtggttccctttgaca

SEQ ID NO: 1077 - DNA, 20 bp, synthetic construct
  misc_feature 1..20: note = CRISPR gRNA sequence
  source 1..20: mol_type = other DNA
cctttgacaccggcagcagc

SEQ ID NO: 1078 - DNA, 20 bp, synthetic construct
  misc_feature 1..20: note = CRISPR gRNA sequence
  source 1..20: mol_type = other DNA
tgacaccggcagcagccttg

SEQ ID NO: 1079 - DNA, 20 bp, synthetic construct
  misc_feature 1..20: note = CRISPR gRNA sequence
  source 1..20: mol_type = other DNA
gacaccggcagcagccttgg

SEQ ID NO: 1080 - DNA, 20 bp, synthetic construct
  misc_feature 1..20: note = CRISPR gRNA sequence
  source 1..20: mol_type = other DNA
acaccggcagcagccttggg

SEQ ID NO: 1081 - DNA, 20 bp, synthetic construct
  misc_feature 1..20: note = CRISPR gRNA sequence
  source 1..20: mol_type = other DNA
gggcccgtgacttttcctct

SEQ ID NO: 1082 - DNA, 20 bp, synthetic construct
  misc_feature 1..20: note = CRISPR gRNA sequence
  source 1..20: mol_type = other DNA
ggcccgtgacttttcctctc

SEQ ID NO: 1083 - DNA, 20 bp, synthetic construct
  misc_feature 1..20: note = CRISPR gRNA sequence
  source 1..20: mol_type = other DNA
ttcctctcaggccttgttct

SEQ ID NO: 1084 - DNA, 20 bp, synthetic construct
  misc_feature 1..20: note = CRISPR gRNA sequence
  source 1..20: mol_type = other DNA
tcctctcaggccttgttctc

SEQ ID NO: 1085 - DNA, 20 bp, synthetic construct
  misc_feature 1..20: note = CRISPR gRNA sequence
  source 1..20: mol_type = other DNA
cctctcaggccttgttctct

SEQ ID NO: 1086 - DNA, 20 bp, synthetic construct
  misc_feature 1..20: note = CRISPR gRNA sequence
  source 1..20: mol_type = other DNA
ctctcaggccttgttctctg

SEQ ID NO: 1087 - DNA, 20 bp, synthetic construct
  misc_feature 1..20: note = CRISPR gRNA sequence
  source 1..20: mol_type = other DNA
tcaggccttgttctctgctt

SEQ ID NO: 1088 - DNA, 20 bp, synthetic construct
  misc_feature 1..20: note = CRISPR gRNA sequence
  source 1..20: mol_type = other DNA
aggccttgttctctgcttca

SEQ ID NO: 1089 - DNA, 20 bp, synthetic construct
  misc_feature 1..20: note = CRISPR gRNA sequence
  source 1..20: mol_type = other DNA
gttctctgcttcacactcaa

SEQ ID NO: 1090 - DNA, 20 bp, synthetic construct
  misc_feature 1..20: note = CRISPR gRNA sequence
  source 1..20: mol_type = other DNA
ttctctgcttcacactcaat

SEQ ID NO: 1091 - DNA, 20 bp, synthetic construct
  misc_feature 1..20: note = CRISPR gRNA sequence
  source 1..20: mol_type = other DNA
tctgcttcacactcaatgtg

SEQ ID NO: 1092 - DNA, 20 bp, synthetic construct
  misc_feature 1..20: note = CRISPR gRNA sequence
  source 1..20: mol_type = other DNA
tgcttcacactcaatgtgtg

SEQ ID NO: 1093 - DNA, 20 bp, synthetic construct
  misc_feature 1..20: note = CRISPR gRNA sequence
  source 1..20: mol_type = other DNA
cttcacactcaatgtgtgtg

SEQ ID NO: 1094 - DNA, 20 bp, synthetic construct
  misc_feature 1..20: note = CRISPR gRNA sequence
  source 1..20: mol_type = other DNA
cacactcaatgtgtgtgggg

SEQ ID NO: 1095 - DNA, 20 bp, synthetic construct
  misc_feature 1..20: note = CRISPR gRNA sequence
  source 1..20: mol_type = other DNA
acactcaatgtgtgtggggg

SEQ ID NO: 1096 - DNA, 20 bp, synthetic construct
  misc_feature 1..20: note = CRISPR gRNA sequence
  source 1..20: mol_type = other DNA
aatgtgtgtgggggtctgag

SEQ ID NO: 1097 - DNA, 20 bp, synthetic construct
  misc_feature 1..20: note = CRISPR gRNA sequence
  source 1..20: mol_type = other DNA
agtccagcacttctgagtcc

SEQ ID NO: 1098 - DNA, 20 bp, synthetic construct
  misc_feature 1..20: note = CRISPR gRNA sequence
  source 1..20: mol_type = other DNA
ctgagtccctcagcctccac

SEQ ID NO: 1099 - DNA, 20 bp, synthetic construct
  misc_feature 1..20: note = CRISPR gRNA sequence
  source 1..20: mol_type = other DNA
tgagtccctcagcctccact

SEQ ID NO: 1100 - DNA, 20 bp, synthetic construct
  misc_feature 1..20: note = CRISPR gRNA sequence
  source 1..20: mol_type = other DNA
agtccctcagcctccactca

SEQ ID NO: 1101 - DNA, 20 bp, synthetic construct
  misc_feature 1..20: note = CRISPR gRNA sequence
  source 1..20: mol_type = other DNA
agcctccactcaggtcagga

SEQ ID NO: 1102 - DNA, 20 bp, synthetic construct
  misc_feature 1..20: note = CRISPR gRNA sequence
  source 1..20: mol_type = other DNA
cactcaggtcaggaccagaa

SEQ ID NO: 1103 - DNA, 20 bp, synthetic construct
  misc_feature 1..20: note = CRISPR gRNA sequence
  source 1..20: mol_type = other DNA
aggtcaggaccagaagtcgc

SEQ ID NO: 1104 - DNA, 20 bp, synthetic construct
  misc_feature 1..20: note = CRISPR gRNA sequence
  source 1..20: mol_type = other DNA
ttcccttctcagggaataga

SEQ ID NO: 1105 - DNA, 20 bp, synthetic construct
  misc_feature 1..20: note = CRISPR gRNA sequence
  source 1..20: mol_type = other DNA
ccttctcagggaatagaaga

SEQ ID NO: 1106 - DNA, 20 bp, synthetic construct
  misc_feature 1..20: note = CRISPR gRNA sequence
  source 1..20: mol_type = other DNA
ctcagggaatagaagattat

SEQ ID NO: 1107 - DNA, 20 bp, synthetic construct
  misc_feature 1..20: note = CRISPR gRNA sequence
  source 1..20: mol_type = other DNA
tcagggaatagaagattatc

SEQ ID NO: 1108 - DNA, 20 bp, synthetic construct
  misc_feature 1..20: note = CRISPR gRNA sequence
  source 1..20: mol_type = other DNA
agggaatagaagattatccc

SEQ ID NO: 1109 - DNA, 20 bp, synthetic construct
  misc_feature 1..20: note = CRISPR gRNA sequence
  source 1..20: mol_type = other DNA
tcccaggtgcctgtgtccag

SEQ ID NO: 1110 - DNA, 20 bp, synthetic construct
  misc_feature 1..20: note = CRISPR gRNA sequence
  source 1..20: mol_type = other DNA
tgtccaggctggtgtctggg

SEQ ID NO: 1111 - DNA, 20 bp, synthetic construct
  misc_feature 1..20: note = CRISPR gRNA sequence
  source 1..20: mol_type = other DNA
gtgtctgggttctgtgctct

SEQ ID NO: 1112 - DNA, 20 bp, synthetic construct
  misc_feature 1..20: note = CRISPR gRNA sequence
  source 1..20: mol_type = other DNA
ggttctgtgctctcttcccc

SEQ ID NO: 1113 - DNA, 20 bp, synthetic construct
  misc_feature 1..20: note = CRISPR gRNA sequence
  source 1..20: mol_type = other DNA
tgtgctctcttccccatccc

SEQ ID NO: 1114 - DNA, 20 bp, synthetic construct
  misc_feature 1..20: note = CRISPR gRNA sequence
  source 1..20: mol_type = other DNA
tgctctcttccccatcccgg

SEQ ID NO: 1115 - DNA, 20 bp, synthetic construct
  misc_feature 1..20: note = CRISPR gRNA sequence
  source 1..20: mol_type = other DNA
tcttccccatcccgggtgtc

SEQ ID NO: 1116 - DNA, 20 bp, synthetic construct
  misc_feature 1..20: note = CRISPR gRNA sequence
  source 1..20: mol_type = other DNA
ttccccatcccgggtgtcct

SEQ ID NO: 1117 - DNA, 20 bp, synthetic construct
  misc_feature 1..20: note = CRISPR gRNA sequence
  source 1..20: mol_type = other DNA
ccccatcccgggtgtcctgt

SEQ ID NO: 1118 - DNA, 20 bp, synthetic construct
  misc_feature 1..20: note = CRISPR gRNA sequence
  source 1..20: mol_type = other DNA
cccatcccgggtgtcctgtc

SEQ ID NO: 1119 - DNA, 20 bp, synthetic construct
  misc_feature 1..20: note = CRISPR gRNA sequence
  source 1..20: mol_type = other DNA
tccattctcaagatggccac

SEQ ID NO: 1120 - DNA, 20 bp, synthetic construct
  misc_feature 1..20: note = CRISPR gRNA sequence
  source 1..20: mol_type = other DNA
tcaagatggccacatgcgtg

SEQ ID NO: 1121 - DNA, 20 bp, synthetic construct
  misc_feature 1..20: note = CRISPR gRNA sequence
  source 1..20: mol_type = other DNA
aagatggccacatgcgtgct

SEQ ID NO: 1122 - DNA, 20 bp, synthetic construct
  misc_feature 1..20: note = CRISPR gRNA sequence
  source 1..20: mol_type = other DNA
gtggagtgtcccatgacaga

SEQ ID NO: 1123 - DNA, 20 bp, synthetic construct
  misc_feature 1..20: note = CRISPR gRNA sequence
  source 1..20: mol_type = other DNA
aattttctgactcttcccgt

SEQ ID NO: 1124 - DNA, 20 bp, synthetic construct
  misc_feature 1..20: note = CRISPR gRNA sequence
  source 1..20: mol_type = other DNA
tctgactcttcccgtcagac

SEQ ID NO: 1125 - DNA, 20 bp, synthetic construct
  misc_feature 1..20: note = CRISPR gRNA sequence
  source 1..20: mol_type = other DNA
ctgactcttcccgtcagacc

SEQ ID NO: 1126 - DNA, 20 bp, synthetic construct
  misc_feature 1..20: note = CRISPR gRNA sequence
  source 1..20: mol_type = other DNA
tgactcttcccgtcagaccc

SEQ ID NO: 1127 - DNA, 20 bp, synthetic construct
  misc_feature 1..20: note = CRISPR gRNA sequence
  source 1..20: mol_type = other DNA
actcttcccgtcagaccccc

SEQ ID NO: 1128 - DNA, 20 bp, synthetic construct
  misc_feature 1..20: note = CRISPR gRNA sequence
  source 1..20: mol_type = other DNA
ttcccgtcagacccccccaa

SEQ ID NO: 1129 - DNA, 20 bp, synthetic construct
  misc_feature 1..20: note = CRISPR gRNA sequence
  source 1..20: mol_type = other DNA
cccgtcagacccccccaaga

SEQ ID NO: 1130 - DNA, 20 bp, synthetic construct
  misc_feature 1..20: note = CRISPR gRNA sequence
  source 1..20: mol_type = other DNA
ccgtcagacccccccaagac

SEQ ID NO: 1131 - DNA, 20 bp, synthetic construct
  misc_feature 1..20: note = CRISPR gRNA sequence
  source 1..20: mol_type = other DNA
tgaccatgaggccaccctga

SEQ ID NO: 1132 - DNA, 20 bp, synthetic construct
  misc_feature 1..20: note = CRISPR gRNA sequence
  source 1..20: mol_type = other DNA
accatgaggccaccctgagg

SEQ ID NO: 1133 - DNA, 20 bp, synthetic construct
  misc_feature 1..20: note = CRISPR gRNA sequence
  source 1..20: mol_type = other DNA
aggtgctgggccctgggctt

SEQ ID NO: 1134 - DNA, 20 bp, synthetic construct
  misc_feature 1..20: note = CRISPR gRNA sequence
  source 1..20: mol_type = other DNA
ggccctgggcttctaccctg

SEQ ID NO: 1135 - DNA, 20 bp, synthetic construct
  misc_feature 1..20: note = CRISPR gRNA sequence
  source 1..20: mol_type = other DNA
ggcttctaccctgcggagat

SEQ ID NO: 1136 - DNA, 20 bp, synthetic construct
  misc_feature 1..20: note = CRISPR gRNA sequence
  source 1..20: mol_type = other DNA
ctaccctgcggagatcacac

SEQ ID NO: 1137 - DNA, 20 bp, synthetic construct
  misc_feature 1..20: note = CRISPR gRNA sequence
  source 1..20: mol_type = other DNA
taccctgcggagatcacact

SEQ ID NO: 1138 - DNA, 20 bp, synthetic construct
  misc_feature 1..20: note = CRISPR gRNA sequence
  source 1..20: mol_type = other DNA
ccctgcggagatcacactga

SEQ ID NO: 1139 - DNA, 20 bp, synthetic construct
  misc_feature 1..20: note = CRISPR gRNA sequence
  source 1..20: mol_type = other DNA
cggagatcacactgacctgg

SEQ ID NO: 1140 - DNA, 20 bp, synthetic construct
  misc_feature 1..20: note = CRISPR gRNA sequence
  source 1..20: mol_type = other DNA
acctggcagcgggatgggga

SEQ ID NO: 1141 - DNA, 20 bp, synthetic construct
  misc_feature 1..20: note = CRISPR gRNA sequence
  source 1..20: mol_type = other DNA
gcagcgggatggggaggacc

SEQ ID NO: 1142 - DNA, 20 bp, synthetic construct
  misc_feature 1..20: note = CRISPR gRNA sequence
  source 1..20: mol_type = other DNA
gtggagaccaggcctgcagg

SEQ ID NO: 1143 - DNA, 20 bp, synthetic construct
  misc_feature 1..20: note = CRISPR gRNA sequence
  source 1..20: mol_type = other DNA
caggggatggaaccttccag

SEQ ID NO: 1144 - DNA, 20 bp, synthetic construct
  misc_feature 1..20: note = CRISPR gRNA sequence
  source 1..20: mol_type = other DNA
ccagaagtgggcggctgtgg

SEQ ID NO: 1145 - DNA, 20 bp, synthetic construct
  misc_feature 1..20: note = CRISPR gRNA sequence
  source 1..20: mol_type = other DNA
cagaagtgggcggctgtggt

SEQ ID NO: 1146 - DNA, 20 bp, synthetic construct
  misc_feature 1..20: note = CRISPR gRNA sequence
  source 1..20: mol_type = other DNA
tggtggtgccttctggagag

SEQ ID NO: 1147 - DNA, 20 bp, synthetic construct
  misc_feature 1..20: note = CRISPR gRNA sequence
  source 1..20: mol_type = other DNA
ctggagaggagcagagatac

SEQ ID NO: 1148 - DNA, 20 bp, synthetic construct
  misc_feature 1..20: note = CRISPR gRNA sequence
  source 1..20: mol_type = other DNA
tggagaggagcagagataca

SEQ ID NO: 1149 - DNA, 20 bp, synthetic construct
  misc_feature 1..20: note = CRISPR gRNA sequence
  source 1..20: mol_type = other DNA
gagaggagcagagatacacc

SEQ ID NO: 1150 - DNA, 20 bp, synthetic construct
  misc_feature 1..20: note = CRISPR gRNA sequence
  source 1..20: mol_type = other DNA
ccatgtgcagcatgagggtc

SEQ ID NO: 1151 - DNA, 20 bp, synthetic construct
  misc_feature 1..20: note = CRISPR gRNA sequence
  source 1..20: mol_type = other DNA
cccaagcccctcaccctgag

SEQ ID NO: 1152 - DNA, 20 bp, synthetic construct
  misc_feature 1..20: note = CRISPR gRNA sequence
  source 1..20: mol_type = other DNA
accctgagatggggtaagga

SEQ ID NO: 1153 - DNA, 20 bp, synthetic construct
  misc_feature 1..20: note = CRISPR gRNA sequence
  source 1..20: mol_type = other DNA
agatggggtaaggagggaga

SEQ ID NO: 1154 - DNA, 20 bp, synthetic construct
  misc_feature 1..20: note = CRISPR gRNA sequence
  source 1..20: mol_type = other DNA
ttagggaaagcaggagcctc

SEQ ID NO: 1155 - DNA, 20 bp, synthetic construct
  misc_feature 1..20: note = CRISPR gRNA sequence
  source 1..20: mol_type = other DNA
agggaaagcaggagcctctc

SEQ ID NO: 1156 - DNA, 20 bp, synthetic construct
  misc_feature 1..20: note = CRISPR gRNA sequence
  source 1..20: mol_type = other DNA
gggaaagcaggagcctctct

SEQ ID NO: 1157 - DNA, 20 bp, synthetic construct
  misc_feature 1..20: note = CRISPR gRNA sequence
  source 1..20: mol_type = other DNA
tctggagacctttagcaggg

SEQ ID NO: 1158 - DNA, 20 bp, synthetic construct
  misc_feature 1..20: note = CRISPR gRNA sequence
  source 1..20: mol_type = other DNA
tggagacctttagcagggtc

SEQ ID NO: 1159 - DNA, 20 bp, synthetic construct
  misc_feature 1..20: note = CRISPR gRNA sequence
  source 1..20: mol_type = other DNA
gagacctttagcagggtcag

SEQ ID NO: 1160 - DNA, 20 bp, synthetic construct
  misc_feature 1..20: note = CRISPR gRNA sequence
  source 1..20: mol_type = other DNA
tagcagggtcagggcccctc

SEQ ID NO: 1161 - DNA, 20 bp, synthetic construct
  misc_feature 1..20: note = CRISPR gRNA sequence
  source 1..20: mol_type = other DNA
agcagggtcagggcccctca

SEQ ID NO: 1162 - DNA, 20 bp, synthetic construct
  misc_feature 1..20: note = CRISPR gRNA sequence
  source 1..20: mol_type = other DNA
gcagggtcagggcccctcac

SEQ ID NO: 1163 - DNA, 20 bp, synthetic construct
  misc_feature 1..20: note = CRISPR gRNA sequence
  source 1..20: mol_type = other DNA
accttcccctcttttcccag

SEQ ID NO: 1164 - DNA, 20 bp, synthetic construct
  misc_feature 1..20: note = CRISPR gRNA sequence
  source 1..20: mol_type = other DNA
cccctcttttcccagagctg

SEQ ID NO: 1165 - DNA, 20 bp, synthetic construct
  misc_feature 1..20: note = CRISPR gRNA sequence
  source 1..20: mol_type = other DNA
ccctcttttcccagagctgt

SEQ ID NO: 1166 - DNA, 20 bp, synthetic construct
  misc_feature 1..20: note = CRISPR gRNA sequence
  source 1..20: mol_type = other DNA
ttttcccagagctgtcttcc

SEQ ID NO: 1167 - DNA, 20 bp, synthetic construct
  misc_feature 1..20: note = CRISPR gRNA sequence
  source 1..20: mol_type = other DNA
ttcccagagctgtcttccca

SEQ ID NO: 1168 - DNA, 20 bp, synthetic construct
  misc_feature 1..20: note = CRISPR gRNA sequence
  source 1..20: mol_type = other DNA
tcccagagctgtcttcccag

SEQ ID NO: 1169 - DNA, 20 bp, synthetic construct
  misc_feature 1..20: note = CRISPR gRNA sequence
  source 1..20: mol_type = other DNA
cccagagctgtcttcccagc

SEQ ID NO: 1170 - DNA, 20 bp, synthetic construct
  misc_feature 1..20: note = CRISPR gRNA sequence
  source 1..20: mol_type = other DNA
ccagagctgtcttcccagcc

SEQ ID NO: 1171 - DNA, 20 bp, synthetic construct
  misc_feature 1..20: note = CRISPR gRNA sequence
  source 1..20: mol_type = other DNA
tcttcccagcccaccatccc

SEQ ID NO: 1172 - DNA, 20 bp, synthetic construct
  misc_feature 1..20: note = CRISPR gRNA sequence
  source 1..20: mol_type = other DNA
cccagcccaccatccccatc

SEQ ID NO: 1173 - DNA, 20 bp, synthetic construct
  misc_feature 1..20: note = CRISPR gRNA sequence
  source 1..20: mol_type = other DNA
ccagcccaccatccccatcg

SEQ ID NO: 1174 - DNA, 20 bp, synthetic construct
  misc_feature 1..20: note = CRISPR gRNA sequence
  source 1..20: mol_type = other DNA
ctggcctggttctccttgga

SEQ ID NO: 1175 - DNA, 20 bp, synthetic construct
  misc_feature 1..20: note = CRISPR gRNA sequence
  source 1..20: mol_type = other DNA
gcctggttctccttggagct

SEQ ID NO: 1176 - DNA, 20 bp, synthetic construct
  misc_feature 1..20: note = CRISPR gRNA sequence
  source 1..20: mol_type = other DNA
gttctccttggagctgtgat

SEQ ID NO: 1177 - DNA, 20 bp, synthetic construct
  misc_feature 1..20: note = CRISPR gRNA sequence
  source 1..20: mol_type = other DNA
tccttggagctgtgatcact

SEQ ID NO: 1178 - DNA, 20 bp, synthetic construct
  misc_feature 1..20: note = CRISPR gRNA sequence
  source 1..20: mol_type = other DNA
cttggagctgtgatcactgg

SEQ ID NO: 1179 - DNA, 20 bp, synthetic construct
  misc_feature 1..20: note = CRISPR gRNA sequence
  source 1..20: mol_type = other DNA
ggagctgtgatcactggagc

SEQ ID NO: 1180 - DNA, 20 bp, synthetic construct
  misc_feature 1..20: note = CRISPR gRNA sequence
  source 1..20: mol_type = other DNA
gagctgtgatcactggagct

SEQ ID NO: 1181 - DNA, 20 bp, synthetic construct
  misc_feature 1..20: note = CRISPR gRNA sequence
  source 1..20: mol_type = other DNA
tgatcactggagctgtggtc

SEQ ID NO: 1182 - DNA, 20 bp, synthetic construct
  misc_feature 1..20: note = CRISPR gRNA sequence
  source 1..20: mol_type = other DNA
gagctgtggtcgctgccgtg

SEQ ID NO: 1183 - DNA, 20 bp, synthetic construct
  misc_feature 1..20: note = CRISPR gRNA sequence
  source 1..20: mol_type = other DNA
tggtcgctgccgtgatgtgg

SEQ ID NO: 1184 - DNA, 20 bp, synthetic construct
  misc_feature 1..20: note = CRISPR gRNA sequence
  source 1..20: mol_type = other DNA
ccgtgatgtggaggaggaag

SEQ ID NO: 1185 - DNA, 20 bp, synthetic construct
  misc_feature 1..20: note = CRISPR gRNA sequence
  source 1..20: mol_type = other DNA
aggtggagaaggggtgaagg

SEQ ID NO: 1186 - DNA, 20 bp, synthetic construct
  misc_feature 1..20: note = CRISPR gRNA sequence
  source 1..20: mol_type = other DNA
agatttcttgtctcactgag

SEQ ID NO: 1187 - DNA, 20 bp, synthetic construct
  misc_feature 1..20: note = CRISPR gRNA sequence
  source 1..20: mol_type = other DNA
cttgtctcactgagggttcc

SEQ ID NO: 1188 - DNA, 20 bp, synthetic construct
  misc_feature 1..20: note = CRISPR gRNA sequence
  source 1..20: mol_type = other DNA
ttgtctcactgagggttcca

SEQ ID NO: 1189 - DNA, 20 bp, synthetic construct
  misc_feature 1..20: note = CRISPR gRNA sequence
  source 1..20: mol_type = other DNA
gtctcactgagggttccaag

SEQ ID NO: 1190 - DNA, 20 bp, synthetic construct
  misc_feature 1..20: note = CRISPR gRNA sequence
  source 1..20: mol_type = other DNA
tctcactgagggttccaagc

SEQ ID NO: 1191 - DNA, 20 bp, synthetic construct
  misc_feature 1..20: note = CRISPR gRNA sequence
  source 1..20: mol_type = other DNA
actgagggttccaagcccca

SEQ ID NO: 1192 - DNA, 20 bp, synthetic construct
  misc_feature 1..20: note = CRISPR gRNA sequence
  source 1..20: mol_type = other DNA
agggttccaagccccagcta

SEQ ID NO: 1193 - DNA, 20 bp, synthetic construct
  misc_feature 1..20: note = CRISPR gRNA sequence
  source 1..20: mol_type = other DNA
caagccccagctagaaatgt

SEQ ID NO: 1194 - DNA, 20 bp, synthetic construct
  misc_feature 1..20: note = CRISPR gRNA sequence
  source 1..20: mol_type = other DNA
gaaatgtgccctgtctcatt

SEQ ID NO: 1195 - DNA, 20 bp, synthetic construct
  misc_feature 1..20: note = CRISPR gRNA sequence
  source 1..20: mol_type = other DNA
tctcattactgggaagcacc

SEQ ID NO: 1196 - DNA, 20 bp, synthetic construct
  misc_feature 1..20: note = CRISPR gRNA sequence
  source 1..20: mol_type = other DNA
cccagtaatgagacagggca

SEQ ID NO: 1197 - DNA, 20 bp, synthetic construct
  misc_feature 1..20: note = CRISPR gRNA sequence
  source 1..20: mol_type = other DNA
ccagtaatgagacagggcac

SEQ ID NO: 1198 - DNA, 20 bp, synthetic construct
  misc_feature 1..20: note = CRISPR gRNA sequence
  source 1..20: mol_type = other DNA
ctagctggggcttggaaccc

SEQ ID NO: 1199 - DNA, 20 bp, synthetic construct
  misc_feature 1..20: note = CRISPR gRNA sequence
  source 1..20: mol_type = other DNA
tagctggggcttggaaccct

SEQ ID NO: 1200 - DNA, 20 bp, synthetic construct
  misc_feature 1..20: note = CRISPR gRNA sequence
  source 1..20: mol_type = other DNA
gctggggcttggaaccctca

SEQ ID NO: 1201 - DNA, 20 bp, synthetic construct
  misc_feature 1..20: note = CRISPR gRNA sequence
  source 1..20: mol_type = other DNA
gggcttggaaccctcagtga

SEQ ID NO: 1202 - DNA, 20 bp, synthetic construct
  misc_feature 1..20: note = CRISPR gRNA sequence
  source 1..20: mol_type = other DNA
ggaaccctcagtgagacaag

SEQ ID NO: 1203 - DNA, 20 bp, synthetic construct
  misc_feature 1..20: note = CRISPR gRNA sequence
  source 1..20: mol_type = other DNA
gaaccctcagtgagacaaga

SEQ ID NO: 1204 - DNA, 20 bp, synthetic construct
  misc_feature 1..20: note = CRISPR gRNA sequence
  source 1..20: mol_type = other DNA
agtgagacaagaaatctcag

SEQ ID NO: 1205 - DNA, 20 bp, synthetic construct
  misc_feature 1..20: note = CRISPR gRNA sequence
  source 1..20: mol_type = other DNA
agaccccacccttcacccct

SEQ ID NO: 1206 - DNA, 20 bp, synthetic construct
  misc_feature 1..20: note = CRISPR gRNA sequence
  source 1..20: mol_type = other DNA
caccccttctccacctgagc

SEQ ID NO: 1207 - DNA, 20 bp, synthetic construct
  misc_feature 1..20: note = CRISPR gRNA sequence
  source 1..20: mol_type = other DNA
accccttctccacctgagct

SEQ ID NO: 1208 - DNA, 20 bp, synthetic construct
  misc_feature 1..20: note = CRISPR gRNA sequence
  source 1..20: mol_type = other DNA
ctccacctgagctcttcctc

SEQ ID NO: 1209 - DNA, 20 bp, synthetic construct
  misc_feature 1..20: note = CRISPR gRNA sequence
  source 1..20: mol_type = other DNA
tccacctgagctcttcctcc

SEQ ID NO: 1210 - DNA, 20 bp, synthetic construct
  misc_feature 1..20: note = CRISPR gRNA sequence
  source 1..20: mol_type = other DNA
cacctgagctcttcctcctc

SEQ ID NO: 1211 - DNA, 20 bp, synthetic construct
  misc_feature 1..20: note = CRISPR gRNA sequence
  source 1..20: mol_type = other DNA
agctcttcctcctccacatc

SEQ ID NO: 1212 - DNA, 20 bp, synthetic construct
  misc_feature 1..20: note = CRISPR gRNA sequence
  source 1..20: mol_type = other DNA
ttcctcctccacatcacggc

SEQ ID NO: 1213 - DNA, 20 bp, synthetic construct
  misc_feature 1..20: note = CRISPR gRNA sequence
  source 1..20: mol_type = other DNA
cctcctccacatcacggcag

SEQ ID NO: 1214 - DNA, 20 bp, synthetic construct
  misc_feature 1..20: note = CRISPR gRNA sequence
  source 1..20: mol_type = other DNA
ctcctccacatcacggcagc

SEQ ID NO: 1215 - DNA, 20 bp, synthetic construct
  misc_feature 1..20: note = CRISPR gRNA sequence
  source 1..20: mol_type = other DNA
ctccacatcacggcagcgac

SEQ ID NO: 1216 - DNA, 20 bp, synthetic construct
  misc_feature 1..20: note = CRISPR gRNA sequence
  source 1..20: mol_type = other DNA
cacatcacggcagcgaccac

SEQ ID NO: 1217 - DNA, 20 bp, synthetic construct
  misc_feature 1..20: note = CRISPR gRNA sequence
  source 1..20: mol_type = other DNA
cagtgatcacagctccaagg

SEQ ID NO: 1218 - DNA, 20 bp, synthetic construct
  misc_feature 1..20: note = CRISPR gRNA sequence
  source 1..20: mol_type = other DNA
caaggagaaccaggccagca

SEQ ID NO: 1219 - DNA, 20 bp, synthetic construct
  misc_feature 1..20: note = CRISPR gRNA sequence
  source 1..20: mol_type = other DNA
ggaagacagctctgggaaaa

SEQ ID NO: 1220 - DNA, 20 bp, synthetic construct
  misc_feature 1..20: note = CRISPR gRNA sequence
  source 1..20: mol_type = other DNA
tgggaaaagaggggaaggtg

SEQ ID NO: 1221 - DNA, 20 bp, synthetic construct
  misc_feature 1..20: note = CRISPR gRNA sequence
  source 1..20: mol_type = other DNA
ggaaaagaggggaaggtgag

SEQ ID NO: 1222 - DNA, 20 bp, synthetic construct
  misc_feature 1..20: note = CRISPR gRNA sequence
  source 1..20: mol_type = other DNA
accctgctaaaggtctccag

SEQ ID NO: 1223 - DNA, 20 bp, synthetic construct
  misc_feature 1..20: note = CRISPR gRNA sequence
  source 1..20: mol_type = other DNA
ctaaaggtctccagagaggc

SEQ ID NO: 1224 - DNA, 20 bp, synthetic construct
  misc_feature 1..20: note = CRISPR gRNA sequence
  source 1..20: mol_type = other DNA
aaggtctccagagaggctcc

SEQ ID NO: 1225 - DNA, 20 bp, synthetic construct
  misc_feature 1..20: note = CRISPR gRNA sequence
  source 1..20: mol_type = other DNA
cagagaggctcctgctttcc

SEQ ID NO: 1226 - DNA, 20 bp, synthetic construct
  misc_feature 1..20: note = CRISPR gRNA sequence
  source 1..20: mol_type = other DNA
ctgctttccctaagagacat

SEQ ID NO: 1227 - DNA, 20 bp, synthetic construct
  misc_feature 1..20: note = CRISPR gRNA sequence
  source 1..20: mol_type = other DNA
ctttccctaagagacatgac

SEQ ID NO: 1228 - DNA, 20 bp, synthetic construct
  misc_feature 1..20: note = CRISPR gRNA sequence
  source 1..20: mol_type = other DNA
tccctaagagacatgacacc

SEQ ID NO: 1229 - DNA, 20 bp, synthetic construct
  misc_feature 1..20: note = CRISPR gRNA sequence
  source 1..20: mol_type = other DNA
ccctaagagacatgacaccc

SEQ ID NO: 1230 - DNA, 20 bp, synthetic construct
  misc_feature 1..20: note = CRISPR gRNA sequence
  source 1..20: mol_type = other DNA
cctaagagacatgacacccc

SEQ ID NO: 1231 - DNA, 20 bp, synthetic construct
  misc_feature 1..20: note = CRISPR gRNA sequence
  source 1..20: mol_type = other DNA
agagacatgacacccccatc

SEQ ID NO: 1232 - DNA, 20 bp, synthetic construct
  misc_feature 1..20: note = CRISPR gRNA sequence
  source 1..20: mol_type = other DNA
cctccttaccccatctcagg

SEQ ID NO: 1233 - DNA, 20 bp, synthetic construct
  misc_feature 1..20: note = CRISPR gRNA sequence
  source 1..20: mol_type = other DNA
cttaccccatctcagggtga

SEQ ID NO: 1234 - DNA, 20 bp, synthetic construct
  misc_feature 1..20: note = CRISPR gRNA sequence
  source 1..20: mol_type = other DNA
accccatctcagggtgaggg

SEQ ID NO: 1235 - DNA, 20 bp, synthetic construct
  misc_feature 1..20: note = CRISPR gRNA sequence
  source 1..20: mol_type = other DNA
ccccatctcagggtgagggg

SEQ ID NO: 1236 - DNA, 20 bp, synthetic construct
  misc_feature 1..20: note = CRISPR gRNA sequence
  source 1..20: mol_type = other DNA
agggtgaggggcttgggcag

SEQ ID NO: 1237 - DNA, 20 bp, synthetic construct
  misc_feature 1..20: note = CRISPR gRNA sequence
  source 1..20: mol_type = other DNA
gggcagaccctcatgctgca

SEQ ID NO: 1238 - DNA, 20 bp, synthetic construct
  misc_feature 1..20: note = CRISPR gRNA sequence
  source 1..20: mol_type = other DNA
ggcagaccctcatgctgcac

SEQ ID NO: 1239 - DNA, 20 bp, synthetic construct
  misc_feature 1..20: note = CRISPR gRNA sequence
  source 1..20: mol_type = other DNA
atgctgcacatggcaggtgt

SEQ ID NO: 1240 - DNA, 20 bp, synthetic construct
  misc_feature 1..20: note = CRISPR gRNA sequence
  source 1..20: mol_type = other DNA
cacatggcaggtgtatctct

SEQ ID NO: 1241 - DNA, 20 bp, synthetic construct
  misc_feature 1..20: note = CRISPR gRNA sequence
  source 1..20: mol_type = other DNA
tgctcctctccagaaggcac

SEQ ID NO: 1242 - DNA, 20 bp, synthetic construct
  misc_feature 1..20: note = CRISPR gRNA sequence
  source 1..20: mol_type = other DNA
ctcctctccagaaggcacca

SEQ ID NO: 1243 - DNA, 20 bp, synthetic construct
  misc_feature 1..20: note = CRISPR gRNA sequence
  source 1..20: mol_type = other DNA
ctctccagaaggcaccacca

SEQ ID NO: 1244 - DNA, 20 bp, synthetic construct
  misc_feature 1..20: note = CRISPR gRNA sequence
  source 1..20: mol_type = other DNA
tccagaaggcaccaccacag

SEQ ID NO: 1245 - DNA, 20 bp, synthetic construct
  misc_feature 1..20: note = CRISPR gRNA sequence
  source 1..20: mol_type = other DNA
cagaaggcaccaccacagcc

SEQ ID NO: 1246 - DNA, 20 bp, synthetic construct
  misc_feature 1..20: note = CRISPR gRNA sequence
  source 1..20: mol_type = other DNA
ctggaaggttccatcccctg

SEQ ID NO: 1247 - DNA, 20 bp, synthetic construct
  misc_feature 1..20: note = CRISPR gRNA sequence
  source 1..20: mol_type = other DNA
tggaaggttccatcccctgc

SEQ ID NO: 1248 - DNA, 20 bp, synthetic construct
  misc_feature 1..20: note = CRISPR gRNA sequence
  source 1..20: mol_type = other DNA
gaaggttccatcccctgcag

SEQ ID NO: 1249 - DNA, 20 bp, synthetic construct
  misc_feature 1..20: note = CRISPR gRNA sequence
  source 1..20: mol_type = other DNA
catcccctgcaggcctggtc

SEQ ID NO: 1250 - DNA, 20 bp, synthetic construct
  misc_feature 1..20: note = CRISPR gRNA sequence
  source 1..20: mol_type = other DNA
caggcctggtctccacgagc

SEQ ID NO: 1251 - DNA, 20 bp, synthetic construct
  misc_feature 1..20: note = CRISPR gRNA sequence
  source 1..20: mol_type = other DNA
gtctccacgagctccgtgtc

SEQ ID NO: 1252 - DNA, 20 bp, synthetic construct
  misc_feature 1..20: note = CRISPR gRNA sequence
  source 1..20: mol_type = other DNA
cacgagctccgtgtcctggg

SEQ ID NO: 1253 - DNA, 20 bp, synthetic construct
  misc_feature 1..20: note = CRISPR gRNA sequence
  source 1..20: mol_type = other DNA
cgtgtcctgggtctggtcct

SEQ ID NO: 1254 - DNA, 20 bp, synthetic construct
  misc_feature 1..20: note = CRISPR gRNA sequence
  source 1..20: mol_type = other DNA
ggtctggtcctccccatccc

SEQ ID NO: 1255 - DNA, 20 bp, synthetic construct
  misc_feature 1..20: note = CRISPR gRNA sequence
  source 1..20: mol_type = other DNA
gtcctccccatcccgctgcc

SEQ ID NO: 1256 - DNA, 20 bp, synthetic construct
  misc_feature 1..20: note = CRISPR gRNA sequence
  source 1..20: mol_type = other DNA
cccatcccgctgccaggtca

SEQ ID NO: 1257 - DNA, 20 bp, synthetic construct
  misc_feature 1..20: note = CRISPR gRNA sequence
  source 1..20: mol_type = other DNA
ccaggtcagtgtgatctccg

SEQ ID NO: 1258 - DNA, 20 bp, synthetic construct
  misc_feature 1..20: note = CRISPR gRNA sequence
  source 1..20: mol_type = other DNA
cgcagggtagaagcccaggg

SEQ ID NO: 1259 - DNA, 20 bp, synthetic construct
  misc_feature 1..20: note = CRISPR gRNA sequence
  source 1..20: mol_type = other DNA
agggtggcctcatggtcaga

SEQ ID NO: 1260 - DNA, 20 bp, synthetic construct
  misc_feature 1..20: note = CRISPR gRNA sequence
  source 1..20: mol_type = other DNA
atggtcagagatggggtggt

SEQ ID NO: 1261 - DNA, 20 bp, synthetic construct
  misc_feature 1..20: note = CRISPR gRNA sequence
  source 1..20: mol_type = other DNA
gggggggtctgacgggaaga

SEQ ID NO: 1262 - DNA, 20 bp, synthetic construct
  misc_feature 1..20: note = CRISPR gRNA sequence
  source 1..20: mol_type = other DNA
ggggggtctgacgggaagag

SEQ ID NO: 1263 - DNA, 20 bp, synthetic construct
  misc_feature 1..20: note = CRISPR gRNA sequence
  source 1..20: mol_type = other DNA
acgggaagagtcagaaaatt

SEQ ID NO: 1264 - DNA, 20 bp, synthetic construct
  misc_feature 1..20: note = CRISPR gRNA sequence
  source 1..20: mol_type = other DNA
aggcattttgcatctgtcat

SEQ ID NO: 1265 - DNA, 20 bp, synthetic construct
  misc_feature 1..20: note = CRISPR gRNA sequence
  source 1..20: mol_type = other DNA
tgcatctgtcatgggacact

SEQ ID NO: 1266 - DNA, 20 bp, synthetic construct
  misc_feature 1..20: note = CRISPR gRNA sequence
  source 1..20: mol_type = other DNA
gcatctgtcatgggacactc

SEQ ID NO: 1267 - DNA, 20 bp, synthetic construct
  misc_feature 1..20: note = CRISPR gRNA sequence
  source 1..20: mol_type = other DNA
catctgtcatgggacactcc

SEQ ID NO: 1268 - DNA, 20 bp, synthetic construct
  misc_feature 1..20: note = CRISPR gRNA sequence
  source 1..20: mol_type = other DNA
tcatgggacactccaccagc

SEQ ID NO: 1269 - DNA, 20 bp, synthetic construct
  misc_feature 1..20: note = CRISPR gRNA sequence
  source 1..20: mol_type = other DNA
caccagcacgcatgtggcca

SEQ ID NO: 1270 - DNA, 20 bp, synthetic construct
  misc_feature 1..20: note = CRISPR gRNA sequence
  source 1..20: mol_type = other DNA
gagaatggacaggacacccg

SEQ ID NO: 1271 - DNA, 20 bp, synthetic construct
  misc_feature 1..20: note = CRISPR gRNA sequence
  source 1..20: mol_type = other DNA
agaatggacaggacacccgg

SEQ ID NO: 1272 - DNA, 20 bp, synthetic construct
  misc_feature 1..20: note = CRISPR gRNA sequence
  source 1..20: mol_type = other DNA
gacacaggcacctgggataa

SEQ ID NO: 1273 - DNA, 20 bp, synthetic construct
  misc_feature 1..20: note = CRISPR gRNA sequence
  source 1..20: mol_type = other DNA
ggataatcttctattccctg

SEQ ID NO: 1274 - DNA, 20 bp, synthetic construct
  misc_feature 1..20: note = CRISPR gRNA sequence
  source 1..20: mol_type = other DNA
ctattccctgagaagggaac

SEQ ID NO: 1275 - DNA, 20 bp, synthetic construct
  misc_feature 1..20: note = CRISPR gRNA sequence
  source 1..20: mol_type = other DNA
tattccctgagaagggaaca

SEQ ID NO: 1276 - DNA, 20 bp, synthetic construct
  misc_feature 1..20: note = CRISPR gRNA sequence
  source 1..20: mol_type = other DNA
ttccctgagaagggaacagc

SEQ ID NO: 1277 - DNA, 20 bp, synthetic construct
  misc_feature 1..20: note = CRISPR gRNA sequence
  source 1..20: mol_type = other DNA
cctgagaagggaacagcgac

SEQ ID NO: 1278 - DNA, 20 bp, synthetic construct
  misc_feature 1..20: note = CRISPR gRNA sequence
  source 1..20: mol_type = other DNA
agaagggaacagcgacttct

SEQ ID NO: 1279 - DNA, 20 bp, synthetic construct
  misc_feature 1..20: note = CRISPR gRNA sequence
  source 1..20: mol_type = other DNA
ctggtcctgacctgagtgga

SEQ ID NO: 1280 - DNA, 20 bp, synthetic construct
  misc_feature 1..20: note = CRISPR gRNA sequence
  source 1..20: mol_type = other DNA
tggtcctgacctgagtggag

SEQ ID NO: 1281 - DNA, 20 bp, synthetic construct
  misc_feature 1..20: note = CRISPR gRNA sequence
  source 1..20: mol_type = other DNA
gtcctgacctgagtggaggc

SEQ ID NO: 1282 - DNA, 20 bp, synthetic construct
  misc_feature 1..20: note = CRISPR gRNA sequence
  source 1..20: mol_type = other DNA
acctgagtggaggctgaggg

SEQ ID NO: 1283 - DNA, 20 bp, synthetic construct
  misc_feature 1..20: note = CRISPR gRNA sequence
  source 1..20: mol_type = other DNA
agtggaggctgagggactca

SEQ ID NO: 1284 - DNA, 20 bp, synthetic construct
  misc_feature 1..20: note = CRISPR gRNA sequence
  source 1..20: mol_type = other DNA
agggactcagaagtgctgga

SEQ ID NO: 1285 - DNA, 20 bp, synthetic construct
  misc_feature 1..20: note = CRISPR gRNA sequence
  source 1..20: mol_type = other DNA
agaagtgctggactcagacc

SEQ ID NO: 1286 - DNA, 20 bp, synthetic construct
  misc_feature 1..20: note = CRISPR gRNA sequence
  source 1..20: mol_type = other DNA
gactcagacccccacacaca

SEQ ID NO: 1287 - DNA, 20 bp, synthetic construct
  misc_feature 1..20: note = CRISPR gRNA sequence
  source 1..20: mol_type = other DNA
agacccccacacacattgag

SEQ ID NO: 1288 - DNA, 20 bp, synthetic construct
  misc_feature 1..20: note = CRISPR gRNA sequence
  source 1..20: mol_type = other DNA
agtgtgaagcagagaacaag

SEQ ID NO: 1289 - DNA, 20 bp, synthetic construct
  misc_feature 1..20: note = CRISPR gRNA sequence
  source 1..20: mol_type = other DNA
agaggaaaagtcacgggccc

SEQ ID NO: 1290 - DNA, 20 bp, synthetic construct
  misc_feature 1..20: note = CRISPR gRNA sequence
  source 1..20: mol_type = other DNA
ctgccggtgtcaaagggaac

SEQ ID NO: 1291 - DNA, 20 bp, synthetic construct
  misc_feature 1..20: note = CRISPR gRNA sequence
  source 1..20: mol_type = other DNA
ccggtgtcaaagggaaccac

SEQ ID NO: 1292 - DNA, 20 bp, synthetic construct
  misc_feature 1..20: note = CRISPR gRNA sequence
  source 1..20: mol_type = other DNA
atcagtattcgagggatcgt

SEQ ID NO: 1293 - DNA, 20 bp, synthetic construct
  misc_feature 1..20: note = CRISPR gRNA sequence
  source 1..20: mol_type = other DNA
gagggatcgtcttcccgtca

SEQ ID NO: 1294 - DNA, 20 bp, synthetic construct
  misc_feature 1..20: note = CRISPR gRNA sequence
  source 1..20: mol_type = other DNA
cccgtcactccttcagagat

SEQ ID NO: 1295 - DNA, 20 bp, synthetic construct
  misc_feature 1..20: note = CRISPR gRNA sequence
  source 1..20: mol_type = other DNA
ccgtcactccttcagagatt

SEQ ID NO: 1296 - DNA, 20 bp, synthetic construct
  misc_feature 1..20: note = CRISPR gRNA sequence
  source 1..20: mol_type = other DNA
cttcagagattttatccctt

SEQ ID NO: 1297 - DNA, 20 bp, synthetic construct
  misc_feature 1..20: note = CRISPR gRNA sequence
  source 1..20: mol_type = other DNA
cagagattttatcccttaat

SEQ ID NO: 1298 - DNA, 20 bp, synthetic construct
  misc_feature 1..20: note = CRISPR gRNA sequence
  source 1..20: mol_type = other DNA
agagattttatcccttaatt

SEQ ID NO: 1299 - DNA, 20 bp, synthetic construct
  misc_feature 1..20: note = CRISPR gRNA sequence
  source 1..20: mol_type = other DNA
tatcccttaattgtgtcaga

SEQ ID NO: 1300 - DNA, 20 bp, synthetic construct
  misc_feature 1..20: note = CRISPR gRNA sequence
  source 1..20: mol_type = other DNA
atcccttaattgtgtcagag

SEQ ID NO: 1301 - DNA, 20 bp, synthetic construct
  misc_feature 1..20: note = CRISPR gRNA sequence
  source 1..20: mol_type = other DNA
tcccttaattgtgtcagaga

SEQ ID NO: 1302 - DNA, 20 bp, synthetic construct
  misc_feature 1..20: note = CRISPR gRNA sequence
  source 1..20: mol_type = other DNA
aattgtgtcagagagcaggg

SEQ ID NO: 1303 - DNA, 20 bp, synthetic construct
  misc_feature 1..20: note = CRISPR gRNA sequence
  source 1..20: mol_type = other DNA
attgtgtcagagagcagggc

SEQ ID NO: 1304 - DNA, 20 bp, synthetic construct
  misc_feature 1..20: note = CRISPR gRNA sequence
  source 1..20: mol_type = other DNA
tgtcagagagcagggcggaa

SEQ ID NO: 1305 - DNA, 20 bp, synthetic construct
  misc_feature 1..20: note = CRISPR gRNA sequence
  source 1..20: mol_type = other DNA
agagtcactctctggtacag

SEQ ID NO: 1306 - DNA, 20 bp, synthetic construct
  misc_feature 1..20: note = CRISPR gRNA sequence
  source 1..20: mol_type = other DNA
tctggtacaggatctggaac

SEQ ID NO: 1307 - DNA, 20 bp, synthetic construct
  misc_feature 1..20: note = CRISPR gRNA sequence
  source 1..20: mol_type = other DNA
tggtacaggatctggaaccc

SEQ ID NO: 1308 - DNA, 20 bp, synthetic construct
  misc_feature 1..20: note = CRISPR gRNA sequence
  source 1..20: mol_type = other DNA
gtacaggatctggaacccag

SEQ ID NO: 1309 - DNA, 20 bp, synthetic construct
  misc_feature 1..20: note = CRISPR gRNA sequence
  source 1..20: mol_type = other DNA
gaacccaggaggattcctct

SEQ ID NO: 1310 - DNA, 20 bp, synthetic construct
  misc_feature 1..20: note = CRISPR gRNA sequence
  source 1..20: mol_type = other DNA
ctctccctcaggaccagagg

SEQ ID NO: 1311 - DNA, 20 bp, synthetic construct
  misc_feature 1..20: note = CRISPR gRNA sequence
  source 1..20: mol_type = other DNA
tccctcaggaccagagggag

SEQ ID NO: 1312 - DNA, 20 bp, synthetic construct
  misc_feature 1..20: note = CRISPR gRNA sequence
  source 1..20: mol_type = other DNA
cctcaggaccagagggaggg

SEQ ID NO: 1313 - DNA, 20 bp, synthetic construct
  misc_feature 1..20: note = CRISPR gRNA sequence
  source 1..20: mol_type = other DNA
aggaccagagggagggtgat

SEQ ID NO: 1314 - DNA, 20 bp, synthetic construct
  misc_feature 1..20: note = CRISPR gRNA sequence
  source 1..20: mol_type = other DNA
tagtgttggtcccaattgtc

SEQ ID NO: 1315 - DNA, 20 bp, synthetic construct
  misc_feature 1..20: note = CRISPR gRNA sequence
  source 1..20: mol_type = other DNA
gtgttggtcccaattgtctc

SEQ ID NO: 1316 - DNA, 20 bp, synthetic construct
  misc_feature 1..20: note = CRISPR gRNA sequence
  source 1..20: mol_type = other DNA
gtcccaattgtctcccctcc

SEQ ID NO: 1317 - DNA, 20 bp, synthetic construct
  misc_feature 1..20: note = CRISPR gRNA sequence
  source 1..20: mol_type = other DNA
tctcccctccttgtgggagg

SEQ ID NO: 1318 - DNA, 20 bp, synthetic construct
  misc_feature 1..20: note = CRISPR gRNA sequence
  source 1..20: mol_type = other DNA
ccctccttgtgggaggccag

SEQ ID NO: 1319 - DNA, 20 bp, synthetic construct
  misc_feature 1..20: note = CRISPR gRNA sequence
  source 1..20: mol_type = other DNA
cttgtgggaggccagcccgg

SEQ ID NO: 1320 - DNA, 20 bp, synthetic construct
  misc_feature 1..20: note = CRISPR gRNA sequence
  source 1..20: mol_type = other DNA
gtgggaggccagcccgggag

SEQ ID NO: 1321 - DNA, 20 bp, synthetic construct
  misc_feature 1..20: note = CRISPR gRNA sequence
  source 1..20: mol_type = other DNA
tgggaggccagcccgggaga

SEQ ID NO: 1322 - DNA, 20 bp, synthetic construct
  misc_feature 1..20: note = CRISPR gRNA sequence
  source 1..20: mol_type = other DNA
caggcgatcagggaggcgcc

SEQ ID NO: 1323 - DNA, 20 bp, synthetic construct
  misc_feature 1..20: note = CRISPR gRNA sequence
  source 1..20: mol_type = other DNA
gtacccgtgcgctgcagcgt

SEQ ID NO: 1324 - DNA, 20 bp, synthetic construct
  misc_feature 1..20: note = CRISPR gRNA sequence
  source 1..20: mol_type = other DNA
cagcgtctccttcccgttct

SEQ ID NO: 1325 - DNA, 20 bp, synthetic construct
  misc_feature 1..20: note = CRISPR gRNA sequence
  source 1..20: mol_type = other DNA
cttcccgttctccaggtatc

SEQ ID NO: 1326 - DNA, 20 bp, synthetic construct
  misc_feature 1..20: note = CRISPR gRNA sequence
  source 1..20: mol_type = other DNA
cccgttctccaggtatctgc

SEQ ID NO: 1327 - DNA, 20 bp, synthetic construct
  misc_feature 1..20: note = CRISPR gRNA sequence
  source 1..20: mol_type = other DNA
ccgttctccaggtatctgcg

SEQ ID NO: 1328 - DNA, 20 bp, synthetic construct
  misc_feature 1..20: note = CRISPR gRNA sequence
  source 1..20: mol_type = other DNA
tccaggtatctgcggagcca

SEQ ID NO: 1329 - DNA, 20 bp, synthetic construct
  misc_feature 1..20: note = CRISPR gRNA sequence
  source 1..20: mol_type = other DNA
caggtatctgcggagccact

SEQ ID NO: 1330 - DNA, 20 bp, synthetic construct
  misc_feature 1..20: note = CRISPR gRNA sequence
  source 1..20: mol_type = other DNA
cggagccactccacgcacgt

SEQ ID NO: 1331 - DNA, 20 bp, synthetic construct
  misc_feature 1..20: note = CRISPR gRNA sequence
  source 1..20: mol_type = other DNA
cacgcacgtgccatccaggt

SEQ ID NO: 1332 - DNA, 20 bp, synthetic construct
  misc_feature 1..20: note = CRISPR gRNA sequence
  source 1..20: mol_type = other DNA
tcaactgctccgcctcatgg

SEQ ID NO: 1333 - DNA, 20 bp, synthetic construct
  misc_feature 1..20: note = CRISPR gRNA sequence
  source 1..20: mol_type = other DNA
aactgctccgcctcatgggc

SEQ ID NO: 1334 - DNA, 20 bp, synthetic construct
  misc_feature 1..20: note = CRISPR gRNA sequence
  source 1..20: mol_type = other DNA
ctccgcctcatgggccgcct

SEQ ID NO: 1335 - DNA, 20 bp, synthetic construct
  misc_feature 1..20: note = CRISPR gRNA sequence
  source 1..20: mol_type = other DNA
cgcctcatgggccgcctccc

SEQ ID NO: 1336 - DNA, 20 bp, synthetic construct
  misc_feature 1..20: note = CRISPR gRNA sequence
  source 1..20: mol_type = other DNA
atgggccgcctcccacttgc

SEQ ID NO: 1337 - DNA, 20 bp, synthetic construct
  misc_feature 1..20: note = CRISPR gRNA sequence
  source 1..20: mol_type = other DNA
ccacttgcgcttggtgatct

SEQ ID NO: 1338 - DNA, 20 bp, synthetic construct
  misc_feature 1..20: note = CRISPR gRNA sequence
  source 1..20: mol_type = other DNA
gcgcttggtgatctgagccg

SEQ ID NO: 1339 - DNA, 20 bp, synthetic construct
  misc_feature 1..20: note = CRISPR gRNA sequence
  source 1..20: mol_type = other DNA
cgcttggtgatctgagccgc

SEQ ID NO: 1340 - DNA, 20 bp, synthetic construct
  misc_feature 1..20: note = CRISPR gRNA sequence
  source 1..20: mol_type = other DNA
ggtgatctgagccgccatgt

SEQ ID NO: 1341 - DNA, 20 bp, synthetic construct
  misc_feature 1..20: note = CRISPR gRNA sequence
  source 1..20: mol_type = other DNA
gtgatctgagccgccatgtc

SEQ ID NO: 1342 - DNA, 20 bp, synthetic construct
  misc_feature 1..20: note = CRISPR gRNA sequence
  source 1..20: mol_type = other DNA
agccgccatgtccgccgcgg

SEQ ID NO: 1343 - DNA, 20 bp, synthetic construct
  misc_feature 1..20: note = CRISPR gRNA sequence
  source 1..20: mol_type = other DNA
gttcagggcgatgtaatcct

SEQ ID NO: 1344 - DNA, 20 bp, synthetic construct
  misc_feature 1..20: note = CRISPR gRNA sequence
  source 1..20: mol_type = other DNA
agggcgatgtaatccttgcc

SEQ ID NO: 1345 - DNA, 20 bp, synthetic construct
  misc_feature 1..20: note = CRISPR gRNA sequence
  source 1..20: mol_type = other DNA
gccgtcgtaggcgtcctgcc

SEQ ID NO: 1346 - DNA, 20 bp, synthetic construct
  misc_feature 1..20: note = CRISPR gRNA sequence
  source 1..20: mol_type = other DNA
ccgtcgtaggcgtcctgccg

SEQ ID NO: 1347 - DNA, 20 bp, synthetic construct
  misc_feature 1..20: note = CRISPR gRNA sequence
  source 1..20: mol_type = other DNA
ccggtacccgcggaggaagc

SEQ ID NO: 1348 - DNA, 20 bp, synthetic construct
  misc_feature 1..20: note = CRISPR gRNA sequence
  source 1..20: mol_type = other DNA
tctggatggtgtgagaacct

SEQ ID NO: 1349 - DNA, 20 bp, synthetic construct
  misc_feature 1..20: note = CRISPR gRNA sequence
  source 1..20: mol_type = other DNA
gatggtgtgagaacctggcc

SEQ ID NO: 1350 - DNA, 20 bp, synthetic construct
  misc_feature 1..20: note = CRISPR gRNA sequence
  source 1..20: mol_type = other DNA
gccccgaccccgcggtcagc

SEQ ID NO: 1351 - DNA, 20 bp, synthetic construct
  misc_feature 1..20: note = CRISPR gRNA sequence
  source 1..20: mol_type = other DNA
ttggcctaaactgaaaatga

SEQ ID NO: 1352 - DNA, 20 bp, synthetic construct
  misc_feature 1..20: note = CRISPR gRNA sequence
  source 1..20: mol_type = other DNA
tggcctaaactgaaaatgaa

SEQ ID NO: 1353 - DNA, 20 bp, synthetic construct
  misc_feature 1..20: note = CRISPR gRNA sequence
  source 1..20: mol_type = other DNA
ggcctaaactgaaaatgaaa

SEQ ID NO: 1354 - DNA, 20 bp, synthetic construct
  misc_feature 1..20: note = CRISPR gRNA sequence
  source 1..20: mol_type = other DNA
gcctaaactgaaaatgaaac

SEQ ID NO: 1355 - DNA, 20 bp, synthetic construct
  misc_feature 1..20: note = CRISPR gRNA sequence
  source 1..20: mol_type = other DNA
aactgaaaatgaaaccgggt

SEQ ID NO: 1356 - DNA, 20 bp, synthetic construct
  misc_feature 1..20: note = CRISPR gRNA sequence
  source 1..20: mol_type = other DNA
aaaatgaaaccgggtaaagg

SEQ ID NO: 1357 - DNA, 20 bp, synthetic construct
  misc_feature 1..20: note = CRISPR gRNA sequence
  source 1..20: mol_type = other DNA
ggcctctcccggggcaaggg

SEQ ID NO: 1358 - DNA, 20 bp, synthetic construct
  misc_feature 1..20: note = CRISPR gRNA sequence
  source 1..20: mol_type = other DNA
tcccggggcaagggtctcgg

SEQ ID NO: 1359 - DNA, 20 bp, synthetic construct
  misc_feature 1..20: note = CRISPR gRNA sequence
  source 1..20: mol_type = other DNA
ccggggcaagggtctcgggg

SEQ ID NO: 1360 - DNA, 20 bp, synthetic construct
  misc_feature 1..20: note = CRISPR gRNA sequence
  source 1..20: mol_type = other DNA
ggggtcccgcggcttcgggg

SEQ ID NO: 1361 - DNA, 20 bp, synthetic construct
  misc_feature 1..20: note = CRISPR gRNA sequence
  source 1..20: mol_type = other DNA
cggggtggatctcggacccg

SEQ ID NO: 1362 - DNA, 20 bp, synthetic construct
  misc_feature 1..20: note = CRISPR gRNA sequence
  source 1..20: mol_type = other DNA
ggggtggatctcggacccgg

SEQ ID NO: 1363 - DNA, 20 bp, synthetic construct
  misc_feature 1..20: note = CRISPR gRNA sequence
  source 1..20: mol_type = other DNA
ggacccggagactgtgggcg

SEQ ID NO: 1364 - DNA, 20 bp, synthetic construct
  misc_feature 1..20: note = CRISPR gRNA sequence
  source 1..20: mol_type = other DNA
tgggcgacctggcccgtccg

SEQ ID NO: 1365 - DNA, 20 bp, synthetic construct
  misc_feature 1..20: note = CRISPR gRNA sequence
  source 1..20: mol_type = other DNA
gcccgtccgtgggggatgag

SEQ ID NO: 1366 - DNA, 20 bp, synthetic construct
  misc_feature 1..20: note = CRISPR gRNA sequence
  source 1..20: mol_type = other DNA
acctgcgcccccggccgggg

SEQ ID NO: 1367 - DNA, 20 bp, synthetic construct
  misc_feature 1..20: note = CRISPR gRNA sequence
  source 1..20: mol_type = other DNA
cgcccccggccggggtcact

SEQ ID NO: 1368 - DNA, 20 bp, synthetic construct
  misc_feature 1..20: note = CRISPR gRNA sequence
  source 1..20: mol_type = other DNA
accggcctcgctctggttgt

SEQ ID NO: 1369 - DNA, 20 bp, synthetic construct
  misc_feature 1..20: note = CRISPR gRNA sequence
  source 1..20: mol_type = other DNA
gctctggttgtagtagccgc

SEQ ID NO: 1370 - DNA, 20 bp, synthetic construct
  misc_feature 1..20: note = CRISPR gRNA sequence
  source 1..20: mol_type = other DNA
tggttgtagtagccgcgcag

SEQ ID NO: 1371 - DNA, 20 bp, synthetic construct
  misc_feature 1..20: note = CRISPR gRNA sequence
  source 1..20: mol_type = other DNA
gttgtagtagccgcgcaggg

SEQ ID NO: 1372 - DNA, 20 bp, synthetic construct
  misc_feature 1..20: note = CRISPR gRNA sequence
  source 1..20: mol_type = other DNA
tagtagccgcgcagggtccc

SEQ ID NO: 1373 - DNA, 20 bp, synthetic construct
  misc_feature 1..20: note = CRISPR gRNA sequence
  source 1..20: mol_type = other DNA
ggtcagtctgtgactgggcc

SEQ ID NO: 1374 - DNA, 20 bp, synthetic construct
  misc_feature 1..20: note = CRISPR gRNA sequence
  source 1..20: mol_type = other DNA
tgactgggccttcacattcc

SEQ ID NO: 1375 - DNA, 20 bp, synthetic construct
  misc_feature 1..20: note = CRISPR gRNA sequence
  source 1..20: mol_type = other DNA
ggccttcacattccgtgtct

SEQ ID NO: 1376 - DNA, 20 bp, synthetic construct
  misc_feature 1..20: note = CRISPR gRNA sequence
  source 1..20: mol_type = other DNA
cacattccgtgtctcctggt

SEQ ID NO: 1377 - DNA, 20 bp, synthetic construct
  misc_feature 1..20: note = CRISPR gRNA sequence
  source 1..20: mol_type = other DNA
acattccgtgtctcctggtc

SEQ ID NO: 1378 - DNA, 20 bp, synthetic construct
  misc_feature 1..20: note = CRISPR gRNA sequence
  source 1..20: mol_type = other DNA
cgtgtctcctggtcccaata

SEQ ID NO: 1379 - DNA, 20 bp, synthetic construct
  misc_feature 1..20: note = CRISPR gRNA sequence
  source 1..20: mol_type = other DNA
ctggtcccaatactccggcc

SEQ ID NO: 1380 - DNA, 20 bp, synthetic construct
  misc_feature 1..20: note = CRISPR gRNA sequence
  source 1..20: mol_type = other DNA
gtcccaatactccggcccct

SEQ ID NO: 1381 - DNA, 20 bp, synthetic construct
  misc_feature 1..20: note = CRISPR gRNA sequence
  source 1..20: mol_type = other DNA
cggcccctcctgctctatcc

SEQ ID NO: 1382 - DNA, 20 bp, synthetic construct
  misc_feature 1..20: note = CRISPR gRNA sequence
  source 1..20: mol_type = other DNA
ctgctctatccacggcgccc

SEQ ID NO: 1383 - DNA, 20 bp, synthetic construct
  misc_feature 1..20: note = CRISPR gRNA sequence
  source 1..20: mol_type = other DNA
ctctatccacggcgcccgcg

SEQ ID NO: 1384 - DNA, 20 bp, synthetic construct
  misc_feature 1..20: note = CRISPR gRNA sequence
  source 1..20: mol_type = other DNA
tatccacggcgcccgcggct

SEQ ID NO: 1385 - DNA, 20 bp, synthetic construct
  misc_feature 1..20: note = CRISPR gRNA sequence
  source 1..20: mol_type = other DNA
tccacggcgcccgcggctcc

SEQ ID NO: 1386 - DNA, 20 bp, synthetic construct
  misc_feature 1..20: note = CRISPR gRNA sequence
  source 1..20: mol_type = other DNA
catcctctggctcgcggcgt

SEQ ID NO: 1387 - DNA, 20 bp, synthetic construct
  misc_feature 1..20: note = CRISPR gRNA sequence
  source 1..20: mol_type = other DNA
tggctcgcggcgtcgctgtc

SEQ ID NO: 1388 - DNA, 20 bp, synthetic construct
  misc_feature 1..20: note = CRISPR gRNA sequence
  source 1..20: mol_type = other DNA
gctcgcggcgtcgctgtcga

SEQ ID NO: 1389 - DNA, 20 bp, synthetic construct
  misc_feature 1..20: note = CRISPR gRNA sequence
  source 1..20: mol_type = other DNA
gcggcgtcgctgtcgaaccg

SEQ ID NO: 1390 - DNA, 20 bp, synthetic construct
  misc_feature 1..20: note = CRISPR gRNA sequence
  source 1..20: mol_type = other DNA
tcgaaccgcacgaactgcgt

SEQ ID NO: 1391 - DNA, 20 bp, synthetic construct
  misc_feature 1..20: note = CRISPR gRNA sequence
  source 1..20: mol_type = other DNA
cgtgtcgtccacgtagccca

SEQ ID NO: 1392 - DNA, 20 bp, synthetic construct
  misc_feature 1..20: note = CRISPR gRNA sequence
  source 1..20: mol_type = other DNA
cccgcggccgggccgggaca

SEQ ID NO: 1393 - DNA, 20 bp, synthetic construct
  misc_feature 1..20: note = CRISPR gRNA sequence
  source 1..20: mol_type = other DNA
atggagtgggagcctggggg

SEQ ID NO: 1394 - DNA, 20 bp, synthetic construct
  misc_feature 1..20: note = CRISPR gRNA sequence
  source 1..20: mol_type = other DNA
ggggcgagcagtggctgaga

SEQ ID NO: 1395 - DNA, 20 bp, synthetic construct
  misc_feature 1..20: note = CRISPR gRNA sequence
  source 1..20: mol_type = other DNA
agacctgcccgaccctcgtc

SEQ ID NO: 1396 - DNA, 20 bp, synthetic construct
  misc_feature 1..20: note = CRISPR gRNA sequence
  source 1..20: mol_type = other DNA
cccgaccctcgtcccggcgc

SEQ ID NO: 1397 - DNA, 20 bp, synthetic construct
  misc_feature 1..20: note = CRISPR gRNA sequence
  source 1..20: mol_type = other DNA
gtcccggcgcggctcccccg

SEQ ID NO: 1398 - DNA, 20 bp, synthetic construct
  misc_feature 1..20: note = CRISPR gRNA sequence
  source 1..20: mol_type = other DNA
ccccggtcctgcgcccccgc

SEQ ID NO: 1399 - DNA, 20 bp, synthetic construct
  misc_feature 1..20: note = CRISPR gRNA sequence
  source 1..20: mol_type = other DNA
cgcccccgccaggagggccc

SEQ ID NO: 1400 - DNA, 20 bp, synthetic construct
  misc_feature 1..20: note = CRISPR gRNA sequence
  source 1..20: mol_type = other DNA
gcttctccccgcagaggcgg

SEQ ID NO: 1401 - DNA, 20 bp, synthetic construct
  misc_feature 1..20: note = CRISPR gRNA sequence
  source 1..20: mol_type = other DNA
cttctccccgcagaggcggt

SEQ ID NO: 1402 - DNA, 20 bp, synthetic construct
  misc_feature 1..20: note = CRISPR gRNA sequence
  source 1..20: mol_type = other DNA
ctccccgcagaggcggtttc

SEQ ID NO: 1403 - DNA, 20 bp, synthetic construct
  misc_feature 1..20: note = CRISPR gRNA sequence
  source 1..20: mol_type = other DNA
tccccgcagaggcggtttcc

SEQ ID NO: 1404 - DNA, 20 bp, synthetic construct
  misc_feature 1..20: note = CRISPR gRNA sequence
  source 1..20: mol_type = other DNA
cccgcagaggcggtttccct

SEQ ID NO: 1405 - DNA, 20 bp, synthetic construct
  misc_feature 1..20: note = CRISPR gRNA sequence
  source 1..20: mol_type = other DNA
ccctcccgaccccgcactca

SEQ ID NO: 1406 - DNA, 20 bp, synthetic construct
  misc_feature 1..20: note = CRISPR gRNA sequence
  source 1..20: mol_type = other DNA
cctcccgaccccgcactcac

SEQ ID NO: 1407 - DNA, 20 bp, synthetic construct
  misc_feature 1..20: note = CRISPR gRNA sequence
  source 1..20: mol_type = other DNA
ccgaccccgcactcacccgc

SEQ ID NO: 1408 - DNA, 20 bp, synthetic construct
  misc_feature 1..20: note = CRISPR gRNA sequence
  source 1..20: mol_type = other DNA
acccgcccaggtctgggtca

SEQ ID NO: 1409 - DNA, 20 bp, synthetic construct
  misc_feature 1..20: note = CRISPR gRNA sequence
  source 1..20: mol_type = other DNA
ggtcagggccagggcccccg

SEQ ID NO: 1410 - DNA, 20 bp, synthetic construct
  misc_feature 1..20: note = CRISPR gRNA sequence
  source 1..20: mol_type = other DNA
ggggcgccatgacggccatc

SEQ ID NO: 1411 - DNA, 20 bp, synthetic construct
  misc_feature 1..20: note = CRISPR gRNA sequence
  source 1..20: mol_type = other DNA
ggcgtctggggagaatctga

SEQ ID NO: 1412 - DNA, 20 bp, synthetic construct
  misc_feature 1..20: note = CRISPR gRNA sequence
  source 1..20: mol_type = other DNA
gggagaatctgagtcccggt

SEQ ID NO: 1413 - DNA, 20 bp, synthetic construct
  misc_feature 1..20: note = CRISPR gRNA sequence
  source 1..20: mol_type = other DNA
agtcccggtgggtgcgtgcg

SEQ ID NO: 1414 - DNA, 20 bp, synthetic construct
  misc_feature 1..20: note = CRISPR gRNA sequence
  source 1..20: mol_type = other DNA
tagaacagcgaccgcgacga

SEQ ID NO: 1415 - DNA, 20 bp, synthetic construct
  misc_feature 1..20: note = CRISPR gRNA sequence
  source 1..20: mol_type = other DNA
agaacagcgaccgcgacgac

SEQ ID NO: 1416 - DNA, 20 bp, synthetic construct
  misc_feature 1..20: note = CRISPR gRNA sequence
  source 1..20: mol_type = other DNA
gaacagcgaccgcgacgaca

SEQ ID NO: 1417 - DNA, 20 bp, synthetic construct
  misc_feature 1..20: note = CRISPR gRNA sequence
  source 1..20: mol_type = other DNA
attggcttctctggaaaccc

SEQ ID NO: 1418 - DNA, 20 bp, synthetic construct
  misc_feature 1..20: note = CRISPR gRNA sequence
  source 1..20: mol_type = other DNA
gcttctctggaaacccgaca

SEQ ID NO: 1419 - DNA, 20 bp, synthetic construct
  misc_feature 1..20: note = CRISPR gRNA sequence
  source 1..20: mol_type = other DNA
atcaaagaatccccattacc

SEQ ID NO: 1420 - DNA, 20 bp, synthetic construct
  misc_feature 1..20: note = CRISPR gRNA sequence
  source 1..20: mol_type = other DNA
tcaaagaatccccattaccc

SEQ ID NO: 1421 - DNA, 20 bp, synthetic construct
  misc_feature 1..20: note = CRISPR gRNA sequence
  source 1..20: mol_type = other DNA
ccctctgccccacccacccc

SEQ ID NO: 1422 - DNA, 20 bp, synthetic construct
  misc_feature 1..20: note = CRISPR gRNA sequence
  source 1..20: mol_type = other DNA
acccgccaccccacccactc

SEQ ID NO: 1423 - DNA, 20 bp, synthetic construct
  misc_feature 1..20: note = CRISPR gRNA sequence
  source 1..20: mol_type = other DNA
ccccacccactctagacccc

SEQ ID NO: 1424 - DNA, 20 bp, synthetic construct
  misc_feature 1..20: note = CRISPR gRNA sequence
  source 1..20: mol_type = other DNA
cccaagaatctcaccttttc

SEQ ID NO: 1425 - DNA, 20 bp, synthetic construct
  misc_feature 1..20: note = CRISPR gRNA sequence
  source 1..20: mol_type = other DNA
atctcaccttttcaagctgt

SEQ ID NO: 1426 - DNA, 20 bp, synthetic construct
  misc_feature 1..20: note = CRISPR gRNA sequence
  source 1..20: mol_type = other DNA
ctcaccttttcaagctgtga

SEQ ID NO: 1427 - DNA, 20 bp, synthetic construct
  misc_feature 1..20: note = CRISPR gRNA sequence
  source 1..20: mol_type = other DNA
tcaagctgtgagagacacat

SEQ ID NO: 1428 - DNA, 20 bp, synthetic construct
  misc_feature 1..20: note = CRISPR gRNA sequence
  source 1..20: mol_type = other DNA
aagctgtgagagacacatca

SEQ ID NO: 1429 - DNA, 20 bp, synthetic construct
  misc_feature 1..20: note = CRISPR gRNA sequence
  source 1..20: mol_type = other DNA
tgagagacacatcagagccc

SEQ ID NO: 1430 - DNA, 20 bp, synthetic construct
  misc_feature 1..20: note = CRISPR gRNA sequence
  source 1..20: mol_type = other DNA
gagagacacatcagagccct

SEQ ID NO: 1431 - DNA, 20 bp, synthetic construct
  misc_feature 1..20: note = CRISPR gRNA sequence
  source 1..20: mol_type = other DNA
ccctgggcactgtcgctgcc

SEQ ID NO: 1432 - DNA, 20 bp, synthetic construct
  misc_feature 1..20: note = CRISPR gRNA sequence
  source 1..20: mol_type = other DNA
ctgggcactgtcgctgcctg

SEQ ID NO: 1433 - DNA, 20 bp, synthetic construct
  misc_feature 1..20: note = CRISPR gRNA sequence
  source 1..20: mol_type = other DNA
ggcactgtcgctgcctggag

SEQ ID NO: 1434 - DNA, 20 bp, synthetic construct
  misc_feature 1..20: note = CRISPR gRNA sequence
  source 1..20: mol_type = other DNA
tgcctggagtagaacaaaaa

SEQ ID NO: 1435 - DNA, 20 bp, synthetic construct
  misc_feature 1..20: note = CRISPR gRNA sequence
  source 1..20: mol_type = other DNA
gcctggagtagaacaaaaac

SEQ ID NO: 1436 - DNA, 20 bp, synthetic construct
  misc_feature 1..20: note = CRISPR gRNA sequence
  source 1..20: mol_type = other DNA
agtagaacaaaaacaggacc

SEQ ID NO: 1437 - DNA, 20 bp, synthetic construct
  misc_feature 1..20: note = CRISPR gRNA sequence
  source 1..20: mol_type = other DNA
gaacaaaaacaggacctggt

SEQ ID NO: 1438 - DNA, 20 bp, synthetic construct
  misc_feature 1..20: note = CRISPR gRNA sequence
  source 1..20: mol_type = other DNA
acaaaaacaggacctggtca

SEQ ID NO: 1439 - DNA, 20 bp, synthetic construct
  misc_feature 1..20: note = CRISPR gRNA sequence
  source 1..20: mol_type = other DNA
caggacctggtcagagcccg

SEQ ID NO: 1440 - DNA, 20 bp, synthetic construct
  misc_feature 1..20: note = CRISPR gRNA sequence
  source 1..20: mol_type = other DNA
aggacctggtcagagcccgc

SEQ ID NO: 1441 - DNA, 20 bp, synthetic construct
  misc_feature 1..20: note = CRISPR gRNA sequence
  source 1..20: mol_type = other DNA
gacctggtcagagcccgcag

SEQ ID NO: 1442 - DNA, 20 bp, synthetic construct
  misc_feature 1..20: note = CRISPR gRNA sequence
  source 1..20: mol_type = other DNA
gtcagagcccgcaggagacg

SEQ ID NO: 1443 - DNA, 20 bp, synthetic construct
  misc_feature 1..20: note = CRISPR gRNA sequence
  source 1..20: mol_type = other DNA
tcagagcccgcaggagacgt

SEQ ID NO: 1444 - DNA, 20 bp, synthetic construct
  misc_feature 1..20: note = CRISPR gRNA sequence
  source 1..20: mol_type = other DNA
agcccgcaggagacgtggga

SEQ ID NO: 1445 - DNA, 20 bp, synthetic construct
  misc_feature 1..20: note = CRISPR gRNA sequence
  source 1..20: mol_type = other DNA
gcccgcaggagacgtgggac

SEQ ID NO: 1446 - DNA, 20 bp, synthetic construct
  misc_feature 1..20: note = CRISPR gRNA sequence
  source 1..20: mol_type = other DNA
ccgcaggagacgtgggacag

SEQ ID NO: 1447 - DNA, 20 bp, synthetic construct
  misc_feature 1..20: note = CRISPR gRNA sequence
  source 1..20: mol_type = other DNA
cgcaggagacgtgggacagg

SEQ ID NO: 1448 - DNA, 20 bp, synthetic construct
  misc_feature 1..20: note = CRISPR gRNA sequence
  source 1..20: mol_type = other DNA
acgtgggacaggaggaatta

SEQ ID NO: 1449 - DNA, 20 bp, synthetic construct
  misc_feature 1..20: note = CRISPR gRNA sequence
  source 1..20: mol_type = other DNA
cgtgggacaggaggaattat

SEQ ID NO: 1450 - DNA, 20 bp, synthetic construct
  misc_feature 1..20: note = CRISPR gRNA sequence
  source 1..20: mol_type = other DNA
gtgggacaggaggaattatg

SEQ ID NO: 1451 - DNA, 20 bp, synthetic construct
  misc_feature 1..20: note = CRISPR gRNA sequence
  source 1..20: mol_type = other DNA
ggacaggaggaattatgggg

SEQ ID NO: 1452 - DNA, 20 bp, synthetic construct
  misc_feature 1..20: note = CRISPR gRNA sequence
  source 1..20: mol_type = other DNA
gacaggaggaattatggggt

SEQ ID NO: 1453 - DNA, 20 bp, synthetic construct
  misc_feature 1..20: note = CRISPR gRNA sequence
  source 1..20: mol_type = other DNA
ggaggaattatggggtgggt

SEQ ID NO: 1454 - DNA, 20 bp, synthetic construct
  misc_feature 1..20: note = CRISPR gRNA sequence
  source 1..20: mol_type = other DNA
ccacccccaccacttacacg

SEQ ID NO: 1455 - DNA, 20 bp, synthetic construct
  misc_feature 1..20: note = CRISPR gRNA sequence
  source 1..20: mol_type = other DNA
ccaccacttacacgcagcct

SEQ ID NO: 1456 - DNA, 20 bp, synthetic construct
  misc_feature 1..20: note = CRISPR gRNA sequence
  source 1..20: mol_type = other DNA
accacttacacgcagcctga

SEQ ID NO: 1457 - DNA, 20 bp, synthetic construct
  misc_feature 1..20: note = CRISPR gRNA sequence
  source 1..20: mol_type = other DNA
acttacacgcagcctgagag

SEQ ID NO: 1458 - DNA, 20 bp, synthetic construct
  misc_feature 1..20: note = CRISPR gRNA sequence
  source 1..20: mol_type = other DNA
gctccctccttttccacctg

SEQ ID NO: 1459 - DNA, 20 bp, synthetic construct
  misc_feature 1..20: note = CRISPR gRNA sequence
  source 1..20: mol_type = other DNA
ctccctccttttccacctgt

SEQ ID NO: 1460 - DNA, 20 bp, synthetic construct
  misc_feature 1..20: note = CRISPR gRNA sequence
  source 1..20: mol_type = other DNA
cctccttttccacctgtggg

SEQ ID NO: 1461 - DNA, 20 bp, synthetic construct
  misc_feature 1..20: note = CRISPR gRNA sequence
  source 1..20: mol_type = other DNA
gtgggaagaaaatgtcctgt

SEQ ID NO: 1462 - DNA, 20 bp, synthetic construct
  misc_feature 1..20: note = CRISPR gRNA sequence
  source 1..20: mol_type = other DNA
tgggaagaaaatgtcctgtg

SEQ ID NO: 1463 - DNA, 20 bp, synthetic construct
  misc_feature 1..20: note = CRISPR gRNA sequence
  source 1..20: mol_type = other DNA
gggaagaaaatgtcctgtga

SEQ ID NO: 1464 - DNA, 20 bp, synthetic construct
  misc_feature 1..20: note = CRISPR gRNA sequence
  source 1..20: mol_type = other DNA
aaaatgtcctgtgagggcac

SEQ ID NO: 1465 - DNA, 20 bp, synthetic construct
  misc_feature 1..20: note = CRISPR gRNA sequence
  source 1..20: mol_type = other DNA
aaatgtcctgtgagggcact

SEQ ID NO: 1466 - DNA, 20 bp, synthetic construct
  misc_feature 1..20: note = CRISPR gRNA sequence
  source 1..20: mol_type = other DNA
atgtcctgtgagggcactgg

SEQ ID NO: 1467 - DNA, 20 bp, synthetic construct
  misc_feature 1..20: note = CRISPR gRNA sequence
  source 1..20: mol_type = other DNA
tgtcctgtgagggcactggg

SEQ ID NO: 1468 - DNA, 20 bp, synthetic construct
  misc_feature 1..20: note = CRISPR gRNA sequence
  source 1..20: mol_type = other DNA
cctgtgagggcactgggagg

SEQ ID NO: 1469 - DNA, 20 bp, synthetic construct
  misc_feature 1..20: note = CRISPR gRNA sequence
  source 1..20: mol_type = other DNA
gtgagggcactgggaggaag

SEQ ID NO: 1470 - DNA, 20 bp, synthetic construct
  misc_feature 1..20: note = CRISPR gRNA sequence
  source 1..20: mol_type = other DNA
tgagggcactgggaggaagc

SEQ ID NO: 1471 - DNA, 20 bp, synthetic construct
  misc_feature 1..20: note = CRISPR gRNA sequence
  source 1..20: mol_type = other DNA
gagggcactgggaggaagca

SEQ ID NO: 1472 - DNA, 20 bp, synthetic construct
  misc_feature 1..20: note = CRISPR gRNA sequence
  source 1..20: mol_type = other DNA
ctgggaggaagcagggccat

SEQ ID NO: 1473 - DNA, 20 bp, synthetic construct
  misc_feature 1..20: note = CRISPR gRNA sequence
  source 1..20: mol_type = other DNA
gaagcagggccatgagatct

SEQ ID NO: 1474 - DNA, 20 bp, synthetic construct
  misc_feature 1..20: note = CRISPR gRNA sequence
  source 1..20: mol_type = other DNA
agcagggccatgagatctta

SEQ ID NO: 1475 - DNA, 20 bp, synthetic construct
  misc_feature 1..20: note = CRISPR gRNA sequence
  source 1..20: mol_type = other DNA
gcagggccatgagatcttag

SEQ ID NO: 1476 - DNA, 20 bp, synthetic construct
  misc_feature 1..20: note = CRISPR gRNA sequence
  source 1..20: mol_type = other DNA
gagatcttagaggaacctcc

SEQ ID NO: 1477 - DNA, 20 bp, synthetic construct
  misc_feature 1..20: note = CRISPR gRNA sequence
  source 1..20: mol_type = other DNA
ttagaggaacctcctagtct

SEQ ID NO: 1478 - DNA, 20 bp, synthetic construct
  misc_feature 1..20: note = CRISPR gRNA sequence
  source 1..20: mol_type = other DNA
cctcctagtcttggacccaa

SEQ ID NO: 1479 - DNA, 20 bp, synthetic construct
  misc_feature 1..20: note = CRISPR gRNA sequence
  source 1..20: mol_type = other DNA
ctcctagtcttggacccaaa

SEQ ID NO: 1480 - DNA, 20 bp, synthetic construct
  misc_feature 1..20: note = CRISPR gRNA sequence
  source 1..20: mol_type = other DNA
ttggacccaaaaggaatttc

SEQ ID NO: 1481 - DNA, 20 bp, synthetic construct
  misc_feature 1..20: note = CRISPR gRNA sequence
  source 1..20: mol_type = other DNA
gacccaaaaggaatttccag

SEQ ID NO: 1482 - DNA, 20 bp, synthetic construct
  misc_feature 1..20: note = CRISPR gRNA sequence
  source 1..20: mol_type = other DNA
aatttccagaagtatgacta

SEQ ID NO: 1483 - DNA, 20 bp, synthetic construct
  misc_feature 1..20: note = CRISPR gRNA sequence
  source 1..20: mol_type = other DNA
cagaagtatgactacagacc

SEQ ID NO: 1484 - DNA, 20 bp, synthetic construct
  misc_feature 1..20: note = CRISPR gRNA sequence
  source 1..20: mol_type = other DNA
agaagtatgactacagaccc

SEQ ID NO: 1485 - DNA, 20 bp, synthetic construct
  misc_feature 1..20: note = CRISPR gRNA sequence
  source 1..20: mol_type = other DNA
gaagtatgactacagaccca

SEQ ID NO: 1486 - DNA, 20 bp, synthetic construct
  misc_feature 1..20: note = CRISPR gRNA sequence
  source 1..20: mol_type = other DNA
gtatgactacagacccaggg

SEQ ID NO: 1487 - DNA, 20 bp, synthetic construct
  misc_feature 1..20: note = CRISPR gRNA sequence
  source 1..20: mol_type = other DNA
tatgactacagacccagggc

SEQ ID NO: 1488 - DNA, 20 bp, synthetic construct
  misc_feature 1..20: note = CRISPR gRNA sequence
  source 1..20: mol_type = other DNA
ctacagacccagggcaggat

SEQ ID NO: 1489 - DNA, 20 bp, synthetic construct
  misc_feature 1..20: note = CRISPR gRNA sequence
  source 1..20: mol_type = other DNA
tacagacccagggcaggatc

SEQ ID NO: 1490 - DNA, 20 bp, synthetic construct
  misc_feature 1..20: note = CRISPR gRNA sequence
  source 1..20: mol_type = other DNA
agggcaggatcaggaaacac

SEQ ID NO: 1491 - DNA, 20 bp, synthetic construct
  misc_feature 1..20: note = CRISPR gRNA sequence
  source 1..20: mol_type = other DNA
gggcaggatcaggaaacacg

SEQ ID NO: 1492 - DNA, 20 bp, synthetic construct
  misc_feature 1..20: note = CRISPR gRNA sequence
  source 1..20: mol_type = other DNA
aggatcaggaaacacgagga

SEQ ID NO: 1493 - DNA, 20 bp, synthetic construct
  misc_feature 1..20: note = CRISPR gRNA sequence
  source 1..20: mol_type = other DNA
tcaggaaacacgaggaaagc

SEQ ID NO: 1494 - DNA, 20 bp, synthetic construct
  misc_feature 1..20: note = CRISPR gRNA sequence
  source 1..20: mol_type = other DNA
aaacacgaggaaagcaagtg

SEQ ID NO: 1495 - DNA, 20 bp, synthetic construct
  misc_feature 1..20: note = CRISPR gRNA sequence
  source 1..20: mol_type = other DNA
aacacgaggaaagcaagtgt

SEQ ID NO: 1496 - DNA, 20 bp, synthetic construct
  misc_feature 1..20: note = CRISPR gRNA sequence
  source 1..20: mol_type = other DNA
aggaaagcaagtgtgggtcc

SEQ ID NO: 1497 - DNA, 20 bp, synthetic construct
  misc_feature 1..20: note = CRISPR gRNA sequence
  source 1..20: mol_type = other DNA
cctggaccaactgccctcct

SEQ ID NO: 1498 - DNA, 20 bp, synthetic construct
  misc_feature 1..20: note = CRISPR gRNA sequence
  source 1..20: mol_type = other DNA
ctggaccaactgccctccta

SEQ ID NO: 1499 - DNA, 20 bp, synthetic construct
  misc_feature 1..20: note = CRISPR gRNA sequence
  source 1..20: mol_type = other DNA
gccctcctaaggtctgtcct

SEQ ID NO: 1500 - DNA, 20 bp, synthetic construct
  misc_feature 1..20: note = CRISPR gRNA sequence
  source 1..20: mol_type = other DNA
ctcctaaggtctgtccttag

SEQ ID NO: 1501 - DNA, 20 bp, synthetic construct
  misc_feature 1..20: note = CRISPR gRNA sequence
  source 1..20: mol_type = other DNA
tcctaaggtctgtccttagc

SEQ ID NO: 1502 - DNA, 20 bp, synthetic construct
  misc_feature 1..20: note = CRISPR gRNA sequence
  source 1..20: mol_type = other DNA
cctaaggtctgtccttagca

SEQ ID NO: 1503 - DNA, 20 bp, synthetic construct
  misc_feature 1..20: note = CRISPR gRNA sequence
  source 1..20: mol_type = other DNA
ttcccctgactcatgaatgc

SEQ ID NO: 1504 - DNA, 20 bp, synthetic construct
  misc_feature 1..20: note = CRISPR gRNA sequence
  source 1..20: mol_type = other DNA
tgactcatgaatgctggaat

SEQ ID NO: 1505 - DNA, 20 bp, synthetic construct
  misc_feature 1..20: note = CRISPR gRNA sequence
  source 1..20: mol_type = other DNA
gactcatgaatgctggaatc

SEQ ID NO: 1506 - DNA, 20 bp, synthetic construct
  misc_feature 1..20: note = CRISPR gRNA sequence
  source 1..20: mol_type = other DNA
accccaacaccacaaccatc

SEQ ID NO: 1507 - DNA, 20 bp, synthetic construct
  misc_feature 1..20: note = CRISPR gRNA sequence
  source 1..20: mol_type = other DNA
ccccaacaccacaaccatca

SEQ ID NO: 1508 - DNA, 20 bp, synthetic construct
  misc_feature 1..20: note = CRISPR gRNA sequence
  source 1..20: mol_type = other DNA
ttgtcacatgtgctgcacaa

SEQ ID NO: 1509 - DNA, 20 bp, synthetic construct
  misc_feature 1..20: note = CRISPR gRNA sequence
  source 1..20: mol_type = other DNA
gtcacatgtgctgcacaaaa

SEQ ID NO: 1510 - DNA, 20 bp, synthetic construct
  misc_feature 1..20: note = CRISPR gRNA sequence
  source 1..20: mol_type = other DNA
catgtgctgcacaaaagagt

SEQ ID NO: 1511 - DNA, 20 bp, synthetic construct
  misc_feature 1..20: note = CRISPR gRNA sequence
  source 1..20: mol_type = other DNA
ctgcacaaaagagtaagtgc

SEQ ID NO: 1512 - DNA, 20 bp, synthetic construct
  misc_feature 1..20: note = CRISPR gRNA sequence
  source 1..20: mol_type = other DNA
aaagagtaagtgctggcaca

SEQ ID NO: 1513 - DNA, 20 bp, synthetic construct
  misc_feature 1..20: note = CRISPR gRNA sequence
  source 1..20: mol_type = other DNA
aagagtaagtgctggcacac

SEQ ID NO: 1514 - DNA, 20 bp, synthetic construct
  misc_feature 1..20: note = CRISPR gRNA sequence
  source 1..20: mol_type = other DNA
agagtaagtgctggcacaca

SEQ ID NO: 1515 - DNA, 20 bp, synthetic construct
  misc_feature 1..20: note = CRISPR gRNA sequence
  source 1..20: mol_type = other DNA
agtgctggcacacagggtcc

SEQ ID NO: 1516 - DNA, 20 bp, synthetic construct
  misc_feature 1..20: note = CRISPR gRNA sequence
  source 1..20: mol_type = other DNA
gtgctggcacacagggtccc

SEQ ID NO: 1517 - DNA, 20 bp, synthetic construct
  misc_feature 1..20: note = CRISPR gRNA sequence
  source 1..20: mol_type = other DNA
cacagggtcccaggctgcgt

SEQ ID NO: 1518 - DNA, 20 bp, synthetic construct
  misc_feature 1..20: note = CRISPR gRNA sequence
  source 1..20: mol_type = other DNA
cctgtgtgcatgctgcttcc

SEQ ID NO: 1519 - DNA, 20 bp, synthetic construct
  misc_feature 1..20: note = CRISPR gRNA sequence
  source 1..20: mol_type = other DNA
gcatgctgcttcccagtaat

SEQ ID NO: 1520 - DNA, 20 bp, synthetic construct
  misc_feature 1..20: note = CRISPR gRNA sequence
  source 1..20: mol_type = other DNA
catgctgcttcccagtaatg

SEQ ID NO: 1521 - DNA, 20 bp, synthetic construct
  misc_feature 1..20: note = CRISPR gRNA sequence
  source 1..20: mol_type = other DNA
gctgcttcccagtaatgagg

SEQ ID NO: 1522 - DNA, 20 bp, synthetic construct
  misc_feature 1..20: note = CRISPR gRNA sequence
  source 1..20: mol_type = other DNA
ctgcttcccagtaatgaggc

SEQ ID NO: 1523 - DNA, 20 bp, synthetic construct
  misc_feature 1..20: note = CRISPR gRNA sequence
  source 1..20: mol_type = other DNA
tgcttcccagtaatgaggca

SEQ ID NO: 1524 - DNA, 20 bp, synthetic construct
  misc_feature 1..20: note = CRISPR gRNA sequence
  source 1..20: mol_type = other DNA
aggcagggaacacttctacc

SEQ ID NO: 1525 - DNA, 20 bp, synthetic construct
  misc_feature 1..20: note = CRISPR gRNA sequence
  source 1..20: mol_type = other DNA
ggcagggaacacttctacct

SEQ ID NO: 1526 - DNA, 20 bp, synthetic construct
  misc_feature 1..20: note = CRISPR gRNA sequence
  source 1..20: mol_type = other DNA
gcagggaacacttctacctg

SEQ ID NO: 1527 - DNA, 20 bp, synthetic construct
  misc_feature 1..20: note = CRISPR gRNA sequence
  source 1..20: mol_type = other DNA
tacctggggcttgaaacccc

SEQ ID NO: 1528 - DNA, 20 bp, synthetic construct
  misc_feature 1..20: note = CRISPR gRNA sequence
  source 1..20: mol_type = other DNA
ctggggcttgaaacccccag

SEQ ID NO: 1529 - DNA, 20 bp, synthetic construct
  misc_feature 1..20: note = CRISPR gRNA sequence
  source 1..20: mol_type = other DNA
tggggcttgaaacccccagt

SEQ ID NO: 1530 - DNA, 20 bp, synthetic construct
  misc_feature 1..20: note = CRISPR gRNA sequence
  source 1..20: mol_type = other DNA
cttgaaacccccagtgggac

SEQ ID NO: 1531 - DNA, 20 bp, synthetic construct
  misc_feature 1..20: note = CRISPR gRNA sequence
  source 1..20: mol_type = other DNA
cccagtgggacaagaaaacc

SEQ ID NO: 1532 - DNA, 20 bp, synthetic construct
  misc_feature 1..20: note = CRISPR gRNA sequence
  source 1..20: mol_type = other DNA
actcttcctcctacacatca

SEQ ID NO: 1533 - DNA, 20 bp, synthetic construct
  misc_feature 1..20: note = CRISPR gRNA sequence
  source 1..20: mol_type = other DNA
cttcctcctacacatcacag

SEQ ID NO: 1534 - DNA, 20 bp, synthetic construct
  misc_feature 1..20: note = CRISPR gRNA sequence
  source 1..20: mol_type = other DNA
acacatcacagcagcgacca

SEQ ID NO: 1535 - DNA, 20 bp, synthetic construct
  misc_feature 1..20: note = CRISPR gRNA sequence
  source 1..20: mol_type = other DNA
gctccgatgaccacaactgc

SEQ ID NO: 1536 - DNA, 20 bp, synthetic construct
  misc_feature 1..20: note = CRISPR gRNA sequence
  source 1..20: mol_type = other DNA
ctccgatgaccacaactgct

SEQ ID NO: 1537 - DNA, 20 bp, synthetic construct
  misc_feature 1..20: note = CRISPR gRNA sequence
  source 1..20: mol_type = other DNA
gatgaccacaactgctagga

SEQ ID NO: 1538 - DNA, 20 bp, synthetic construct
  misc_feature 1..20: note = CRISPR gRNA sequence
  source 1..20: mol_type = other DNA
accacaactgctaggacagc

SEQ ID NO: 1539 - DNA, 20 bp, synthetic construct
  misc_feature 1..20: note = CRISPR gRNA sequence
  source 1..20: mol_type = other DNA
ccacaactgctaggacagcc

SEQ ID NO: 1540 - DNA, 20 bp, synthetic construct
  misc_feature 1..20: note = CRISPR gRNA sequence
  source 1..20: mol_type = other DNA
aactgctaggacagccaggc

SEQ ID NO: 1541 - DNA, 20 bp, synthetic construct
  misc_feature 1..20: note = CRISPR gRNA sequence
  source 1..20: mol_type = other DNA
gccagcaacaatgcccacga

SEQ ID NO: 1542 - DNA, 20 bp, synthetic construct
  misc_feature 1..20: note = CRISPR gRNA sequence
  source 1..20: mol_type = other DNA
ccagcaacaatgcccacgat

SEQ ID NO: 1543 - DNA, 20 bp, synthetic construct
  misc_feature 1..20: note = CRISPR gRNA sequence
  source 1..20: mol_type = other DNA
cagcaacaatgcccacgatg

SEQ ID NO: 1544 - DNA, 20 bp, synthetic construct
  misc_feature 1..20: note = CRISPR gRNA sequence
  source 1..20: mol_type = other DNA
aacaatgcccacgatgggga

SEQ ID NO: 1545 - DNA, 20 bp, synthetic construct
  misc_feature 1..20: note = CRISPR gRNA sequence
  source 1..20: mol_type = other DNA
aatgcccacgatggggacgg

SEQ ID NO: 1546 - DNA, 20 bp, synthetic construct
  misc_feature 1..20: note = CRISPR gRNA sequence
  source 1..20: mol_type = other DNA
ccacgatggggacggtggac

SEQ ID NO: 1547 - DNA, 20 bp, synthetic construct
  misc_feature 1..20: note = CRISPR gRNA sequence
  source 1..20: mol_type = other DNA
cacgatggggacggtggact

SEQ ID NO: 1548 - DNA, 20 bp, synthetic construct
  misc_feature 1..20: note = CRISPR gRNA sequence
  source 1..20: mol_type = other DNA
gatggggacggtggactggg

SEQ ID NO: 1549 - DNA, 20 bp, synthetic construct
  misc_feature 1..20: note = CRISPR gRNA sequence
  source 1..20: mol_type = other DNA
gggacggtggactgggaaga

SEQ ID NO: 1550 - DNA, 20 bp, synthetic construct
  misc_feature 1..20: note = CRISPR gRNA sequence
  source 1..20: mol_type = other DNA
gtggactgggaagacggctc

SEQ ID NO: 1551 - DNA, 20 bp, synthetic construct
  misc_feature 1..20: note = CRISPR gRNA sequence
  source 1..20: mol_type = other DNA
tggactgggaagacggctct

SEQ ID NO: 1552 - DNA, 20 bp, synthetic construct
  misc_feature 1..20: note = CRISPR gRNA sequence
  source 1..20: mol_type = other DNA
ctgggaagacggctctggga

SEQ ID NO: 1553 - DNA, 20 bp, synthetic construct
  misc_feature 1..20: note = CRISPR gRNA sequence
  source 1..20: mol_type = other DNA
tgggaagacggctctgggaa

SEQ ID NO: 1554 - DNA, 20 bp, synthetic construct
  misc_feature 1..20: note = CRISPR gRNA sequence
  source 1..20: mol_type = other DNA
ggaagacggctctgggaaag

SEQ ID NO: 1555 - DNA, 20 bp, synthetic construct
  misc_feature 1..20: note = CRISPR gRNA sequence
  source 1..20: mol_type = other DNA
gaagacggctctgggaaagg

SEQ ID NO: 1556 - DNA, 20 bp, synthetic construct
  misc_feature 1..20: note = CRISPR gRNA sequence
  source 1..20: mol_type = other DNA
aagacggctctgggaaagga

SEQ ID NO: 1557 - DNA, 20 bp, synthetic construct
  misc_feature 1..20: note = CRISPR gRNA sequence
  source 1..20: mol_type = other DNA
agacggctctgggaaaggag

SEQ ID NO: 1558 - DNA, 20 bp, synthetic construct
  misc_feature 1..20: note = CRISPR gRNA sequence
  source 1..20: mol_type = other DNA
cggctctgggaaaggagggg

SEQ ID NO: 1559 - DNA, 20 bp, synthetic construct
  misc_feature 1..20: note = CRISPR gRNA sequence
  source 1..20: mol_type = other DNA
ctgggaaaggaggggaagat

SEQ ID NO: 1560 - DNA, 20 bp, synthetic construct
  misc_feature 1..20: note = CRISPR gRNA sequence
  source 1..20: mol_type = other DNA
tgggaaaggaggggaagatg

SEQ ID NO: 1561 - DNA, 20 bp, synthetic construct
  misc_feature 1..20: note = CRISPR gRNA sequence
  source 1..20: mol_type = other DNA
gggaaaggaggggaagatga

SEQ ID NO: 1562 - DNA, 20 bp, synthetic construct
  misc_feature 1..20: note = CRISPR gRNA sequence
  source 1..20: mol_type = other DNA
ggaaaggaggggaagatgag

SEQ ID NO: 1563 - DNA, 20 bp, synthetic construct
  misc_feature 1..20: note = CRISPR gRNA sequence
  source 1..20: mol_type = other DNA
gaggggccctgaccctgctg

SEQ ID NO: 1564 - DNA, 20 bp, synthetic construct
  misc_feature 1..20: note = CRISPR gRNA sequence
  source 1..20: mol_type = other DNA
aggggccctgaccctgctga

SEQ ID NO: 1565 - DNA, 20 bp, synthetic construct
  misc_feature 1..20: note = CRISPR gRNA sequence
  source 1..20: mol_type = other DNA
ggggccctgaccctgctgaa

SEQ ID NO: 1566 - DNA, 20 bp, synthetic construct
  misc_feature 1..20: note = CRISPR gRNA sequence
  source 1..20: mol_type = other DNA
gaagggctcctgctttccct

SEQ ID NO: 1567 - DNA, 20 bp, synthetic construct
  misc_feature 1..20: note = CRISPR gRNA sequence
  source 1..20: mol_type = other DNA
gggctcctgctttccctgag

SEQ ID NO: 1568 - DNA, 20 bp, synthetic construct
  misc_feature 1..20: note = CRISPR gRNA sequence
  source 1..20: mol_type = other DNA
gctcctgctttccctgagaa

SEQ ID NO: 1569 - DNA, 20 bp, synthetic construct
  misc_feature 1..20: note = CRISPR gRNA sequence
  source 1..20: mol_type = other DNA
tccccctccttaccccatct

SEQ ID NO: 1570 - DNA, 20 bp, synthetic construct
  misc_feature 1..20: note = CRISPR gRNA sequence
  source 1..20: mol_type = other DNA
ccccctccttaccccatctc

SEQ ID NO: 1571 - DNA, 20 bp, synthetic construct
  misc_feature 1..20: note = CRISPR gRNA sequence
  source 1..20: mol_type = other DNA
cccctccttaccccatctca

SEQ ID NO: 1572 - DNA, 20 bp, synthetic construct
  misc_feature 1..20: note = CRISPR gRNA sequence
  source 1..20: mol_type = other DNA
tccttaccccatctcagggt

SEQ ID NO: 1573 - DNA, 20 bp, synthetic construct
  misc_feature 1..20: note = CRISPR gRNA sequence
  source 1..20: mol_type = other DNA
ccttaccccatctcagggtg

SEQ ID NO: 1574 - DNA, 20 bp, synthetic construct
  misc_feature 1..20: note = CRISPR gRNA sequence
  source 1..20: mol_type = other DNA
cttaccccatctcagggtga

SEQ ID NO: 1575 - DNA, 20 bp, synthetic construct
  misc_feature 1..20: note = CRISPR gRNA sequence
  source 1..20: mol_type = other DNA
ttaccccatctcagggtgag

SEQ ID NO: 1576 - DNA, 20 bp, synthetic construct
  misc_feature 1..20: note = CRISPR gRNA sequence
  source 1..20: mol_type = other DNA
catctcagggtgaggggctt

SEQ ID NO: 1577 - DNA, 20 bp, synthetic construct
  misc_feature 1..20: note = CRISPR gRNA sequence
  source 1..20: mol_type = other DNA
ctcagggtgaggggcttcgg

SEQ ID NO: 1578 - DNA, 20 bp, synthetic construct
  misc_feature 1..20: note = CRISPR gRNA sequence
  source 1..20: mol_type = other DNA
gcagcccctcatgctgtaca

SEQ ID NO: 1579 - DNA, 20 bp, synthetic construct
  misc_feature 1..20: note = CRISPR gRNA sequence
  source 1..20: mol_type = other DNA
tgtgtatctctgctcttctc

SEQ ID NO: 1580 - DNA, 20 bp, synthetic construct
  misc_feature 1..20: note = CRISPR gRNA sequence
  source 1..20: mol_type = other DNA
gtatctctgctcttctccag

SEQ ID NO: 1581 - DNA, 20 bp, synthetic construct
  misc_feature 1..20: note = CRISPR gRNA sequence
  source 1..20: mol_type = other DNA
tatctctgctcttctccaga

SEQ ID NO: 1582 - DNA, 20 bp, synthetic construct
  misc_feature 1..20: note = CRISPR gRNA sequence
  source 1..20: mol_type = other DNA
ttctccagaaggcaccacca

SEQ ID NO: 1583 - DNA, 20 bp, synthetic construct
  misc_feature 1..20: note = CRISPR gRNA sequence
  source 1..20: mol_type = other DNA
ccaccacagctgcccacttc

SEQ ID NO: 1584 - DNA, 20 bp, synthetic construct
  misc_feature 1..20: note = CRISPR gRNA sequence
  source 1..20: mol_type = other DNA
ccacagctgcccacttctgg

SEQ ID NO: 1585 - DNA, 20 bp, synthetic construct
  misc_feature 1..20: note = CRISPR gRNA sequence
  source 1..20: mol_type = other DNA
cacagctgcccacttctgga

SEQ ID NO: 1586 - DNA, 20 bp, synthetic construct
  misc_feature 1..20: note = CRISPR gRNA sequence
  source 1..20: mol_type = other DNA
tggaaggttctatctcctgc

SEQ ID NO: 1587 - DNA, 20 bp, synthetic construct
  misc_feature 1..20: note = CRISPR gRNA sequence
  source 1..20: mol_type = other DNA
ggttctatctcctgctggtc

SEQ ID NO: 1588 - DNA, 20 bp, synthetic construct
  misc_feature 1..20: note = CRISPR gRNA sequence
  source 1..20: mol_type = other DNA
cctgctggtctggtctccac

SEQ ID NO: 1589 - DNA, 20 bp, synthetic construct
  misc_feature 1..20: note = CRISPR gRNA sequence
  source 1..20: mol_type = other DNA
tggtctggtctccacaagct

SEQ ID NO: 1590 - DNA, 20 bp, synthetic construct
  misc_feature 1..20: note = CRISPR gRNA sequence
  source 1..20: mol_type = other DNA
ctccacaagctcagtgtcct

SEQ ID NO: 1591 - DNA, 20 bp, synthetic construct
  misc_feature 1..20: note = CRISPR gRNA sequence
  source 1..20: mol_type = other DNA
caagctcagtgtcctgagtt

SEQ ID NO: 1592 - DNA, 20 bp, synthetic construct
  misc_feature 1..20: note = CRISPR gRNA sequence
  source 1..20: mol_type = other DNA
ggtcctcgccatcccgctgc

SEQ ID NO: 1593 - DNA, 20 bp, synthetic construct
  misc_feature 1..20: note = CRISPR gRNA sequence
  source 1..20: mol_type = other DNA
gtcctcgccatcccgctgcc

SEQ ID NO: 1594 - DNA, 20 bp, synthetic construct
  misc_feature 1..20: note = CRISPR gRNA sequence
  source 1..20: mol_type = other DNA
tcgccatcccgctgccaggt

SEQ ID NO: 1595 - DNA, 20 bp, synthetic construct
  misc_feature 1..20: note = CRISPR gRNA sequence
  source 1..20: mol_type = other DNA
ccaggtcagtgtgatctccg

SEQ ID NO: 1596 - DNA, 20 bp, synthetic construct
  misc_feature 1..20: note = CRISPR gRNA sequence
  source 1..20: mol_type = other DNA
caggtcagtgtgatctccgc

SEQ ID NO: 1597 - DNA, 20 bp, synthetic construct
  misc_feature 1..20: note = CRISPR gRNA sequence
  source 1..20: mol_type = other DNA
aggtcagtgtgatctccgca

SEQ ID NO: 1598 - DNA, 20 bp, synthetic construct
  misc_feature 1..20: note = CRISPR gRNA sequence
  source 1..20: mol_type = other DNA
tcagtgtgatctccgcaggg

SEQ ID NO: 1599 - DNA, 20 bp, synthetic construct
  misc_feature 1..20: note = CRISPR gRNA sequence
  source 1..20: mol_type = other DNA
atctccgcagggtagaaacc

SEQ ID NO: 1600 - DNA, 20 bp, synthetic construct
  misc_feature 1..20: note = CRISPR gRNA sequence
  source 1..20: mol_type = other DNA
tctccgcagggtagaaaccc

SEQ ID NO: 1601 - DNA, 20 bp, synthetic construct
  misc_feature 1..20: note = CRISPR gRNA sequence
  source 1..20: mol_type = other DNA
ctccgcagggtagaaaccca

SEQ ID NO: 1602 - DNA, 20 bp, synthetic construct
  misc_feature 1..20: note = CRISPR gRNA sequence
  source 1..20: mol_type = other DNA
cagggtagaaacccagggcc

SEQ ID NO: 1603 - DNA, 20 bp, synthetic construct
  misc_feature 1..20: note = CRISPR gRNA sequence
  source 1..20: mol_type = other DNA
aaacccagggcccagcacct

SEQ ID NO: 1604 - DNA, 20 bp, synthetic construct
  misc_feature 1..20: note = CRISPR gRNA sequence
  source 1..20: mol_type = other DNA
aacccagggcccagcacctc

SEQ ID NO: 1605 - DNA, 20 bp, synthetic construct
  misc_feature 1..20: note = CRISPR gRNA sequence
  source 1..20: mol_type = other DNA
acccagggcccagcacctca

SEQ ID NO: 1606 - DNA, 20 bp, synthetic construct
  misc_feature 1..20: note = CRISPR gRNA sequence
  source 1..20: mol_type = other DNA
cagggcccagcacctcaggg

SEQ ID NO: 1607 - DNA, 20 bp, synthetic construct
  misc_feature 1..20: note = CRISPR gRNA sequence
  source 1..20: mol_type = other DNA
agcacctcagggtggcctca

SEQ ID NO: 1608 - DNA, 20 bp, synthetic construct
  misc_feature 1..20: note = CRISPR gRNA sequence
  source 1..20: mol_type = other DNA
cctcagggtggcctcatggt

SEQ ID NO: 1609 - DNA, 20 bp, synthetic construct
  misc_feature 1..20: note = CRISPR gRNA sequence
  source 1..20: mol_type = other DNA
tcagggtggcctcatggtca

SEQ ID NO: 1610 - DNA, 20 bp, synthetic construct
  misc_feature 1..20: note = CRISPR gRNA sequence
  source 1..20: mol_type = other DNA
ggtggcctcatggtcagaga

SEQ ID NO: 1611 - DNA, 20 bp, synthetic construct
  misc_feature 1..20: note = CRISPR gRNA sequence
  source 1..20: mol_type = other DNA
gtggcctcatggtcagagat

SEQ ID NO: 1612 - DNA, 20 bp, synthetic construct
  misc_feature 1..20: note = CRISPR gRNA sequence
  source 1..20: mol_type = other DNA
tggcctcatggtcagagatg

SEQ ID NO: 1613 - DNA, 20 bp, synthetic construct
  misc_feature 1..20: note = CRISPR gRNA sequence
  source 1..20: mol_type = other DNA
cctcatggtcagagatgggg

SEQ ID NO: 1614 - DNA, 20 bp, synthetic construct
  misc_feature 1..20: note = CRISPR gRNA sequence
  source 1..20: mol_type = other DNA
catggtcagagatggggtgg

SEQ ID NO: 1615 - DNA, 20 bp, synthetic construct
  misc_feature 1..20: note = CRISPR gRNA sequence
  source 1..20: mol_type = other DNA
atggtcagagatggggtggt

SEQ ID NO: 1616 - DNA, 20 bp, synthetic construct
  misc_feature 1..20: note = CRISPR gRNA sequence
  source 1..20: mol_type = other DNA
tggtgggtcacgtgtgtctt

SEQ ID NO: 1617 - DNA, 20 bp, synthetic construct
  misc_feature 1..20: note = CRISPR gRNA sequence
  source 1..20: mol_type = other DNA
ggtgggtcacgtgtgtcttt

SEQ ID NO: 1618 - DNA, 20 bp, synthetic construct
  misc_feature 1..20: note = CRISPR gRNA sequence
  source 1..20: mol_type = other DNA
gtgggtcacgtgtgtctttg

SEQ ID NO: 1619 - DNA, 20 bp, synthetic construct
  misc_feature 1..20: note = CRISPR gRNA sequence
  source 1..20: mol_type = other DNA
tgggtcacgtgtgtctttgg

SEQ ID NO: 1620 - DNA, 20 bp, synthetic construct
  misc_feature 1..20: note = CRISPR gRNA sequence
  source 1..20: mol_type = other DNA
gggtcacgtgtgtctttggg

SEQ ID NO: 1621 - DNA, 20 bp, synthetic construct
  misc_feature 1..20: note = CRISPR gRNA sequence
  source 1..20: mol_type = other DNA
tgtgtctttggggggtctga

SEQ ID NO: 1622 - DNA, 20 bp, synthetic construct
  misc_feature 1..20: note = CRISPR gRNA sequence
  source 1..20: mol_type = other DNA
gtgtctttggggggtctgat

SEQ ID NO: 1623 - DNA, 20 bp, synthetic construct
  misc_feature 1..20: note = CRISPR gRNA sequence
  source 1..20: mol_type = other DNA
tctttggggggtctgatggg

SEQ ID NO: 1624 - DNA, 20 bp, synthetic construct
  misc_feature 1..20: note = CRISPR gRNA sequence
  source 1..20: mol_type = other DNA
tttggggggtctgatgggaa

SEQ ID NO: 1625 - DNA, 20 bp, synthetic construct
  misc_feature 1..20: note = CRISPR gRNA sequence
  source 1..20: mol_type = other DNA
gggggtctgatgggaagagt

SEQ ID NO: 1626 - DNA, 20 bp, synthetic construct
  misc_feature 1..20: note = CRISPR gRNA sequence
  source 1..20: mol_type = other DNA
atgggaagagtcagaaaatt

SEQ ID NO: 1627 - DNA, 20 bp, synthetic construct
  misc_feature 1..20: note = CRISPR gRNA sequence
  source 1..20: mol_type = other DNA
tgggaagagtcagaaaattc

SEQ ID NO: 1628 - DNA, 20 bp, synthetic construct
  misc_feature 1..20: note = CRISPR gRNA sequence
  source 1..20: mol_type = other DNA
caggcgctttgcatctttca

SEQ ID NO: 1629 - DNA, 20 bp, synthetic construct
  misc_feature 1..20: note = CRISPR gRNA sequence
  source 1..20: mol_type = other DNA
aggcgctttgcatctttcat

SEQ ID NO: 1630 - DNA, 20 bp, synthetic construct
  misc_feature 1..20: note = CRISPR gRNA sequence
  source 1..20: mol_type = other DNA
gcatctttcatgggacaccc

SEQ ID NO: 1631 - DNA, 20 bp, synthetic construct
  misc_feature 1..20: note = CRISPR gRNA sequence
  source 1..20: mol_type = other DNA
catctttcatgggacaccct

SEQ ID NO: 1632 - DNA, 20 bp, synthetic construct
  misc_feature 1..20: note = CRISPR gRNA sequence
  source 1..20: mol_type = other DNA
cctaggaccacccatgtgac

SEQ ID NO: 1633 - DNA, 20 bp, synthetic construct
  misc_feature 1..20: note = CRISPR gRNA sequence
  source 1..20: mol_type = other DNA
accacccatgtgaccagcct

SEQ ID NO: 1634 - DNA, 20 bp, synthetic construct
  misc_feature 1..20: note = CRISPR gRNA sequence
  source 1..20: mol_type = other DNA
ccatgtgaccagcctgagaa

SEQ ID NO: 1635 - DNA, 20 bp, synthetic construct
  misc_feature 1..20: note = CRISPR gRNA sequence
  source 1..20: mol_type = other DNA
gtgaccagcctgagaatgga

SEQ ID NO: 1636 - DNA, 20 bp, synthetic construct
  misc_feature 1..20: note = CRISPR gRNA sequence
  source 1..20: mol_type = other DNA
tgaccagcctgagaatggac

SEQ ID NO: 1637 - DNA, 20 bp, synthetic construct
  misc_feature 1..20: note = CRISPR gRNA sequence
  source 1..20: mol_type = other DNA
ctgagaatggacaggacacc

SEQ ID NO: 1638 - DNA, 20 bp, synthetic construct
  misc_feature 1..20: note = CRISPR gRNA sequence
  source 1..20: mol_type = other DNA
tgagaatggacaggacacct

SEQ ID NO: 1639 - DNA, 20 bp, synthetic construct
  misc_feature 1..20: note = CRISPR gRNA sequence
  source 1..20: mol_type = other DNA
gagaatggacaggacacctg

SEQ ID NO: 1640 - DNA, 20 bp, synthetic construct
  misc_feature 1..20: note = CRISPR gRNA sequence
  source 1..20: mol_type = other DNA
aatggacaggacacctgggg

SEQ ID NO: 1641 - DNA, 20 bp, synthetic construct
  misc_feature 1..20: note = CRISPR gRNA sequence
  source 1..20: mol_type = other DNA
atggacaggacacctggggt

SEQ ID NO: 1642 - DNA, 20 bp, synthetic construct
  misc_feature 1..20: note = CRISPR gRNA sequence
  source 1..20: mol_type = other DNA
tggacaggacacctggggtg

SEQ ID NO: 1643 - DNA, 20 bp, synthetic construct
  misc_feature 1..20: note = CRISPR gRNA sequence
  source 1..20: mol_type = other DNA
acaggacacctggggtgggg

SEQ ID NO: 1644 - DNA, 20 bp, synthetic construct
  misc_feature 1..20: note = CRISPR gRNA sequence
  source 1..20: mol_type = other DNA
caggacacctggggtgggga

SEQ ID NO: 1645 - DNA, 20 bp, synthetic construct
  misc_feature 1..20: note = CRISPR gRNA sequence
  source 1..20: mol_type = other DNA
aggacacctggggtggggaa

SEQ ID NO: 1646 - DNA, 20 bp, synthetic construct
  misc_feature 1..20: note = CRISPR gRNA sequence
  source 1..20: mol_type = other DNA
ggacacctggggtggggaag

SEQ ID NO: 1647 - DNA, 20 bp, synthetic construct
  misc_feature 1..20: note = CRISPR gRNA sequence
  source 1..20: mol_type = other DNA
cctggggtggggaaggggca

SEQ ID NO: 1648 - DNA, 20 bp, synthetic construct
  misc_feature 1..20: note = CRISPR gRNA sequence
  source 1..20: mol_type = other DNA
tggggaaggggcacagaacc

SEQ ID NO: 1649 - DNA, 20 bp, synthetic construct
  misc_feature 1..20: note = CRISPR gRNA sequence
  source 1..20: mol_type = other DNA
ggggcacagaacccagacac

SEQ ID NO: 1650 - DNA, 20 bp, synthetic construct
  misc_feature 1..20: note = CRISPR gRNA sequence
  source 1..20: mol_type = other DNA
acagaacccagacaccagcc

SEQ ID NO: 1651 - DNA, 20 bp, synthetic construct
  misc_feature 1..20: note = CRISPR gRNA sequence
  source 1..20: mol_type = other DNA
cccagacaccagcctggacg

SEQ ID NO: 1652 - DNA, 20 bp, synthetic construct
  misc_feature 1..20: note = CRISPR gRNA sequence
  source 1..20: mol_type = other DNA
ccagacaccagcctggacgc

SEQ ID NO: 1653 - DNA, 20 bp, synthetic construct
  misc_feature 1..20: note = CRISPR gRNA sequence
  source 1..20: mol_type = other DNA
ccagcctggacgcaggcacc

SEQ ID NO: 1654 - DNA, 20 bp, synthetic construct
  misc_feature 1..20: note = CRISPR gRNA sequence
  source 1..20: mol_type = other DNA
cagcctggacgcaggcacct

SEQ ID NO: 1655 - DNA, 20 bp, synthetic construct
  misc_feature 1..20: note = CRISPR gRNA sequence
  source 1..20: mol_type = other DNA
tgggataatctcctattcat

SEQ ID NO: 1656 - DNA, 20 bp, synthetic construct
  misc_feature 1..20: note = CRISPR gRNA sequence
  source 1..20: mol_type = other DNA
ataatctcctattcattgga

SEQ ID NO: 1657 - DNA, 20 bp, synthetic construct
  misc_feature 1..20: note = CRISPR gRNA sequence
  source 1..20: mol_type = other DNA
tcctattcattggaaagttc

SEQ ID NO: 1658 - DNA, 20 bp, synthetic construct
  misc_feature 1..20: note = CRISPR gRNA sequence
  source 1..20: mol_type = other DNA
attggaaagttcgagtctct

SEQ ID NO: 1659 - DNA, 20 bp, synthetic construct
  misc_feature 1..20: note = CRISPR gRNA sequence
  source 1..20: mol_type = other DNA
ggaaagttcgagtctctgag

SEQ ID NO: 1660 - DNA, 20 bp, synthetic construct
  misc_feature 1..20: note = CRISPR gRNA sequence
  source 1..20: mol_type = other DNA
gaaagttcgagtctctgagc

SEQ ID NO: 1661 - DNA, 20 bp, synthetic construct
  misc_feature 1..20: note = CRISPR gRNA sequence
  source 1..20: mol_type = other DNA
aaagttcgagtctctgagcg

SEQ ID NO: 1662 - DNA, 20 bp, synthetic construct
  misc_feature 1..20: note = CRISPR gRNA sequence
  source 1..20: mol_type = other DNA
tcgagtctctgagcggggaa

SEQ ID NO: 1663 - DNA, 20 bp, synthetic construct
  misc_feature 1..20: note = CRISPR gRNA sequence
  source 1..20: mol_type = other DNA
cgagtctctgagcggggaac

SEQ ID NO: 1664 - DNA, 20 bp, synthetic construct
  misc_feature 1..20: note = CRISPR gRNA sequence
  source 1..20: mol_type = other DNA
gagtctctgagcggggaaca

SEQ ID NO: 1665 - DNA, 20 bp, synthetic construct
  misc_feature 1..20: note = CRISPR gRNA sequence
  source 1..20: mol_type = other DNA
gggacttctgctcctgatct

SEQ ID NO: 1666 - DNA, 20 bp, synthetic construct
  misc_feature 1..20: note = CRISPR gRNA sequence
  source 1..20: mol_type = other DNA
acttctgctcctgatctgag

SEQ ID NO: 1667 - DNA, 20 bp, synthetic construct
  misc_feature 1..20: note = CRISPR gRNA sequence
  source 1..20: mol_type = other DNA
ttctgctcctgatctgagtg

SEQ ID NO: 1668 - DNA, 20 bp, synthetic construct
  misc_feature 1..20: note = CRISPR gRNA sequence
  source 1..20: mol_type = other DNA
tctgctcctgatctgagtgg

SEQ ID NO: 1669 - DNA, 20 bp, synthetic construct
  misc_feature 1..20: note = CRISPR gRNA sequence
  source 1..20: mol_type = other DNA
tcctgatctgagtggaggta

SEQ ID NO: 1670 - DNA, 20 bp, synthetic construct
  misc_feature 1..20: note = CRISPR gRNA sequence
  source 1..20: mol_type = other DNA
tgagtggaggtaaagtgact

SEQ ID NO: 1671 - DNA, 20 bp, synthetic construct
  misc_feature 1..20: note = CRISPR gRNA sequence
  source 1..20: mol_type = other DNA
gtggaggtaaagtgactcag

SEQ ID NO: 1672 - DNA, 20 bp, synthetic construct
  misc_feature 1..20: note = CRISPR gRNA sequence
  source 1..20: mol_type = other DNA
gtaaagtgactcagaagtgc

SEQ ID NO: 1673 - DNA, 20 bp, synthetic construct
  misc_feature 1..20: note = CRISPR gRNA sequence
  source 1..20: mol_type = other DNA
tgactcagaagtgctggaat

SEQ ID NO: 1674 - DNA, 20 bp, synthetic construct
  misc_feature 1..20: note = CRISPR gRNA sequence
  source 1..20: mol_type = other DNA
actcagaagtgctggaatca

SEQ ID NO: 1675 - DNA, 20 bp, synthetic construct
  misc_feature 1..20: note = CRISPR gRNA sequence
  source 1..20: mol_type = other DNA
atcagagccccaaacacact

SEQ ID NO: 1676 - DNA, 20 bp, synthetic construct
  misc_feature 1..20: note = CRISPR gRNA sequence
  source 1..20: mol_type = other DNA
gccccaaacacactgagtgt

SEQ ID NO: 1677 - DNA, 20 bp, synthetic construct
  misc_feature 1..20: note = CRISPR gRNA sequence
  source 1..20: mol_type = other DNA
ccccaaacacactgagtgtg

SEQ ID NO: 1678 - DNA, 20 bp, synthetic construct
  misc_feature 1..20: note = CRISPR gRNA sequence
  source 1..20: mol_type = other DNA
caaacacactgagtgtgagg

SEQ ID NO: 1679 - DNA, 20 bp, synthetic construct
  misc_feature 1..20: note = CRISPR gRNA sequence
  source 1..20: mol_type = other DNA
aacacactgagtgtgaggca

SEQ ID NO: 1680 - DNA, 20 bp, synthetic construct
  misc_feature 1..20: note = CRISPR gRNA sequence
  source 1..20: mol_type = other DNA
ctgagtgtgaggcagagaac

SEQ ID NO: 1681 - DNA, 20 bp, synthetic construct
  misc_feature 1..20: note = CRISPR gRNA sequence
  source 1..20: mol_type = other DNA
tgagtgtgaggcagagaaca

SEQ ID NO: 1682 - DNA, 20 bp, synthetic construct
  misc_feature 1..20: note = CRISPR gRNA sequence
  source 1..20: mol_type = other DNA
tgaggcagagaacaaggcct

SEQ ID NO: 1683 - DNA, 20 bp, synthetic construct
  misc_feature 1..20: note = CRISPR gRNA sequence
  source 1..20: mol_type = other DNA
aggcagagaacaaggcctga

SEQ ID NO: 1684 - DNA, 20 bp, synthetic construct
  misc_feature 1..20: note = CRISPR gRNA sequence
  source 1..20: mol_type = other DNA
ggcagagaacaaggcctgag

SEQ ID NO: 1685 - DNA, 20 bp, synthetic construct
  misc_feature 1..20: note = CRISPR gRNA sequence
  source 1..20: mol_type = other DNA
agaacaaggcctgagaggaa

SEQ ID NO: 1686 - DNA, 20 bp, synthetic construct
  misc_feature 1..20: note = CRISPR gRNA sequence
  source 1..20: mol_type = other DNA
aggcctgagaggaaaagtca

SEQ ID NO: 1687 - DNA, 20 bp, synthetic construct
  misc_feature 1..20: note = CRISPR gRNA sequence
  source 1..20: mol_type = other DNA
gaggaaaagtcacggttccc

SEQ ID NO: 1688 - DNA, 20 bp, synthetic construct
  misc_feature 1..20: note = CRISPR gRNA sequence
  source 1..20: mol_type = other DNA
aggaaaagtcacggttccca

SEQ ID NO: 1689 - DNA, 20 bp, synthetic construct
  misc_feature 1..20: note = CRISPR gRNA sequence
  source 1..20: mol_type = other DNA
cacggttcccaaggctgctg

SEQ ID NO: 1690 - DNA, 20 bp, synthetic construct
  misc_feature 1..20: note = CRISPR gRNA sequence
  source 1..20: mol_type = other DNA
acggttcccaaggctgctgc

SEQ ID NO: 1691 - DNA, 20 bp, synthetic construct
  misc_feature 1..20: note = CRISPR gRNA sequence
  source 1..20: mol_type = other DNA
cggttcccaaggctgctgca

SEQ ID NO: 1692 - DNA, 20 bp, synthetic construct
  misc_feature 1..20: note = CRISPR gRNA sequence
  source 1..20: mol_type = other DNA
ggttcccaaggctgctgcag

SEQ ID NO: 1693 - DNA, 20 bp, synthetic construct
  misc_feature 1..20: note = CRISPR gRNA sequence
  source 1..20: mol_type = other DNA
caaggctgctgcaggggtca

SEQ ID NO: 1694 - DNA, 20 bp, synthetic construct
  misc_feature 1..20: note = CRISPR gRNA sequence
  source 1..20: mol_type = other DNA
aaggctgctgcaggggtcaa

SEQ ID NO: 1695 - DNA, 20 bp, synthetic construct
  misc_feature 1..20: note = CRISPR gRNA sequence
  source 1..20: mol_type = other DNA
aggctgctgcaggggtcaaa

SEQ ID NO: 1696 - DNA, 20 bp, synthetic construct
  misc_feature 1..20: note = CRISPR gRNA sequence
  source 1..20: mol_type = other DNA
ggctgctgcaggggtcaaag

SEQ ID NO: 1697 - DNA, 20 bp, synthetic construct
  misc_feature 1..20: note = CRISPR gRNA sequence
  source 1..20: mol_type = other DNA
ggtcaaaggggacccctgat

SEQ ID NO: 1698 - DNA, 20 bp, synthetic construct
  misc_feature 1..20: note = CRISPR gRNA sequence
  source 1..20: mol_type = other DNA
gggacccctgatcagtattc

SEQ ID NO: 1699 - DNA, 20 bp, synthetic construct
  misc_feature 1..20: note = CRISPR gRNA sequence
  source 1..20: mol_type = other DNA
ggacccctgatcagtattct

SEQ ID NO: 1700 - DNA, 20 bp, synthetic construct
  misc_feature 1..20: note = CRISPR gRNA sequence
  source 1..20: mol_type = other DNA
gacccctgatcagtattcta

SEQ ID NO: 1701 - DNA, 20 bp, synthetic construct
  misc_feature 1..20: note = CRISPR gRNA sequence
  source 1..20: mol_type = other DNA
tgtcttcccctccatttcct

SEQ ID NO: 1702 - DNA, 20 bp, synthetic construct
  misc_feature 1..20: note = CRISPR gRNA sequence
  source 1..20: mol_type = other DNA
tcttcccctccatttcctca

SEQ ID NO: 1703 - DNA, 20 bp, synthetic construct
  misc_feature 1..20: note = CRISPR gRNA sequence
  source 1..20: mol_type = other DNA
gacgtcattccttaattgtc

SEQ ID NO: 1704 - DNA, 20 bp, synthetic construct
  misc_feature 1..20: note = CRISPR gRNA sequence
  source 1..20: mol_type = other DNA
cgtcattccttaattgtcta

SEQ ID NO: 1705 - DNA, 20 bp, synthetic construct
  misc_feature 1..20: note = CRISPR gRNA sequence
  source 1..20: mol_type = other DNA
tcattccttaattgtctaga

SEQ ID NO: 1706 - DNA, 20 bp, synthetic construct
  misc_feature 1..20: note = CRISPR gRNA sequence
  source 1..20: mol_type = other DNA
ttccttaattgtctagagag

SEQ ID NO: 1707 - DNA, 20 bp, synthetic construct
  misc_feature 1..20: note = CRISPR gRNA sequence
  source 1..20: mol_type = other DNA
ccttaattgtctagagagaa

SEQ ID NO: 1708 - DNA, 20 bp, synthetic construct
  misc_feature 1..20: note = CRISPR gRNA sequence
  source 1..20: mol_type = other DNA
cttaattgtctagagagaag

SEQ ID NO: 1709 - DNA, 20 bp, synthetic construct
  misc_feature 1..20: note = CRISPR gRNA sequence
  source 1..20: mol_type = other DNA
ttaattgtctagagagaaga

SEQ ID NO: 1710 - DNA, 20 bp, synthetic construct
  misc_feature 1..20: note = CRISPR gRNA sequence
  source 1..20: mol_type = other DNA
taattgtctagagagaagag

SEQ ID NO: 1711 - DNA, 20 bp, synthetic construct
  misc_feature 1..20: note = CRISPR gRNA sequence
  source 1..20: mol_type = other DNA
aattgtctagagagaagagg

SEQ ID NO: 1712 - DNA, 20 bp, synthetic construct
  misc_feature 1..20: note = CRISPR gRNA sequence
  source 1..20: mol_type = other DNA
tagagagaagagggggccct

SEQ ID NO: 1713 - DNA, 20 bp, synthetic construct
  misc_feature 1..20: note = CRISPR gRNA sequence
  source 1..20: mol_type = other DNA
gagagaagagggggccctca

SEQ ID NO: 1714 - DNA, 20 bp, synthetic construct
  misc_feature 1..20: note = CRISPR gRNA sequence
  source 1..20: mol_type = other DNA
agagaagagggggccctcag

SEQ ID NO: 1715 - DNA, 20 bp, synthetic construct
  misc_feature 1..20: note = CRISPR gRNA sequence
  source 1..20: mol_type = other DNA
gggggccctcagaggaaact

SEQ ID NO: 1716 - DNA, 20 bp, synthetic construct
  misc_feature 1..20: note = CRISPR gRNA sequence
  source 1..20: mol_type = other DNA
ggggccctcagaggaaactc

SEQ ID NO: 1717 - DNA, 20 bp, synthetic construct
  misc_feature 1..20: note = CRISPR gRNA sequence
  source 1..20: mol_type = other DNA
tcatgccattctccattcaa

SEQ ID NO: 1718 - DNA, 20 bp, synthetic construct
  misc_feature 1..20: note = CRISPR gRNA sequence
  source 1..20: mol_type = other DNA
atgccattctccattcaacg

SEQ ID NO: 1719 - DNA, 20 bp, synthetic construct
  misc_feature 1..20: note = CRISPR gRNA sequence
  source 1..20: mol_type = other DNA
tgccattctccattcaacgg

SEQ ID NO: 1720 - DNA, 20 bp, synthetic construct
  misc_feature 1..20: note = CRISPR gRNA sequence
  source 1..20: mol_type = other DNA
gccattctccattcaacgga

SEQ ID NO: 1721 - DNA, 20 bp, synthetic construct
  misc_feature 1..20: note = CRISPR gRNA sequence
  source 1..20: mol_type = other DNA
ttcaacggagggcgacattc

SEQ ID NO: 1722 - DNA, 20 bp, synthetic construct
  misc_feature 1..20: note = CRISPR gRNA sequence
  source 1..20: mol_type = other DNA
ccattttcctcctcttctcg

SEQ ID NO: 1723 - DNA, 20 bp, synthetic construct
  misc_feature 1..20: note = CRISPR gRNA sequence
  source 1..20: mol_type = other DNA
cattttcctcctcttctcgt

SEQ ID NO: 1724 - DNA, 20 bp, synthetic construct
  misc_feature 1..20: note = CRISPR gRNA sequence
  source 1..20: mol_type = other DNA
ttttcctcctcttctcgtgg

SEQ ID NO: 1725 - DNA, 20 bp, synthetic construct
  misc_feature 1..20: note = CRISPR gRNA sequence
  source 1..20: mol_type = other DNA
tttcctcctcttctcgtggg

SEQ ID NO: 1726 - DNA, 20 bp, synthetic construct
  misc_feature 1..20: note = CRISPR gRNA sequence
  source 1..20: mol_type = other DNA
ttctcgtgggaggccatccc

SEQ ID NO: 1727 - DNA, 20 bp, synthetic construct
  misc_feature 1..20: note = CRISPR gRNA sequence
  source 1..20: mol_type = other DNA
aggccatccccggcgaccta

SEQ ID NO: 1728 - DNA, 20 bp, synthetic construct
  misc_feature 1..20: note = CRISPR gRNA sequence
  source 1..20: mol_type = other DNA
ggccatccccggcgacctat

SEQ ID NO: 1729 - DNA, 20 bp, synthetic construct
  misc_feature 1..20: note = CRISPR gRNA sequence
  source 1..20: mol_type = other DNA
ccatccccggcgacctatag

SEQ ID NO: 1730 - DNA, 20 bp, synthetic construct
  misc_feature 1..20: note = CRISPR gRNA sequence
  source 1..20: mol_type = other DNA
ccccggcgacctataggaga

SEQ ID NO: 1731 - DNA, 20 bp, synthetic construct
  misc_feature 1..20: note = CRISPR gRNA sequence
  source 1..20: mol_type = other DNA
cccggcgacctataggagat

SEQ ID NO: 1732 - DNA, 20 bp, synthetic construct
  misc_feature 1..20: note = CRISPR gRNA sequence
  source 1..20: mol_type = other DNA
ccggcgacctataggagatg

SEQ ID NO: 1733 - DNA, 20 bp, synthetic construct
  misc_feature 1..20: note = CRISPR gRNA sequence
  source 1..20: mol_type = other DNA
gcgacctataggagatgggg

SEQ ID NO: 1734 - DNA, 20 bp, synthetic construct
  misc_feature 1..20: note = CRISPR gRNA sequence
  source 1..20: mol_type = other DNA
cgacctataggagatgggga

SEQ ID NO: 1735 - DNA, 20 bp, synthetic construct
  misc_feature 1..20: note = CRISPR gRNA sequence
  source 1..20: mol_type = other DNA
ggaaggctccccactgcccc

SEQ ID NO: 1736 - DNA, 20 bp, synthetic construct
  misc_feature 1..20: note = CRISPR gRNA sequence
  source 1..20: mol_type = other DNA
ctccccactgcccctggtac

SEQ ID NO: 1737 - DNA, 20 bp, synthetic construct
  misc_feature 1..20: note = CRISPR gRNA sequence
  source 1..20: mol_type = other DNA
cccctggtaccagcgcgctc

SEQ ID NO: 1738 - DNA, 20 bp, synthetic construct
  misc_feature 1..20: note = CRISPR gRNA sequence
  source 1..20: mol_type = other DNA
agcttgtccttcccgttctc

SEQ ID NO: 1739 - DNA, 20 bp, synthetic construct
  misc_feature 1..20: note = CRISPR gRNA sequence
  source 1..20: mol_type = other DNA
gcttgtccttcccgttctcc

SEQ ID NO: 1740 - DNA, 20 bp, synthetic construct
  misc_feature 1..20: note = CRISPR gRNA sequence
  source 1..20: mol_type = other DNA
tcccgttctccaggtatctg

SEQ ID NO: 1741 - DNA, 20 bp, synthetic construct
  misc_feature 1..20: note = CRISPR gRNA sequence
  source 1..20: mol_type = other DNA
ccgttctccaggtatctgcg

SEQ ID NO: 1742 - DNA, 20 bp, synthetic construct
  misc_feature 1..20: note = CRISPR gRNA sequence
  source 1..20: mol_type = other DNA
cactccacgcactcgccctc

SEQ ID NO: 1743 - DNA, 20 bp, synthetic construct
  misc_feature 1..20: note = CRISPR gRNA sequence
  source 1..20: mol_type = other DNA
actccacgcactcgccctcc

SEQ ID NO: 1744 - DNA, 20 bp, synthetic construct
  misc_feature 1..20: note = CRISPR gRNA sequence
  source 1..20: mol_type = other DNA
ccacgcactcgccctccagg

SEQ ID NO: 1745 - DNA, 20 bp, synthetic construct
  misc_feature 1..20: note = CRISPR gRNA sequence
  source 1..20: mol_type = other DNA
cacgcactcgccctccaggt

SEQ ID NO: 1746 - DNA, 20 bp, synthetic construct
  misc_feature 1..20: note = CRISPR gRNA sequence
  source 1..20: mol_type = other DNA
ctctccgctgctccgcctca

SEQ ID NO: 1747 - DNA, 20 bp, synthetic construct
  misc_feature 1..20: note = CRISPR gRNA sequence
  source 1..20: mol_type = other DNA
tctccgctgctccgcctcac

SEQ ID NO: 1748 - DNA, 20 bp, synthetic construct
  misc_feature 1..20: note = CRISPR gRNA sequence
  source 1..20: mol_type = other DNA
gggccgcctcccacttgcgc

SEQ ID NO: 1749 - DNA, 20 bp, synthetic construct
  misc_feature 1..20: note = CRISPR gRNA sequence
  source 1..20: mol_type = other DNA
ggccgcctcccacttgcgct

SEQ ID NO: 1750 - DNA, 20 bp, synthetic construct
  misc_feature 1..20: note = CRISPR gRNA sequence
  source 1..20: mol_type = other DNA
ccacttgcgctgggtgatct

SEQ ID NO: 1751 - DNA, 20 bp, synthetic construct
  misc_feature 1..20: note = CRISPR gRNA sequence
  source 1..20: mol_type = other DNA
gatctgagccgccgtgtccg

SEQ ID NO: 1752 - DNA, 20 bp, synthetic construct
  misc_feature 1..20: note = CRISPR gRNA sequence
  source 1..20: mol_type = other DNA
ctgagccgccgtgtccgcgg

SEQ ID NO: 1753 - DNA, 20 bp, synthetic construct
  misc_feature 1..20: note = CRISPR gRNA sequence
  source 1..20: mol_type = other DNA
ccgccgtgtccgcggcggtc

SEQ ID NO: 1754 - DNA, 20 bp, synthetic construct
  misc_feature 1..20: note = CRISPR gRNA sequence
  source 1..20: mol_type = other DNA
cgccgtgtccgcggcggtcc

SEQ ID NO: 1755 - DNA, 20 bp, synthetic construct
  misc_feature 1..20: note = CRISPR gRNA sequence
  source 1..20: mol_type = other DNA
ccgtgtccgcggcggtccag

SEQ ID NO: 1756 - DNA, 20 bp, synthetic construct
  misc_feature 1..20: note = CRISPR gRNA sequence
  source 1..20: mol_type = other DNA
tccgcggcggtccaggagcg

SEQ ID NO: 1757 - DNA, 20 bp, synthetic construct
  misc_feature 1..20: note = CRISPR gRNA sequence
  source 1..20: mol_type = other DNA
ccgcggcggtccaggagcgc

SEQ ID NO: 1758 - DNA, 20 bp, synthetic construct
  misc_feature 1..20: note = CRISPR gRNA sequence
  source 1..20: mol_type = other DNA
caggagcgcaggtcctcgtt

SEQ ID NO: 1759 - DNA, 20 bp, synthetic construct
  misc_feature 1..20: note = CRISPR gRNA sequence
  source 1..20: mol_type = other DNA
aggagcgcaggtcctcgttc

SEQ ID NO: 1760 - DNA, 20 bp, synthetic construct
  misc_feature 1..20: note = CRISPR gRNA sequence
  source 1..20: mol_type = other DNA
ggagcgcaggtcctcgttca

SEQ ID NO: 1761 - DNA, 20 bp, synthetic construct
  misc_feature 1..20: note = CRISPR gRNA sequence
  source 1..20: mol_type = other DNA
cgatgtaatccttgccgtcg

SEQ ID NO: 1762 - DNA, 20 bp, synthetic construct
  misc_feature 1..20: note = CRISPR gRNA sequence
  source 1..20: mol_type = other DNA
gatgtaatccttgccgtcgt

SEQ ID NO: 1763 - DNA, 20 bp, synthetic construct
  misc_feature 1..20: note = CRISPR gRNA sequence
  source 1..20: mol_type = other DNA
ccttgccgtcgtaggcgtac

SEQ ID NO: 1764 - DNA, 20 bp, synthetic construct
  misc_feature 1..20: note = CRISPR gRNA sequence
  source 1..20: mol_type = other DNA
aggcgtactggtcatgcccg

SEQ ID NO: 1765 - DNA, 20 bp, synthetic construct
  misc_feature 1..20: note = CRISPR gRNA sequence
  source 1..20: mol_type = other DNA
gcgtactggtcatgcccgcg

SEQ ID NO: 1766 - DNA, 20 bp, synthetic construct
  misc_feature 1..20: note = CRISPR gRNA sequence
  source 1..20: mol_type = other DNA
cgtactggtcatgcccgcgg

SEQ ID NO: 1767 - DNA, 20 bp, synthetic construct
  misc_feature 1..20: note = CRISPR gRNA sequence
  source 1..20: mol_type = other DNA
tactggtcatgcccgcggag

SEQ ID NO: 1768 - DNA, 20 bp, synthetic construct
  misc_feature 1..20: note = CRISPR gRNA sequence
  source 1..20: mol_type = other DNA
actggtcatgcccgcggagg

SEQ ID NO: 1769 - DNA, 20 bp, synthetic construct
  misc_feature 1..20: note = CRISPR gRNA sequence
  source 1..20: mol_type = other DNA
ccgcggaggaggcgcccgtc

SEQ ID NO: 1770 - DNA, 20 bp, synthetic construct
  misc_feature 1..20: note = CRISPR gRNA sequence
  source 1..20: mol_type = other DNA
gcccgtccggccccacgtcg

SEQ ID NO: 1771 - DNA, 20 bp, synthetic construct
  misc_feature 1..20: note = CRISPR gRNA sequence
  source 1..20: mol_type = other DNA
cgtcgcagccgtacatgctc

SEQ ID NO: 1772 - DNA, 20 bp, synthetic construct
  misc_feature 1..20: note = CRISPR gRNA sequence
  source 1..20: mol_type = other DNA
tcgcagccgtacatgctctg

SEQ ID NO: 1773 - DNA, 20 bp, synthetic construct
  misc_feature 1..20: note = CRISPR gRNA sequence
  source 1..20: mol_type = other DNA
cgcagccgtacatgctctgg

SEQ ID NO: 1774 - DNA, 20 bp, synthetic construct
  misc_feature 1..20: note = CRISPR gRNA sequence
  source 1..20: mol_type = other DNA
gcagccgtacatgctctgga

SEQ ID NO: 1775 - DNA, 20 bp, synthetic construct
  misc_feature 1..20: note = CRISPR gRNA sequence
  source 1..20: mol_type = other DNA
gtacatgctctggagggtgt

SEQ ID NO: 1776 - DNA, 20 bp, synthetic construct
  misc_feature 1..20: note = CRISPR gRNA sequence
  source 1..20: mol_type = other DNA
ctctggagggtgtgagaccc

SEQ ID NO: 1777 - DNA, 20 bp, synthetic construct
  misc_feature 1..20: note = CRISPR gRNA sequence
  source 1..20: mol_type = other DNA
agggtgtgagaccctggccc

SEQ ID NO: 1778 - DNA, 20 bp, synthetic construct
  misc_feature 1..20: note = CRISPR gRNA sequence
  source 1..20: mol_type = other DNA
agaccctggccccggccccg

SEQ ID NO: 1779 - DNA, 20 bp, synthetic construct
  misc_feature 1..20: note = CRISPR gRNA sequence
  source 1..20: mol_type = other DNA
cctggccccggccccgcggt

SEQ ID NO: 1780 - DNA, 20 bp, synthetic construct
  misc_feature 1..20: note = CRISPR gRNA sequence
  source 1..20: mol_type = other DNA
ccccggccccgcggtcagcc

SEQ ID NO: 1781 - DNA, 20 bp, synthetic construct
  misc_feature 1..20: note = CRISPR gRNA sequence
  source 1..20: mol_type = other DNA
cgcggtcagcccagtccccc

SEQ ID NO: 1782 - DNA, 20 bp, synthetic construct
  misc_feature 1..20: note = CRISPR gRNA sequence
  source 1..20: mol_type = other DNA
gccccgccccgaccaacccg

SEQ ID NO: 1783 - DNA, 20 bp, synthetic construct
  misc_feature 1..20: note = CRISPR gRNA sequence
  source 1..20: mol_type = other DNA
ccccgccccgaccaacccgc

SEQ ID NO: 1784 - DNA, 20 bp, synthetic construct
  misc_feature 1..20: note = CRISPR gRNA sequence
  source 1..20: mol_type = other DNA
cccgccccgaccaacccgcg

SEQ ID NO: 1785 - DNA, 20 bp, synthetic construct
  misc_feature 1..20: note = CRISPR gRNA sequence
  source 1..20: mol_type = other DNA
cgaccaacccgcggggattt

SEQ ID NO: 1786 - DNA, 20 bp, synthetic construct
  misc_feature 1..20: note = CRISPR gRNA sequence
  source 1..20: mol_type = other DNA
gcctcaactgaaaatgaaac

SEQ ID NO: 1787 - DNA, 20 bp, synthetic construct
  misc_feature 1..20: note = CRISPR gRNA sequence
  source 1..20: mol_type = other DNA
cctcaactgaaaatgaaacc

SEQ ID NO: 1788 - DNA, 20 bp, synthetic construct
  misc_feature 1..20: note = CRISPR gRNA sequence
  source 1..20: mol_type = other DNA
tgaaaccgggtaaacgcgcc

SEQ ID NO: 1789 - DNA, 20 bp, synthetic construct
  misc_feature 1..20: note = CRISPR gRNA sequence
  source 1..20: mol_type = other DNA
gaaaccgggtaaacgcgcct

SEQ ID NO: 1790 - DNA, 20 bp, synthetic construct
  misc_feature 1..20: note = CRISPR gRNA sequence
  source 1..20: mol_type = other DNA
aaaccgggtaaacgcgcctg

SEQ ID NO: 1791 - DNA, 20 bp, synthetic construct
  misc_feature 1..20: note = CRISPR gRNA sequence
  source 1..20: mol_type = other DNA
aacgcgcctggggctctcgc

SEQ ID NO: 1792 - DNA, 20 bp, synthetic construct
  misc_feature 1..20: note = CRISPR gRNA sequence
  source 1..20: mol_type = other DNA
gcctggggctctcgccggtc

SEQ ID NO: 1793 - DNA, 20 bp, synthetic construct
  misc_feature 1..20: note = CRISPR gRNA sequence
  source 1..20: mol_type = other DNA
cctggggctctcgccggtcg

SEQ ID NO: 1794 - DNA, 20 bp, synthetic construct
  misc_feature 1..20: note = CRISPR gRNA sequence
  source 1..20: mol_type = other DNA
ctggggctctcgccggtcga

SEQ ID NO: 1795 - DNA, 20 bp, synthetic construct
  misc_feature 1..20: note = CRISPR gRNA sequence
  source 1..20: mol_type = other DNA
gctctcgccggtcgagggtc

SEQ ID NO: 1796 - DNA, 20 bp, synthetic construct
  misc_feature 1..20: note = CRISPR gRNA sequence
  source 1..20: mol_type = other DNA
ctctcgccggtcgagggtct

SEQ ID NO: 1797 - DNA, 20 bp, synthetic construct
  misc_feature 1..20: note = CRISPR gRNA sequence
  source 1..20: mol_type = other DNA
tcgccggtcgagggtctggg

SEQ ID NO: 1798 - DNA, 20 bp, synthetic construct
  misc_feature 1..20: note = CRISPR gRNA sequence
  source 1..20: mol_type = other DNA
cgccggtcgagggtctgggc

SEQ ID NO: 1799 - DNA, 20 bp, synthetic construct
  misc_feature 1..20: note = CRISPR gRNA sequence
  source 1..20: mol_type = other DNA
gagggtctgggcgggtcccg

SEQ ID NO: 1800 - DNA, 20 bp, synthetic construct
  misc_feature 1..20: note = CRISPR gRNA sequence
  source 1..20: mol_type = other DNA
ctgggcgggtcccgcggcct

SEQ ID NO: 1801 - DNA, 20 bp, synthetic construct
  misc_feature 1..20: note = CRISPR gRNA sequence
  source 1..20: mol_type = other DNA
tgggcgggtcccgcggcctc

SEQ ID NO: 1802 - DNA, 20 bp, synthetic construct
  misc_feature 1..20: note = CRISPR gRNA sequence
  source 1..20: mol_type = other DNA
gggcgggtcccgcggcctca

SEQ ID NO: 1803 - DNA, 20 bp, synthetic construct
  misc_feature 1..20: note = CRISPR gRNA sequence
  source 1..20: mol_type = other DNA
gcgggtcccgcggcctcagg

SEQ ID NO: 1804 - DNA, 20 bp, synthetic construct
  misc_feature 1..20: note = CRISPR gRNA sequence
  source 1..20: mol_type = other DNA
cgggtcccgcggcctcaggg

SEQ ID NO: 1805 - DNA, 20 bp, synthetic construct
  misc_feature 1..20: note = CRISPR gRNA sequence
  source 1..20: mol_type = other DNA
gtcccgcggcctcagggagg

SEQ ID NO: 1806 - DNA, 20 bp, synthetic construct
  misc_feature 1..20: note = CRISPR gRNA sequence
  source 1..20: mol_type = other DNA
ggcctcagggaggcggatct

SEQ ID NO: 1807 - DNA, 20 bp, synthetic construct
  misc_feature 1..20: note = CRISPR gRNA sequence
  source 1..20: mol_type = other DNA
agggaggcggatctcggacc

SEQ ID NO: 1808 - DNA, 20 bp, synthetic construct
  misc_feature 1..20: note = CRISPR gRNA sequence
  source 1..20: mol_type = other DNA
ggaggcggatctcggacccg

SEQ ID NO: 1809 - DNA, 20 bp, synthetic construct
  misc_feature 1..20: note = CRISPR gRNA sequence
  source 1..20: mol_type = other DNA
ggatctcggacccggagact

SEQ ID NO: 1810 - DNA, 20 bp, synthetic construct
  misc_feature 1..20: note = CRISPR gRNA sequence
  source 1..20: mol_type = other DNA
gatctcggacccggagactc

SEQ ID NO: 1811 - DNA, 20 bp, synthetic construct
  misc_feature 1..20: note = CRISPR gRNA sequence
  source 1..20: mol_type = other DNA
atctcggacccggagactcg

SEQ ID NO: 1812 - DNA, 20 bp, synthetic construct
  misc_feature 1..20: note = CRISPR gRNA sequence
  source 1..20: mol_type = other DNA
cccggagactcggggcgacc

SEQ ID NO: 1813 - DNA, 20 bp, synthetic construct
  misc_feature 1..20: note = CRISPR gRNA sequence
  source 1..20: mol_type = other DNA
ccggagactcggggcgaccc

SEQ ID NO: 1814 - DNA, 20 bp, synthetic construct
  misc_feature 1..20: note = CRISPR gRNA sequence
  source 1..20: mol_type = other DNA
ggggcgacccgggccgtacg

SEQ ID NO: 1815 - DNA, 20 bp, synthetic construct
  misc_feature 1..20: note = CRISPR gRNA sequence
  source 1..20: mol_type = other DNA
gggcgacccgggccgtacgt

SEQ ID NO: 1816 - DNA, 20 bp, synthetic construct
  misc_feature 1..20: note = CRISPR gRNA sequence
  source 1..20: mol_type = other DNA
ggcgacccgggccgtacgtg

SEQ ID NO: 1817 - DNA, 20 bp, synthetic construct
  misc_feature 1..20: note = CRISPR gRNA sequence
  source 1..20: mol_type = other DNA
gcgacccgggccgtacgtgg

SEQ ID NO: 1818 - DNA, 20 bp, synthetic construct
  misc_feature 1..20: note = CRISPR gRNA sequence
  source 1..20: mol_type = other DNA
cccgggccgtacgtggggga

SEQ ID NO: 1819 - DNA, 20 bp, synthetic construct
  misc_feature 1..20: note = CRISPR gRNA sequence
  source 1..20: mol_type = other DNA
ccgggccgtacgtgggggat

SEQ ID NO: 1820 - DNA, 20 bp, synthetic construct
  misc_feature 1..20: note = CRISPR gRNA sequence
  source 1..20: mol_type = other DNA
cgggccgtacgtgggggatg

SEQ ID NO: 1821 - DNA, 20 bp, synthetic construct
  misc_feature 1..20: note = CRISPR gRNA sequence
  source 1..20: mol_type = other DNA
ggccgtacgtgggggatggg

SEQ ID NO: 1822 - DNA, 20 bp, synthetic construct
  misc_feature 1..20: note = CRISPR gRNA sequence
  source 1..20: mol_type = other DNA
gggagtcgtgacctgcgccc

SEQ ID NO: 1823 - DNA, 20 bp, synthetic construct
  misc_feature 1..20: note = CRISPR gRNA sequence
  source 1..20: mol_type = other DNA
ggagtcgtgacctgcgcccc

SEQ ID NO: 1824 - DNA, 20 bp, synthetic construct
  misc_feature 1..20: note = CRISPR gRNA sequence
  source 1..20: mol_type = other DNA
tcgtgacctgcgccccgggc

SEQ ID NO: 1825 - DNA, 20 bp, synthetic construct
  misc_feature 1..20: note = CRISPR gRNA sequence
  source 1..20: mol_type = other DNA
cgtgacctgcgccccgggcc

SEQ ID NO: 1826 - DNA, 20 bp, synthetic construct
  misc_feature 1..20: note = CRISPR gRNA sequence
  source 1..20: mol_type = other DNA
gtgacctgcgccccgggccg

SEQ ID NO: 1827 - DNA, 20 bp, synthetic construct
  misc_feature 1..20: note = CRISPR gRNA sequence
  source 1..20: mol_type = other DNA
cccgggccggggtcactcac

SEQ ID NO: 1828 - DNA, 20 bp, synthetic construct
  misc_feature 1..20: note = CRISPR gRNA sequence
  source 1..20: mol_type = other DNA
gtcactcaccggcctcgctc

SEQ ID NO: 1829 - DNA, 20 bp, synthetic construct
  misc_feature 1..20: note = CRISPR gRNA sequence
  source 1..20: mol_type = other DNA
caccggcctcgctctggttg

SEQ ID NO: 1830 - DNA, 20 bp, synthetic construct
  misc_feature 1..20: note = CRISPR gRNA sequence
  source 1..20: mol_type = other DNA
cggcctcgctctggttgtag

SEQ ID NO: 1831 - DNA, 20 bp, synthetic construct
  misc_feature 1..20: note = CRISPR gRNA sequence
  source 1..20: mol_type = other DNA
ctctggttgtagtagccgcg

SEQ ID NO: 1832 - DNA, 20 bp, synthetic construct
  misc_feature 1..20: note = CRISPR gRNA sequence
  source 1..20: mol_type = other DNA
tctggttgtagtagccgcgc

SEQ ID NO: 1833 - DNA, 20 bp, synthetic construct
  misc_feature 1..20: note = CRISPR gRNA sequence
  source 1..20: mol_type = other DNA
tagtagccgcgcaggttccg

SEQ ID NO: 1834 - DNA, 20 bp, synthetic construct
  misc_feature 1..20: note = CRISPR gRNA sequence
  source 1..20: mol_type = other DNA
agtagccgcgcaggttccgc

SEQ ID NO: 1835 - DNA, 20 bp, synthetic construct
  misc_feature 1..20: note = CRISPR gRNA sequence
  source 1..20: mol_type = other DNA
gcaggttccgcaggctctct

SEQ ID NO: 1836 - DNA, 20 bp, synthetic construct
  misc_feature 1..20: note = CRISPR gRNA sequence
  source 1..20: mol_type = other DNA
gttccgcaggctctctcggt

SEQ ID NO: 1837 - DNA, 20 bp, synthetic construct
  misc_feature 1..20: note = CRISPR gRNA sequence
  source 1..20: mol_type = other DNA
tctctcggtcagtctgtgcc

SEQ ID NO: 1838 - DNA, 20 bp, synthetic construct
  misc_feature 1..20: note = CRISPR gRNA sequence
  source 1..20: mol_type = other DNA
ctctcggtcagtctgtgcct

SEQ ID NO: 1839 - DNA, 20 bp, synthetic construct
  misc_feature 1..20: note = CRISPR gRNA sequence
  source 1..20: mol_type = other DNA
cagtctgtgcctgggccttg

SEQ ID NO: 1840 - DNA, 20 bp, synthetic construct
  misc_feature 1..20: note = CRISPR gRNA sequence
  source 1..20: mol_type = other DNA
ccttgtagatctgtgtgttc

SEQ ID NO: 1841 - DNA, 20 bp, synthetic construct
  misc_feature 1..20: note = CRISPR gRNA sequence
  source 1..20: mol_type = other DNA
gtgttccggtcccaatactc

SEQ ID NO: 1842 - DNA, 20 bp, synthetic construct
  misc_feature 1..20: note = CRISPR gRNA sequence
  source 1..20: mol_type = other DNA
ggcccctcctgctctatcca

SEQ ID NO: 1843 - DNA, 20 bp, synthetic construct
  misc_feature 1..20: note = CRISPR gRNA sequence
  source 1..20: mol_type = other DNA
tgctctatccacggcgcccg

SEQ ID NO: 1844 - DNA, 20 bp, synthetic construct
  misc_feature 1..20: note = CRISPR gRNA sequence
  source 1..20: mol_type = other DNA
ggcgcccgcggctcctctct

SEQ ID NO: 1845 - DNA, 20 bp, synthetic construct
  misc_feature 1..20: note = CRISPR gRNA sequence
  source 1..20: mol_type = other DNA
cggctcctctctcggactcg

SEQ ID NO: 1846 - DNA, 20 bp, synthetic construct
  misc_feature 1..20: note = CRISPR gRNA sequence
  source 1..20: mol_type = other DNA
cgctgtcgaacctcacgaac

SEQ ID NO: 1847 - DNA, 20 bp, synthetic construct
  misc_feature 1..20: note = CRISPR gRNA sequence
  source 1..20: mol_type = other DNA
gctgtcgaacctcacgaact

SEQ ID NO: 1848 - DNA, 20 bp, synthetic construct
  misc_feature 1..20: note = CRISPR gRNA sequence
  source 1..20: mol_type = other DNA
cgaactgggtgtcgtccacg

SEQ ID NO: 1849 - DNA, 20 bp, synthetic construct
  misc_feature 1..20: note = CRISPR gRNA sequence
  source 1..20: mol_type = other DNA
tgtcgtccacgtagcccact

SEQ ID NO: 1850 - DNA, 20 bp, synthetic construct
  misc_feature 1..20: note = CRISPR gRNA sequence
  source 1..20: mol_type = other DNA
ccacgtagcccactgagatg

SEQ ID NO: 1851 - DNA, 20 bp, synthetic construct
  misc_feature 1..20: note = CRISPR gRNA sequence
  source 1..20: mol_type = other DNA
cgtagcccactgagatgaag

SEQ ID NO: 1852 - DNA, 20 bp, synthetic construct
  misc_feature 1..20: note = CRISPR gRNA sequence
  source 1..20: mol_type = other DNA
gtagcccactgagatgaagc

SEQ ID NO: 1853 - DNA, 20 bp, synthetic construct
  misc_feature 1..20: note = CRISPR gRNA sequence
  source 1..20: mol_type = other DNA
tagcccactgagatgaagcg

SEQ ID NO: 1854 - DNA, 20 bp, synthetic construct
  misc_feature 1..20: note = CRISPR gRNA sequence
  source 1..20: mol_type = other DNA
agatgaagcggggctccccg

SEQ ID NO: 1855 - DNA, 20 bp, synthetic construct
  misc_feature 1..20: note = CRISPR gRNA sequence
  source 1..20: mol_type = other DNA
gaagcggggctccccgcggc

SEQ ID NO: 1856 - DNA, 20 bp, synthetic construct
  misc_feature 1..20: note = CRISPR gRNA sequence
  source 1..20: mol_type = other DNA
aagcggggctccccgcggcc

SEQ ID NO: 1857 - DNA, 20 bp, synthetic construct
  misc_feature 1..20: note = CRISPR gRNA sequence
  source 1..20: mol_type = other DNA
ggggctccccgcggccgggc

SEQ ID NO: 1858 - DNA, 20 bp, synthetic construct
  misc_feature 1..20: note = CRISPR gRNA sequence
  source 1..20: mol_type = other DNA
gggctccccgcggccgggcc

SEQ ID NO: 1859 - DNA, 20 bp, synthetic construct
  misc_feature 1..20: note = CRISPR gRNA sequence
  source 1..20: mol_type = other DNA
cccgcggccgggccgggaca

SEQ ID NO: 1860 - DNA, 20 bp, synthetic construct
  misc_feature 1..20: note = CRISPR gRNA sequence
  source 1..20: mol_type = other DNA
cgcggccgggccgggacacg

SEQ ID NO: 1861 - DNA, 20 bp, synthetic construct
  misc_feature 1..20: note = CRISPR gRNA sequence
  source 1..20: mol_type = other DNA
gcggccgggccgggacacgg

SEQ ID NO: 1862 - DNA, 20 bp, synthetic construct
  misc_feature 1..20: note = CRISPR gRNA sequence
  source 1..20: mol_type = other DNA
cgggccgggacacggaggtg

SEQ ID NO: 1863 - DNA, 20 bp, synthetic construct
  misc_feature 1..20: note = CRISPR gRNA sequence
  source 1..20: mol_type = other DNA
ggaggtgtagaaatacctca

SEQ ID NO: 1864 - DNA, 20 bp, synthetic construct
  misc_feature 1..20: note = CRISPR gRNA sequence
  source 1..20: mol_type = other DNA
aggtgtagaaatacctcatg

SEQ ID NO: 1865 - DNA, 20 bp, synthetic construct
  misc_feature 1..20: note = CRISPR gRNA sequence
  source 1..20: mol_type = other DNA
tgtagaaatacctcatggag

SEQ ID NO: 1866 - DNA, 20 bp, synthetic construct
  misc_feature 1..20: note = CRISPR gRNA sequence
  source 1..20: mol_type = other DNA
gtagaaatacctcatggagt

SEQ ID NO: 1867 - DNA, 20 bp, synthetic construct
  misc_feature 1..20: note = CRISPR gRNA sequence
  source 1..20: mol_type = other DNA
agaaatacctcatggagtgg

SEQ ID NO: 1868 - DNA, 20 bp, synthetic construct
  misc_feature 1..20: note = CRISPR gRNA sequence
  source 1..20: mol_type = other DNA
tacctcatggagtgggagcc

SEQ ID NO: 1869 - DNA, 20 bp, synthetic construct
  misc_feature 1..20: note = CRISPR gRNA sequence
  source 1..20: mol_type = other DNA
acctcatggagtgggagcct

SEQ ID NO: 1870 - DNA, 20 bp, synthetic construct
  misc_feature 1..20: note = CRISPR gRNA sequence
  source 1..20: mol_type = other DNA
cctcatggagtgggagcctg

SEQ ID NO: 1871 - DNA, 20 bp, synthetic construct
  misc_feature 1..20: note = CRISPR gRNA sequence
  source 1..20: mol_type = other DNA
ctcatggagtgggagcctgg

SEQ ID NO: 1872 - DNA, 20 bp, synthetic construct
  misc_feature 1..20: note = CRISPR gRNA sequence
  source 1..20: mol_type = other DNA
tggagtgggagcctgggggt

SEQ ID NO: 1873 - DNA, 20 bp, synthetic construct
  misc_feature 1..20: note = CRISPR gRNA sequence
  source 1..20: mol_type = other DNA
ggagtgggagcctgggggtg

SEQ ID NO: 1874 - DNA, 20 bp, synthetic construct
  misc_feature 1..20: note = CRISPR gRNA sequence
  source 1..20: mol_type = other DNA
agtgggagcctgggggtgag

SEQ ID NO: 1875 - DNA, 20 bp, synthetic construct
  misc_feature 1..20: note = CRISPR gRNA sequence
  source 1..20: mol_type = other DNA
gtgggagcctgggggtgagg

SEQ ID NO: 1876 - DNA, 20 bp, synthetic construct
  misc_feature 1..20: note = CRISPR gRNA sequence
  source 1..20: mol_type = other DNA
tgggagcctgggggtgagga

SEQ ID NO: 1877 - DNA, 20 bp, synthetic construct
  misc_feature 1..20: note = CRISPR gRNA sequence
  source 1..20: mol_type = other DNA
gggagcctgggggtgaggag

SEQ ID NO: 1878 - DNA, 20 bp, synthetic construct
  misc_feature 1..20: note = CRISPR gRNA sequence
  source 1..20: mol_type = other DNA
cctgggggtgaggaggggct

SEQ ID NO: 1879 - DNA, 20 bp, synthetic construct
  misc_feature 1..20: note = CRISPR gRNA sequence
  source 1..20: mol_type = other DNA
gacccgcccgaccctcctcc

SEQ ID NO: 1880 - DNA, 20 bp, synthetic construct
  misc_feature 1..20: note = CRISPR gRNA sequence
  source 1..20: mol_type = other DNA
gcccgaccctcctcccggcg

SEQ ID NO: 1881 - DNA, 20 bp, synthetic construct
  misc_feature 1..20: note = CRISPR gRNA sequence
  source 1..20: mol_type = other DNA
ctcctcccggcgcggctcct

SEQ ID NO: 1882 - DNA, 20 bp, synthetic construct
  misc_feature 1..20: note = CRISPR gRNA sequence
  source 1..20: mol_type = other DNA
tcctcccggcgcggctcctc

SEQ ID NO: 1883 - DNA, 20 bp, synthetic construct
  misc_feature 1..20: note = CRISPR gRNA sequence
  source 1..20: mol_type = other DNA
aggtcctgcgcccccgcctg

SEQ ID NO: 1884 - DNA, 20 bp, synthetic construct
  misc_feature 1..20: note = CRISPR gRNA sequence
  source 1..20: mol_type = other DNA
tgcggtcccctcgctcctcc

SEQ ID NO: 1885 - DNA, 20 bp, synthetic construct
  misc_feature 1..20: note = CRISPR gRNA sequence
  source 1..20: mol_type = other DNA
ggtcccctcgctcctcccgg

SEQ ID NO: 1886 - DNA, 20 bp, synthetic construct
  misc_feature 1..20: note = CRISPR gRNA sequence
  source 1..20: mol_type = other DNA
tcccctcgctcctcccggca

SEQ ID NO: 1887 - DNA, 20 bp, synthetic construct
  misc_feature 1..20: note = CRISPR gRNA sequence
  source 1..20: mol_type = other DNA
cccctcgctcctcccggcag

SEQ ID NO: 1888 - DNA, 20 bp, synthetic construct
  misc_feature 1..20: note = CRISPR gRNA sequence
  source 1..20: mol_type = other DNA
ccctcccgacccgcactcac

SEQ ID NO: 1889 - DNA, 20 bp, synthetic construct
  misc_feature 1..20: note = CRISPR gRNA sequence
  source 1..20: mol_type = other DNA
ccgacccgcactcaccggcc

SEQ ID NO: 1890 - DNA, 20 bp, synthetic construct
  misc_feature 1..20: note = CRISPR gRNA sequence
  source 1..20: mol_type = other DNA
cgacccgcactcaccggccc

SEQ ID NO: 1891 - DNA, 20 bp, synthetic construct
  misc_feature 1..20: note = CRISPR gRNA sequence
  source 1..20: mol_type = other DNA
gcactcaccggcccaggtct

SEQ ID NO: 1892 - DNA, 20 bp, synthetic construct
  misc_feature 1..20: note = CRISPR gRNA sequence
  source 1..20: mol_type = other DNA
tcaccggcccaggtctcggt

SEQ ID NO: 1893 - DNA, 20 bp, synthetic construct
  misc_feature 1..20: note = CRISPR gRNA sequence
  source 1..20: mol_type = other DNA
caccggcccaggtctcggtc

SEQ ID NO: 1894 - DNA, 20 bp, synthetic construct
  misc_feature 1..20: note = CRISPR gRNA sequence
  source 1..20: mol_type = other DNA
accggcccaggtctcggtca

SEQ ID NO: 1895 - DNA, 20 bp, synthetic construct
  misc_feature 1..20: note = CRISPR gRNA sequence
  source 1..20: mol_type = other DNA
gcccaggtctcggtcagggc

SEQ ID NO: 1896 - DNA, 20 bp, synthetic construct
  misc_feature 1..20: note = CRISPR gRNA sequence
  source 1..20: mol_type = other DNA
cccaggtctcggtcagggcc

SEQ ID NO: 1897 - DNA, 20 bp, synthetic construct
  misc_feature 1..20: note = CRISPR gRNA sequence
  source 1..20: mol_type = other DNA
ccaggtctcggtcagggcca

SEQ ID NO: 1898 - DNA, 20 bp, synthetic construct
  misc_feature 1..20: note = CRISPR gRNA sequence
  source 1..20: mol_type = other DNA
cggtcagggccagggccgcc

SEQ ID NO: 1899 - DNA, 20 bp, synthetic construct
  misc_feature 1..20: note = CRISPR gRNA sequence
  source 1..20: mol_type = other DNA
gtcagggccagggccgccga

SEQ ID NO: 1900 - DNA, 20 bp, synthetic construct
  misc_feature 1..20: note = CRISPR gRNA sequence
  source 1..20: mol_type = other DNA
agggccagggccgccgagag

SEQ ID NO: 1901 - DNA, 20 bp, synthetic construct
  misc_feature 1..20: note = CRISPR gRNA sequence
  source 1..20: mol_type = other DNA
gccagggccgccgagagcag

SEQ ID NO: 1902 - DNA, 20 bp, synthetic construct
  misc_feature 1..20: note = CRISPR gRNA sequence
  source 1..20: mol_type = other DNA
ccagggccgccgagagcagc

SEQ ID NO: 1903 - DNA, 20 bp, synthetic construct
  misc_feature 1..20: note = CRISPR gRNA sequence
  source 1..20: mol_type = other DNA
agggccgccgagagcagcag

SEQ ID NO: 1904 - DNA, 20 bp, synthetic construct
  misc_feature 1..20: note = CRISPR gRNA sequence
  source 1..20: mol_type = other DNA
gggccgccgagagcagcagg

SEQ ID NO: 1905 - DNA, 20 bp, synthetic construct
  misc_feature 1..20: note = CRISPR gRNA sequence
  source 1..20: mol_type = other DNA
cgccgagagcagcaggagga

SEQ ID NO: 1906 - DNA, 20 bp, synthetic construct
  misc_feature 1..20: note = CRISPR gRNA sequence
  source 1..20: mol_type = other DNA
agagcagcaggaggacggtt

SEQ ID NO: 1907 - DNA, 20 bp, synthetic construct
  misc_feature 1..20: note = CRISPR gRNA sequence
  source 1..20: mol_type = other DNA
gagcagcaggaggacggttc

SEQ ID NO: 1908 - DNA, 20 bp, synthetic construct
  misc_feature 1..20: note = CRISPR gRNA sequence
  source 1..20: mol_type = other DNA
agcagcaggaggacggttcg

SEQ ID NO: 1909 - DNA, 20 bp, synthetic construct
  misc_feature 1..20: note = CRISPR gRNA sequence
  source 1..20: mol_type = other DNA
acggttcggggcgccatgac

SEQ ID NO: 1910 - DNA, 20 bp, synthetic construct
  misc_feature 1..20: note = CRISPR gRNA sequence
  source 1..20: mol_type = other DNA
gggcgccatgaccagcatct

SEQ ID NO: 1911 - DNA, 20 bp, synthetic construct
  misc_feature 1..20: note = CRISPR gRNA sequence
  source 1..20: mol_type = other DNA
tgaccagcatctcggcgtct

SEQ ID NO: 1912 - DNA, 20 bp, synthetic construct
  misc_feature 1..20: note = CRISPR gRNA sequence
  source 1..20: mol_type = other DNA
gaccagcatctcggcgtctg

SEQ ID NO: 1913 - DNA, 20 bp, synthetic construct
  misc_feature 1..20: note = CRISPR gRNA sequence
  source 1..20: mol_type = other DNA
ccagcatctcggcgtctgag

SEQ ID NO: 1914 - DNA, 20 bp, synthetic construct
  misc_feature 1..20: note = CRISPR gRNA sequence
  source 1..20: mol_type = other DNA
tcggcgtctgaggagactct

SEQ ID NO: 1915 - DNA, 20 bp, synthetic construct
  misc_feature 1..20: note = CRISPR gRNA sequence
  source 1..20: mol_type = other DNA
gtctgaggagactctgagtc

SEQ ID NO: 1916 - DNA, 20 bp, synthetic construct
  misc_feature 1..20: note = CRISPR gRNA sequence
  source 1..20: mol_type = other DNA
tctgaggagactctgagtcc

SEQ ID NO: 1917 - DNA, 20 bp, synthetic construct
  misc_feature 1..20: note = CRISPR gRNA sequence
  source 1..20: mol_type = other DNA
gaggagactctgagtccggg

SEQ ID NO: 1918 - DNA, 20 bp, synthetic construct
  misc_feature 1..20: note = CRISPR gRNA sequence
  source 1..20: mol_type = other DNA
aggagactctgagtccgggt

SEQ ID NO: 1919 - DNA, 20 bp, synthetic construct
  misc_feature 1..20: note = CRISPR gRNA sequence
  source 1..20: mol_type = other DNA
tctgagtccgggtgggtgcg

SEQ ID NO: 1920 - DNA, 20 bp, synthetic construct
  misc_feature 1..20: note = CRISPR gRNA sequence
  source 1..20: mol_type = other DNA
ctgagtccgggtgggtgcgt

SEQ ID NO: 1921 - DNA, 20 bp, synthetic construct
  misc_feature 1..20: note = CRISPR gRNA sequence
  source 1..20: mol_type = other DNA
tgagtccgggtgggtgcgtg

SEQ ID NO: 1922 - DNA, 20 bp, synthetic construct
  misc_feature 1..20: note = CRISPR gRNA sequence
  source 1..20: mol_type = other DNA
gggtgggtgcgtggggactt

SEQ ID NO: 1923 - DNA, 20 bp, synthetic construct
  misc_feature 1..20: note = CRISPR gRNA sequence
  source 1..20: mol_type = other DNA
gtgcgtggggactttagaac

SEQ ID NO: 1924 - DNA, 20 bp, synthetic construct
  misc_feature 1..20: note = CRISPR gRNA sequence
  source 1..20: mol_type = other DNA
tgcgtggggactttagaact

SEQ ID NO: 1925 - DNA, 20 bp, synthetic construct
  misc_feature 1..20: note = CRISPR gRNA sequence
  source 1..20: mol_type = other DNA
ggactttagaactgggaccg

SEQ ID NO: 1926 - DNA, 20 bp, synthetic construct
  misc_feature 1..20: note = CRISPR gRNA sequence
  source 1..20: mol_type = other DNA
gggaccgcggcgacgctgat

SEQ ID NO: 1927 - DNA, 20 bp, synthetic construct
  misc_feature 1..20: note = CRISPR gRNA sequence
  source 1..20: mol_type = other DNA
gcgacgctgattggcttctc

SEQ ID NO: 1928 - DNA, 20 bp, synthetic construct
  misc_feature 1..20: note = CRISPR gRNA sequence
  source 1..20: mol_type = other DNA
tgggtattggatatctagag

SEQ ID NO: 1929 - DNA, 20 bp, synthetic construct
  misc_feature 1..20: note = CRISPR gRNA sequence
  source 1..20: mol_type = other DNA
ggatatctagagaagccaat

SEQ ID NO: 1930 - DNA, 20 bp, synthetic construct
  misc_feature 1..20: note = CRISPR gRNA sequence
  source 1..20: mol_type = other DNA
gaagccaatcagcgtcgccg

SEQ ID NO: 1931 - DNA, 20 bp, synthetic construct
  misc_feature 1..20: note = CRISPR gRNA sequence
  source 1..20: mol_type = other DNA
aatcagcgtcgccgcggtcc

SEQ ID NO: 1932 - DNA, 20 bp, synthetic construct
  misc_feature 1..20: note = CRISPR gRNA sequence
  source 1..20: mol_type = other DNA
tcgccgcggtcccagttcta

SEQ ID NO: 1933 - DNA, 20 bp, synthetic construct
  misc_feature 1..20: note = CRISPR gRNA sequence
  source 1..20: mol_type = other DNA
aaagtccccacgcacccacc

SEQ ID NO: 1934 - DNA, 20 bp, synthetic construct
  misc_feature 1..20: note = CRISPR gRNA sequence
  source 1..20: mol_type = other DNA
cccacgcacccacccggact

SEQ ID NO: 1935 - DNA, 20 bp, synthetic construct
  misc_feature 1..20: note = CRISPR gRNA sequence
  source 1..20: mol_type = other DNA
cacgcacccacccggactca

SEQ ID NO: 1936 - DNA, 20 bp, synthetic construct
  misc_feature 1..20: note = CRISPR gRNA sequence
  source 1..20: mol_type = other DNA
acccggactcagagtctcct

SEQ ID NO: 1937 - DNA, 20 bp, synthetic construct
  misc_feature 1..20: note = CRISPR gRNA sequence
  source 1..20: mol_type = other DNA
tcagagtctcctcagacgcc

SEQ ID NO: 1938 - DNA, 20 bp, synthetic construct
  misc_feature 1..20: note = CRISPR gRNA sequence
  source 1..20: mol_type = other DNA
ctcctcagacgccgagatgc

SEQ ID NO: 1939 - DNA, 20 bp, synthetic construct
  misc_feature 1..20: note = CRISPR gRNA sequence
  source 1..20: mol_type = other DNA
agacgccgagatgctggtca

SEQ ID NO: 1940 - DNA, 20 bp, synthetic construct
  misc_feature 1..20: note = CRISPR gRNA sequence
  source 1..20: mol_type = other DNA
aaccgtcctcctgctgctct

SEQ ID NO: 1941 - DNA, 20 bp, synthetic construct
  misc_feature 1..20: note = CRISPR gRNA sequence
  source 1..20: mol_type = other DNA
cgtcctcctgctgctctcgg

SEQ ID NO: 1942 - DNA, 20 bp, synthetic construct
  misc_feature 1..20: note = CRISPR gRNA sequence
  source 1..20: mol_type = other DNA
cctgctgctctcggcggccc

SEQ ID NO: 1943 - DNA, 20 bp, synthetic construct
  misc_feature 1..20: note = CRISPR gRNA sequence
  source 1..20: mol_type = other DNA
cggcggccctggccctgacc

SEQ ID NO: 1944 - DNA, 20 bp, synthetic construct
  misc_feature 1..20: note = CRISPR gRNA sequence
  source 1..20: mol_type = other DNA
ccctggccctgaccgagacc

SEQ ID NO: 1945 - DNA, 20 bp, synthetic construct
  misc_feature 1..20: note = CRISPR gRNA sequence
  source 1..20: mol_type = other DNA
cctggccctgaccgagacct

SEQ ID NO: 1946 - DNA, 20 bp, synthetic construct
  misc_feature 1..20: note = CRISPR gRNA sequence
  source 1..20: mol_type = other DNA
gccctgaccgagacctgggc

SEQ ID NO: 1947 - DNA, 20 bp, synthetic construct
  misc_feature 1..20: note = CRISPR gRNA sequence
  source 1..20: mol_type = other DNA
tgaccgagacctgggccggt

SEQ ID NO: 1948 - DNA, 20 bp, synthetic construct
  misc_feature 1..20: note = CRISPR gRNA sequence
  source 1..20: mol_type = other DNA
gagacctgggccggtgagtg

SEQ ID NO: 1949 - DNA, 20 bp, synthetic construct
  misc_feature 1..20: note = CRISPR gRNA sequence
  source 1..20: mol_type = other DNA
agacctgggccggtgagtgc

SEQ ID NO: 1950 - DNA, 20 bp, synthetic construct
  misc_feature 1..20: note = CRISPR gRNA sequence
  source 1..20: mol_type = other DNA
ctgggccggtgagtgcgggt

SEQ ID NO: 1951 - DNA, 20 bp, synthetic construct
  misc_feature 1..20: note = CRISPR gRNA sequence
  source 1..20: mol_type = other DNA
tgggccggtgagtgcgggtc

SEQ ID NO: 1952 - DNA, 20 bp, synthetic construct
  misc_feature 1..20: note = CRISPR gRNA sequence
  source 1..20: mol_type = other DNA
ggccggtgagtgcgggtcgg

SEQ ID NO: 1953 - DNA, 20 bp, synthetic construct
  misc_feature 1..20: note = CRISPR gRNA sequence
  source 1..20: mol_type = other DNA
gccggtgagtgcgggtcggg

SEQ ID NO: 1954 - DNA, 20 bp, synthetic construct
  misc_feature 1..20: note = CRISPR gRNA sequence
  source 1..20: mol_type = other DNA
ccggtgagtgcgggtcggga

SEQ ID NO: 1955 - DNA, 20 bp, synthetic construct
  misc_feature 1..20: note = CRISPR gRNA sequence
  source 1..20: mol_type = other DNA
agtgcgggtcgggagggaaa

SEQ ID NO: 1956 - DNA, 20 bp, synthetic construct
  misc_feature 1..20: note = CRISPR gRNA sequence
  source 1..20: mol_type = other DNA
gggagggaaatggcctctgc

SEQ ID NO: 1957 - DNA, 20 bp, synthetic construct
  misc_feature 1..20: note = CRISPR gRNA sequence
  source 1..20: mol_type = other DNA
ggagggaaatggcctctgcc

SEQ ID NO: 1958 - DNA, 20 bp, synthetic construct
  misc_feature 1..20: note = CRISPR gRNA sequence
  source 1..20: mol_type = other DNA
agggaaatggcctctgccgg

SEQ ID NO: 1959 - DNA, 20 bp, synthetic construct
  misc_feature 1..20: note = CRISPR gRNA sequence
  source 1..20: mol_type = other DNA
gggaaatggcctctgccggg

SEQ ID NO: 1960 - DNA, 20 bp, synthetic construct
  misc_feature 1..20: note = CRISPR gRNA sequence
  source 1..20: mol_type = other DNA
gaaatggcctctgccgggag

SEQ ID NO: 1961 - DNA, 20 bp, synthetic construct
  misc_feature 1..20: note = CRISPR gRNA sequence
  source 1..20: mol_type = other DNA
tggcctctgccgggaggagc

SEQ ID NO: 1962 - DNA, 20 bp, synthetic construct
  misc_feature 1..20: note = CRISPR gRNA sequence
  source 1..20: mol_type = other DNA
ggcctctgccgggaggagcg

SEQ ID NO: 1963 - DNA, 20 bp, synthetic construct
  misc_feature 1..20: note = CRISPR gRNA sequence
  source 1..20: mol_type = other DNA
gcctctgccgggaggagcga

SEQ ID NO: 1964 - DNA, 20 bp, synthetic construct
  misc_feature 1..20: note = CRISPR gRNA sequence
  source 1..20: mol_type = other DNA
cctctgccgggaggagcgag

SEQ ID NO: 1965 - DNA, 20 bp, synthetic construct
  misc_feature 1..20: note = CRISPR gRNA sequence
  source 1..20: mol_type = other DNA
cgggaggagcgaggggaccg

SEQ ID NO: 1966 - DNA, 20 bp, synthetic construct
  misc_feature 1..20: note = CRISPR gRNA sequence
  source 1..20: mol_type = other DNA
gggaggagcgaggggaccgc

SEQ ID NO: 1967 - DNA, 20 bp, synthetic construct
  misc_feature 1..20: note = CRISPR gRNA sequence
  source 1..20: mol_type = other DNA
aggagcgaggggaccgcagg

SEQ ID NO: 1968 - DNA, 20 bp, synthetic construct
  misc_feature 1..20: note = CRISPR gRNA sequence
  source 1..20: mol_type = other DNA
ggagcgaggggaccgcaggc

SEQ ID NO: 1969 - DNA, 20 bp, synthetic construct
  misc_feature 1..20: note = CRISPR gRNA sequence
  source 1..20: mol_type = other DNA
gagcgaggggaccgcaggcg

SEQ ID NO: 1970 - DNA, 20 bp, synthetic construct
  misc_feature 1..20: note = CRISPR gRNA sequence
  source 1..20: mol_type = other DNA
agcgaggggaccgcaggcgg

SEQ ID NO: 1971 - DNA, 20 bp, synthetic construct
  misc_feature 1..20: note = CRISPR gRNA sequence
  source 1..20: mol_type = other DNA
ggggaccgcaggcgggggcg

SEQ ID NO: 1972 - DNA, 20 bp, synthetic construct
  misc_feature 1..20: note = CRISPR gRNA sequence
  source 1..20: mol_type = other DNA
gggaccgcaggcgggggcgc

SEQ ID NO: 1973 - DNA, 20 bp, synthetic construct
  misc_feature 1..20: note = CRISPR gRNA sequence
  source 1..20: mol_type = other DNA
caggcgggggcgcaggacct

SEQ ID NO: 1974 - DNA, 20 bp, synthetic construct
  misc_feature 1..20: note = CRISPR gRNA sequence
  source 1..20: mol_type = other DNA
aggcgggggcgcaggacctg

SEQ ID NO: 1975 - DNA, 20 bp, synthetic construct
  misc_feature 1..20: note = CRISPR gRNA sequence
  source 1..20: mol_type = other DNA
gcgggggcgcaggacctgag

SEQ ID NO: 1976 - DNA, 20 bp, synthetic construct
  misc_feature 1..20: note = CRISPR gRNA sequence
  source 1..20: mol_type = other DNA
caggacctgaggagccgcgc

SEQ ID NO: 1977 - DNA, 20 bp, synthetic construct
  misc_feature 1..20: note = CRISPR gRNA sequence
  source 1..20: mol_type = other DNA
aggacctgaggagccgcgcc

SEQ ID NO: 1978 - DNA, 20 bp, synthetic construct
  misc_feature 1..20: note = CRISPR gRNA sequence
  source 1..20: mol_type = other DNA
gacctgaggagccgcgccgg

SEQ ID NO: 1979 - DNA, 20 bp, synthetic construct
  misc_feature 1..20: note = CRISPR gRNA sequence
  source 1..20: mol_type = other DNA
acctgaggagccgcgccggg

SEQ ID NO: 1980 - DNA, 20 bp, synthetic construct
  misc_feature 1..20: note = CRISPR gRNA sequence
  source 1..20: mol_type = other DNA
ctgaggagccgcgccgggag

SEQ ID NO: 1981 - DNA, 20 bp, synthetic construct
  misc_feature 1..20: note = CRISPR gRNA sequence
  source 1..20: mol_type = other DNA
tgaggagccgcgccgggagg

SEQ ID NO: 1982 - DNA, 20 bp, synthetic construct
  misc_feature 1..20: note = CRISPR gRNA sequence
  source 1..20: mol_type = other DNA
gaggagccgcgccgggagga

SEQ ID NO: 1983 - DNA, 20 bp, synthetic construct
  misc_feature 1..20: note = CRISPR gRNA sequence
  source 1..20: mol_type = other DNA
agccgcgccgggaggagggt

SEQ ID NO: 1984 - DNA, 20 bp, synthetic construct
  misc_feature 1..20: note = CRISPR gRNA sequence
  source 1..20: mol_type = other DNA
gccgcgccgggaggagggtc

SEQ ID NO: 1985 - DNA, 20 bp, synthetic construct
  misc_feature 1..20: note = CRISPR gRNA sequence
  source 1..20: mol_type = other DNA
gcgccgggaggagggtcggg

SEQ ID NO: 1986 - DNA, 20 bp, synthetic construct
  misc_feature 1..20: note = CRISPR gRNA sequence
  source 1..20: mol_type = other DNA
cgccgggaggagggtcgggc

SEQ ID NO: 1987 - DNA, 20 bp, synthetic construct
  misc_feature 1..20: note = CRISPR gRNA sequence
  source 1..20: mol_type = other DNA
gaggagggtcgggcgggtct

SEQ ID NO: 1988 - DNA, 20 bp, synthetic construct
  misc_feature 1..20: note = CRISPR gRNA sequence
  source 1..20: mol_type = other DNA
tctcagcccctcctcacccc

SEQ ID NO: 1989 - DNA, 20 bp, synthetic construct
  misc_feature 1..20: note = CRISPR gRNA sequence
  source 1..20: mol_type = other DNA
ctcagcccctcctcaccccc

SEQ ID NO: 1990 - DNA, 20 bp, synthetic construct
  misc_feature 1..20: note = CRISPR gRNA sequence
  source 1..20: mol_type = other DNA
cccccaggctcccactccat

SEQ ID NO: 1991 - DNA, 20 bp, synthetic construct
  misc_feature 1..20: note = CRISPR gRNA sequence
  source 1..20: mol_type = other DNA
ccccaggctcccactccatg

SEQ ID NO: 1992 - DNA, 20 bp, synthetic construct
  misc_feature 1..20: note = CRISPR gRNA sequence
  source 1..20: mol_type = other DNA
atttctacacctccgtgtcc

SEQ ID NO: 1993 - DNA, 20 bp, synthetic construct
  misc_feature 1..20: note = CRISPR gRNA sequence
  source 1..20: mol_type = other DNA
tacacctccgtgtcccggcc

SEQ ID NO: 1994 - DNA, 20 bp, synthetic construct
  misc_feature 1..20: note = CRISPR gRNA sequence
  source 1..20: mol_type = other DNA
tccgtgtcccggcccggccg

SEQ ID NO: 1995 - DNA, 20 bp, synthetic construct
  misc_feature 1..20: note = CRISPR gRNA sequence
  source 1..20: mol_type = other DNA
ccgtgtcccggcccggccgc

SEQ ID NO: 1996 - DNA, 20 bp, synthetic construct
  misc_feature 1..20: note = CRISPR gRNA sequence
  source 1..20: mol_type = other DNA
cgtgtcccggcccggccgcg

SEQ ID NO: 1997 - DNA, 20 bp, synthetic construct
  misc_feature 1..20: note = CRISPR gRNA sequence
  source 1..20: mol_type = other DNA
tgtcccggcccggccgcggg

SEQ ID NO: 1998 - DNA, 20 bp, synthetic construct
  misc_feature 1..20: note = CRISPR gRNA sequence
  source 1..20: mol_type = other DNA
cggggagccccgcttcatct

SEQ ID NO: 1999 - DNA, 20 bp, synthetic construct
  misc_feature 1..20: note = CRISPR gRNA sequence
  source 1..20: mol_type = other DNA
ggagccccgcttcatctcag

SEQ ID NO: 2000 - DNA, 20 bp, synthetic construct
  misc_feature 1..20: note = CRISPR gRNA sequence
  source 1..20: mol_type = other DNA
gagccccgcttcatctcagt

SEQ ID NO: 2001 - DNA, 20 bp, synthetic construct
  misc_feature 1..20: note = CRISPR gRNA sequence
  source 1..20: mol_type = other DNA
cttcatctcagtgggctacg

SEQ ID NO: 2002 - DNA, 20 bp, synthetic construct
  misc_feature 1..20: note = CRISPR gRNA sequence
  source 1..20: mol_type = other DNA
tgggctacgtggacgacacc

SEQ ID NO: 2003 - DNA, 20 bp, synthetic construct
  misc_feature 1..20: note = CRISPR gRNA sequence
  source 1..20: mol_type = other DNA
gtggacgacacccagttcgt

SEQ ID NO: 2004 - DNA, 20 bp, synthetic construct
  misc_feature 1..20: note = CRISPR gRNA sequence
  source 1..20: mol_type = other DNA
tggacgacacccagttcgtg

SEQ ID NO: 2005 - DNA, 20 bp, synthetic construct
  misc_feature 1..20: note = CRISPR gRNA sequence
  source 1..20: mol_type = other DNA
acccagttcgtgaggttcga

SEQ ID NO: 2006 - DNA, 20 bp, synthetic construct
  misc_feature 1..20: note = CRISPR gRNA sequence
  source 1..20: mol_type = other DNA
aggttcgacagcgacgccgc

SEQ ID NO: 2007 - DNA, 20 bp, synthetic construct
  misc_feature 1..20: note = CRISPR gRNA sequence
  source 1..20: mol_type = other DNA
gacagcgacgccgcgagtcc

SEQ ID NO: 2008 - DNA, 20 bp, synthetic construct
  misc_feature 1..20: note = CRISPR gRNA sequence
  source 1..20: mol_type = other DNA
cagcgacgccgcgagtccga

SEQ ID NO: 2009 - DNA, 20 bp, synthetic construct
  misc_feature 1..20: note = CRISPR gRNA sequence
  source 1..20: mol_type = other DNA
gcgacgccgcgagtccgaga

SEQ ID NO: 2010 - DNA, 20 bp, synthetic construct
  misc_feature 1..20: note = CRISPR gRNA sequence
  source 1..20: mol_type = other DNA
cgacgccgcgagtccgagag

SEQ ID NO: 2011 - DNA, 20 bp, synthetic construct
  misc_feature 1..20: note = CRISPR gRNA sequence
  source 1..20: mol_type = other DNA
acgccgcgagtccgagagag

SEQ ID NO: 2012 - DNA, 20 bp, synthetic construct
  misc_feature 1..20: note = CRISPR gRNA sequence
  source 1..20: mol_type = other DNA
cgagtccgagagaggagccg

SEQ ID NO: 2013 - DNA, 20 bp, synthetic construct
  misc_feature 1..20: note = CRISPR gRNA sequence
  source 1..20: mol_type = other DNA
gagtccgagagaggagccgc

SEQ ID NO: 2014 - DNA, 20 bp, synthetic construct
  misc_feature 1..20: note = CRISPR gRNA sequence
  source 1..20: mol_type = other DNA
gagaggagccgcgggcgccg

SEQ ID NO: 2015 - DNA, 20 bp, synthetic construct
  misc_feature 1..20: note = CRISPR gRNA sequence
  source 1..20: mol_type = other DNA
ggagccgcgggcgccgtgga

SEQ ID NO: 2016 - DNA, 20 bp, synthetic construct
  misc_feature 1..20: note = CRISPR gRNA sequence
  source 1..20: mol_type = other DNA
agccgcgggcgccgtggata

SEQ ID NO: 2017 - DNA, 20 bp, synthetic construct
  misc_feature 1..20: note = CRISPR gRNA sequence
  source 1..20: mol_type = other DNA
cgcgggcgccgtggatagag

SEQ ID NO: 2018 - DNA, 20 bp, synthetic construct
  misc_feature 1..20: note = CRISPR gRNA sequence
  source 1..20: mol_type = other DNA
gcgggcgccgtggatagagc

SEQ ID NO: 2019 - DNA, 20 bp, synthetic construct
  misc_feature 1..20: note = CRISPR gRNA sequence
  source 1..20: mol_type = other DNA
gggcgccgtggatagagcag

SEQ ID NO: 2020 - DNA, 20 bp, synthetic construct
  misc_feature 1..20: note = CRISPR gRNA sequence
  source 1..20: mol_type = other DNA
ggcgccgtggatagagcagg

SEQ ID NO: 2021 - DNA, 20 bp, synthetic construct
  misc_feature 1..20: note = CRISPR gRNA sequence
  source 1..20: mol_type = other DNA
gcgccgtggatagagcagga

SEQ ID NO: 2022 - DNA, 20 bp, synthetic construct
  misc_feature 1..20: note = CRISPR gRNA sequence
  source 1..20: mol_type = other DNA
cgccgtggatagagcaggag

SEQ ID NO: 2023 - DNA, 20 bp, synthetic construct
  misc_feature 1..20: note = CRISPR gRNA sequence
  source 1..20: mol_type = other DNA
gtggatagagcaggaggggc

SEQ ID NO: 2024 - DNA, 20 bp, synthetic construct
  misc_feature 1..20: note = CRISPR gRNA sequence
  source 1..20: mol_type = other DNA
ggatagagcaggaggggccg

SEQ ID NO: 2025 - DNA, 20 bp, synthetic construct
  misc_feature 1..20: note = CRISPR gRNA sequence
  source 1..20: mol_type = other DNA
agcaggaggggccggagtat

SEQ ID NO: 2026 - DNA, 20 bp, synthetic construct
  misc_feature 1..20: note = CRISPR gRNA sequence
  source 1..20: mol_type = other DNA
gcaggaggggccggagtatt

SEQ ID NO: 2027 - DNA, 20 bp, synthetic construct
  misc_feature 1..20: note = CRISPR gRNA sequence
  source 1..20: mol_type = other DNA
aggggccggagtattgggac

SEQ ID NO: 2028 - DNA, 20 bp, synthetic construct
  misc_feature 1..20: note = CRISPR gRNA sequence
  source 1..20: mol_type = other DNA
agtattgggaccggaacaca

SEQ ID NO: 2029 - DNA, 20 bp, synthetic construct
  misc_feature 1..20: note = CRISPR gRNA sequence
  source 1..20: mol_type = other DNA
accggaacacacagatctac

SEQ ID NO: 2030 - DNA, 20 bp, synthetic construct
  misc_feature 1..20: note = CRISPR gRNA sequence
  source 1..20: mol_type = other DNA
ccggaacacacagatctaca

SEQ ID NO: 2031 - DNA, 20 bp, synthetic construct
  misc_feature 1..20: note = CRISPR gRNA sequence
  source 1..20: mol_type = other DNA
acacacagatctacaaggcc

SEQ ID NO: 2032 - DNA, 20 bp, synthetic construct
  misc_feature 1..20: note = CRISPR gRNA sequence
  source 1..20: mol_type = other DNA
cacacagatctacaaggccc

SEQ ID NO: 2033 - DNA, 20 bp, synthetic construct
  misc_feature 1..20: note = CRISPR gRNA sequence
  source 1..20: mol_type = other DNA
agatctacaaggcccaggca

SEQ ID NO: 2034 - DNA, 20 bp, synthetic construct
  misc_feature 1..20: note = CRISPR gRNA sequence
  source 1..20: mol_type = other DNA
ggcccaggcacagactgacc

SEQ ID NO: 2035 - DNA, 20 bp, synthetic construct
  misc_feature 1..20: note = CRISPR gRNA sequence
  source 1..20: mol_type = other DNA
cccaggcacagactgaccga

SEQ ID NO: 2036 - DNA, 20 bp, synthetic construct
  misc_feature 1..20: note = CRISPR gRNA sequence
  source 1..20: mol_type = other DNA
caggcacagactgaccgaga

SEQ ID NO: 2037 - DNA, 20 bp, synthetic construct
  misc_feature 1..20: note = CRISPR gRNA sequence
  source 1..20: mol_type = other DNA
agactgaccgagagagcctg

SEQ ID NO: 2038 - DNA, 20 bp, synthetic construct
  misc_feature 1..20: note = CRISPR gRNA sequence
  source 1..20: mol_type = other DNA
gagagcctgcggaacctgcg

SEQ ID NO: 2039 - DNA, 20 bp, synthetic construct
  misc_feature 1..20: note = CRISPR gRNA sequence
  source 1..20: mol_type = other DNA
acctgcgcggctactacaac

SEQ ID NO: 2040 - DNA, 20 bp, synthetic construct
  misc_feature 1..20: note = CRISPR gRNA sequence
  source 1..20: mol_type = other DNA
ctgcgcggctactacaacca

SEQ ID NO: 2041 - DNA, 20 bp, synthetic construct
  misc_feature 1..20: note = CRISPR gRNA sequence
  source 1..20: mol_type = other DNA
gcggctactacaaccagagc

SEQ ID NO: 2042 - DNA, 20 bp, synthetic construct
  misc_feature 1..20: note = CRISPR gRNA sequence
  source 1..20: mol_type = other DNA
cggctactacaaccagagcg

SEQ ID NO: 2043 - DNA, 20 bp, synthetic construct
  misc_feature 1..20: note = CRISPR gRNA sequence
  source 1..20: mol_type = other DNA
tactacaaccagagcgaggc

SEQ ID NO: 2044 - DNA, 20 bp, synthetic construct
  misc_feature 1..20: note = CRISPR gRNA sequence
  source 1..20: mol_type = other DNA
acaaccagagcgaggccggt

SEQ ID NO: 2045 - DNA, 20 bp, synthetic construct
  misc_feature 1..20: note = CRISPR gRNA sequence
  source 1..20: mol_type = other DNA
gcgaggccggtgagtgaccc

SEQ ID NO: 2046 - DNA, 20 bp, synthetic construct
  misc_feature 1..20: note = CRISPR gRNA sequence
  source 1..20: mol_type = other DNA
gccggtgagtgaccccggcc

SEQ ID NO: 2047 - DNA, 20 bp, synthetic construct
  misc_feature 1..20: note = CRISPR gRNA sequence
  source 1..20: mol_type = other DNA
ccggtgagtgaccccggccc

SEQ ID NO: 2048 - DNA, 20 bp, synthetic construct
  misc_feature 1..20: note = CRISPR gRNA sequence
  source 1..20: mol_type = other DNA
cggtgagtgaccccggcccg

SEQ ID NO: 2049 - DNA, 20 bp, synthetic construct
  misc_feature 1..20: note = CRISPR gRNA sequence
  source 1..20: mol_type = other DNA
agtgaccccggcccggggcg

SEQ ID NO: 2050 - DNA, 20 bp, synthetic construct
  misc_feature 1..20: note = CRISPR gRNA sequence
  source 1..20: mol_type = other DNA
gtgaccccggcccggggcgc

SEQ ID NO: 2051 - DNA, 20 bp, synthetic construct
  misc_feature 1..20: note = CRISPR gRNA sequence
  source 1..20: mol_type = other DNA
gactccccatcccccacgta

SEQ ID NO: 2052 - DNA, 20 bp, synthetic construct
  misc_feature 1..20: note = CRISPR gRNA sequence
  source 1..20: mol_type = other DNA
cccatcccccacgtacggcc

SEQ ID NO: 2053 - DNA, 20 bp, synthetic construct
  misc_feature 1..20: note = CRISPR gRNA sequence
  source 1..20: mol_type = other DNA
ccatcccccacgtacggccc

SEQ ID NO: 2054 - DNA, 20 bp, synthetic construct
  misc_feature 1..20: note = CRISPR gRNA sequence
  source 1..20: mol_type = other DNA
cgtacggcccgggtcgcccc

SEQ ID NO: 2055 - DNA, 20 bp, synthetic construct
  misc_feature 1..20: note = CRISPR gRNA sequence
  source 1..20: mol_type = other DNA
cccgggtcgccccgagtctc

SEQ ID NO: 2056 - DNA, 20 bp, synthetic construct
  misc_feature 1..20: note = CRISPR gRNA sequence
  source 1..20: mol_type = other DNA
ccgggtcgccccgagtctcc

SEQ ID NO: 2057 - DNA, 20 bp, synthetic construct
  misc_feature 1..20: note = CRISPR gRNA sequence
  source 1..20: mol_type = other DNA
cgccccgagtctccgggtcc

SEQ ID NO: 2058 - DNA, 20 bp, synthetic construct
  misc_feature 1..20: note = CRISPR gRNA sequence
  source 1..20: mol_type = other DNA
ggtccgagatccgcctccct

SEQ ID NO: 2059 - DNA, 20 bp, synthetic construct
  misc_feature 1..20: note = CRISPR gRNA sequence
  source 1..20: mol_type = other DNA
gtccgagatccgcctccctg

SEQ ID NO: 2060 - DNA, 20 bp, synthetic construct
  misc_feature 1..20: note = CRISPR gRNA sequence
  source 1..20: mol_type = other DNA
gatccgcctccctgaggccg

SEQ ID NO: 2061 - DNA, 20 bp, synthetic construct
  misc_feature 1..20: note = CRISPR gRNA sequence
  source 1..20: mol_type = other DNA
atccgcctccctgaggccgc

SEQ ID NO: 2062 - DNA, 20 bp, synthetic construct
  misc_feature 1..20: note = CRISPR gRNA sequence
  source 1..20: mol_type = other DNA
ctgaggccgcgggacccgcc

SEQ ID NO: 2063 - DNA, 20 bp, synthetic construct
  misc_feature 1..20: note = CRISPR gRNA sequence
  source 1..20: mol_type = other DNA
gacccgcccagaccctcgac

SEQ ID NO: 2064 - DNA, 20 bp, synthetic construct
  misc_feature 1..20: note = CRISPR gRNA sequence
  source 1..20: mol_type = other DNA
cgcccagaccctcgaccggc

SEQ ID NO: 2065 - DNA, 20 bp, synthetic construct
  misc_feature 1..20: note = CRISPR gRNA sequence
  source 1..20: mol_type = other DNA
cccagaccctcgaccggcga

SEQ ID NO: 2066 - DNA, 20 bp, synthetic construct
  misc_feature 1..20: note = CRISPR gRNA sequence
  source 1..20: mol_type = other DNA
ccctcgaccggcgagagccc

SEQ ID NO: 2067 - DNA, 20 bp, synthetic construct
  misc_feature 1..20: note = CRISPR gRNA sequence
  source 1..20: mol_type = other DNA
cctcgaccggcgagagcccc

SEQ ID NO: 2068 - DNA, 20 bp, synthetic construct
  misc_feature 1..20: note = CRISPR gRNA sequence
  source 1..20: mol_type = other DNA
gagccccaggcgcgtttacc

SEQ ID NO: 2069 - DNA, 20 bp, synthetic construct
  misc_feature 1..20: note = CRISPR gRNA sequence
  source 1..20: mol_type = other DNA
cgtttacccggtttcatttt

SEQ ID NO: 2070 - DNA, 20 bp, synthetic construct
  misc_feature 1..20: note = CRISPR gRNA sequence
  source 1..20: mol_type = other DNA
acccggtttcattttcagtt

SEQ ID NO: 2071 - DNA, 20 bp, synthetic construct
  misc_feature 1..20: note = CRISPR gRNA sequence
  source 1..20: mol_type = other DNA
cccggtttcattttcagttg

SEQ ID NO: 2072 - DNA, 20 bp, synthetic construct
  misc_feature 1..20: note = CRISPR gRNA sequence
  source 1..20: mol_type = other DNA
agttgaggccaaaatccccg

SEQ ID NO: 2073 - DNA, 20 bp, synthetic construct
  misc_feature 1..20: note = CRISPR gRNA sequence
  source 1..20: mol_type = other DNA
gttgaggccaaaatccccgc

SEQ ID NO: 2074 - DNA, 20 bp, synthetic construct
  misc_feature 1..20: note = CRISPR gRNA sequence
  source 1..20: mol_type = other DNA
aggccaaaatccccgcgggt

SEQ ID NO: 2075 - DNA, 20 bp, synthetic construct
  misc_feature 1..20: note = CRISPR gRNA sequence
  source 1..20: mol_type = other DNA
caaaatccccgcgggttggt

SEQ ID NO: 2076 - DNA, 20 bp, synthetic construct
  misc_feature 1..20: note = CRISPR gRNA sequence
  source 1..20: mol_type = other DNA
aaaatccccgcgggttggtc

SEQ ID NO: 2077 - DNA, 20 bp, synthetic construct
  misc_feature 1..20: note = CRISPR gRNA sequence
  source 1..20: mol_type = other DNA
aaatccccgcgggttggtcg

SEQ ID NO: 2078 - DNA, 20 bp, synthetic construct
  misc_feature 1..20: note = CRISPR gRNA sequence
  source 1..20: mol_type = other DNA
tccccgcgggttggtcgggg

SEQ ID NO: 2079 - DNA, 20 bp, synthetic construct
  misc_feature 1..20: note = CRISPR gRNA sequence
  source 1..20: mol_type = other DNA
ccccgcgggttggtcggggc

SEQ ID NO: 2080 - DNA, 20 bp, synthetic construct
  misc_feature 1..20: note = CRISPR gRNA sequence
  source 1..20: mol_type = other DNA
cccgcgggttggtcggggcg

SEQ ID NO: 2081 - DNA, 20 bp, synthetic construct
  misc_feature 1..20: note = CRISPR gRNA sequence
  source 1..20: mol_type = other DNA
gcgggttggtcggggcgggg

SEQ ID NO: 2082 - DNA, 20 bp, synthetic construct
  misc_feature 1..20: note = CRISPR gRNA sequence
  source 1..20: mol_type = other DNA
cgggttggtcggggcggggc

SEQ ID NO: 2083 - DNA, 20 bp, synthetic construct
  misc_feature 1..20: note = CRISPR gRNA sequence
  source 1..20: mol_type = other DNA
gggttggtcggggcggggcg

SEQ ID NO: 2084 - DNA, 20 bp, synthetic construct
  misc_feature 1..20: note = CRISPR gRNA sequence
  source 1..20: mol_type = other DNA
ggtcggggcggggcggggct

SEQ ID NO: 2085 - DNA, 20 bp, synthetic construct
  misc_feature 1..20: note = CRISPR gRNA sequence
  source 1..20: mol_type = other DNA
gtcggggcggggcggggctc

SEQ ID NO: 2086 - DNA, 20 bp, synthetic construct
  misc_feature 1..20: note = CRISPR gRNA sequence
  source 1..20: mol_type = other DNA
tcggggcggggcggggctcg

SEQ ID NO: 2087 - DNA, 20 bp, synthetic construct
  misc_feature 1..20: note = CRISPR gRNA sequence
  source 1..20: mol_type = other DNA
cggggcggggcggggctcgg

SEQ ID NO: 2088 - DNA, 20 bp, synthetic construct
  misc_feature 1..20: note = CRISPR gRNA sequence
  source 1..20: mol_type = other DNA
cggggcggggctcgggggac

SEQ ID NO: 2089 - DNA, 20 bp, synthetic construct
  misc_feature 1..20: note = CRISPR gRNA sequence
  source 1..20: mol_type = other DNA
ggggcggggctcgggggact

SEQ ID NO: 2090 - DNA, 20 bp, synthetic construct
  misc_feature 1..20: note = CRISPR gRNA sequence
  source 1..20: mol_type = other DNA
tcgggggactgggctgaccg

SEQ ID NO: 2091 - DNA, 20 bp, synthetic construct
  misc_feature 1..20: note = CRISPR gRNA sequence
  source 1..20: mol_type = other DNA
cgggggactgggctgaccgc

SEQ ID NO: 2092 - DNA, 20 bp, synthetic construct
  misc_feature 1..20: note = CRISPR gRNA sequence
  source 1..20: mol_type = other DNA
gggggactgggctgaccgcg

SEQ ID NO: 2093 - DNA, 20 bp, synthetic construct
  misc_feature 1..20: note = CRISPR gRNA sequence
  source 1..20: mol_type = other DNA
gactgggctgaccgcggggc

SEQ ID NO: 2094 - DNA, 20 bp, synthetic construct
  misc_feature 1..20: note = CRISPR gRNA sequence
  source 1..20: mol_type = other DNA
actgggctgaccgcggggcc

SEQ ID NO: 2095 - DNA, 20 bp, synthetic construct
  misc_feature 1..20: note = CRISPR gRNA sequence
  source 1..20: mol_type = other DNA
ctgggctgaccgcggggccg

SEQ ID NO: 2096 - DNA, 20 bp, synthetic construct
  misc_feature 1..20: note = CRISPR gRNA sequence
  source 1..20: mol_type = other DNA
gctgaccgcggggccggggc

SEQ ID NO: 2097 - DNA, 20 bp, synthetic construct
  misc_feature 1..20: note = CRISPR gRNA sequence
  source 1..20: mol_type = other DNA
ctgaccgcggggccggggcc

SEQ ID NO: 2098 - DNA, 20 bp, synthetic construct
  misc_feature 1..20: note = CRISPR gRNA sequence
  source 1..20: mol_type = other DNA
tgaccgcggggccggggcca

SEQ ID NO: 2099 - DNA, 20 bp, synthetic construct
  misc_feature 1..20: note = CRISPR gRNA sequence
  source 1..20: mol_type = other DNA
ggccagggtctcacaccctc

SEQ ID NO: 2100 - DNA, 20 bp, synthetic construct
  misc_feature 1..20: note = CRISPR gRNA sequence
  source 1..20: mol_type = other DNA
ccagggtctcacaccctcca

SEQ ID NO: 2101 - DNA, 20 bp, synthetic construct
  misc_feature 1..20: note = CRISPR gRNA sequence
  source 1..20: mol_type = other DNA
cacaccctccagagcatgta

SEQ ID NO: 2102 - DNA, 20 bp, synthetic construct
  misc_feature 1..20: note = CRISPR gRNA sequence
  source 1..20: mol_type = other DNA
gagcatgtacggctgcgacg

SEQ ID NO: 2103 - DNA, 20 bp, synthetic construct
  misc_feature 1..20: note = CRISPR gRNA sequence
  source 1..20: mol_type = other DNA
agcatgtacggctgcgacgt

SEQ ID NO: 2104 - DNA, 20 bp, synthetic construct
  misc_feature 1..20: note = CRISPR gRNA sequence
  source 1..20: mol_type = other DNA
gcatgtacggctgcgacgtg

SEQ ID NO: 2105 - DNA, 20 bp, synthetic construct
  misc_feature 1..20: note = CRISPR gRNA sequence
  source 1..20: mol_type = other DNA
gtacggctgcgacgtggggc

SEQ ID NO: 2106 - DNA, 20 bp, synthetic construct
  misc_feature 1..20: note = CRISPR gRNA sequence
  source 1..20: mol_type = other DNA
ggctgcgacgtggggccgga

SEQ ID NO: 2107 - DNA, 20 bp, synthetic construct
  misc_feature 1..20: note = CRISPR gRNA sequence
  source 1..20: mol_type = other DNA
gctgcgacgtggggccggac

SEQ ID NO: 2108 - DNA, 20 bp, synthetic construct
  misc_feature 1..20: note = CRISPR gRNA sequence
  source 1..20: mol_type = other DNA
ccggacgggcgcctcctccg

SEQ ID NO: 2109 - DNA, 20 bp, synthetic construct
  misc_feature 1..20: note = CRISPR gRNA sequence
  source 1..20: mol_type = other DNA
cggacgggcgcctcctccgc

SEQ ID NO: 2110 - DNA, 20 bp, synthetic construct
  misc_feature 1..20: note = CRISPR gRNA sequence
  source 1..20: mol_type = other DNA
gcctcctccgcgggcatgac

SEQ ID NO: 2111 - DNA, 20 bp, synthetic construct
  misc_feature 1..20: note = CRISPR gRNA sequence
  source 1..20: mol_type = other DNA
catgaccagtacgcctacga

SEQ ID NO: 2112 - DNA, 20 bp, synthetic construct
  misc_feature 1..20: note = CRISPR gRNA sequence
  source 1..20: mol_type = other DNA
accagtacgcctacgacggc

SEQ ID NO: 2113 - DNA, 20 bp, synthetic construct
  misc_feature 1..20: note = CRISPR gRNA sequence
  source 1..20: mol_type = other DNA
ccagtacgcctacgacggca

SEQ ID NO: 2114 - DNA, 20 bp, synthetic construct
  misc_feature 1..20: note = CRISPR gRNA sequence
  source 1..20: mol_type = other DNA
aggattacatcgccctgaac

SEQ ID NO: 2115 - DNA, 20 bp, synthetic construct
  misc_feature 1..20: note = CRISPR gRNA sequence
  source 1..20: mol_type = other DNA
ggattacatcgccctgaacg

SEQ ID NO: 2116 - DNA, 20 bp, synthetic construct
  misc_feature 1..20: note = CRISPR gRNA sequence
  source 1..20: mol_type = other DNA
tgaacgaggacctgcgctcc

SEQ ID NO: 2117 - DNA, 20 bp, synthetic construct
  misc_feature 1..20: note = CRISPR gRNA sequence
  source 1..20: mol_type = other DNA
cctgcgctcctggaccgccg

SEQ ID NO: 2118 - DNA, 20 bp, synthetic construct
  misc_feature 1..20: note = CRISPR gRNA sequence
  source 1..20: mol_type = other DNA
ctcctggaccgccgcggaca

SEQ ID NO: 2119 - DNA, 20 bp, synthetic construct
  misc_feature 1..20: note = CRISPR gRNA sequence
  source 1..20: mol_type = other DNA
ctggaccgccgcggacacgg

SEQ ID NO: 2120 - DNA, 20 bp, synthetic construct
  misc_feature 1..20: note = CRISPR gRNA sequence
  source 1..20: mol_type = other DNA
ccgccgcggacacggcggct

SEQ ID NO: 2121 - DNA, 20 bp, synthetic construct
  misc_feature 1..20: note = CRISPR gRNA sequence
  source 1..20: mol_type = other DNA
acacggcggctcagatcacc

SEQ ID NO: 2122 - DNA, 20 bp, synthetic construct
  misc_feature 1..20: note = CRISPR gRNA sequence
  source 1..20: mol_type = other DNA
cggctcagatcacccagcgc

SEQ ID NO: 2123 - DNA, 20 bp, synthetic construct
  misc_feature 1..20: note = CRISPR gRNA sequence
  source 1..20: mol_type = other DNA
ctcagatcacccagcgcaag

SEQ ID NO: 2124 - DNA, 20 bp, synthetic construct
  misc_feature 1..20: note = CRISPR gRNA sequence
  source 1..20: mol_type = other DNA
tcagatcacccagcgcaagt

SEQ ID NO: 2125 - DNA, 20 bp, synthetic construct
  misc_feature 1..20: note = CRISPR gRNA sequence
  source 1..20: mol_type = other DNA
agatcacccagcgcaagtgg

SEQ ID NO: 2126 - DNA, 20 bp, synthetic construct
  misc_feature 1..20: note = CRISPR gRNA sequence
  source 1..20: mol_type = other DNA
gatcacccagcgcaagtggg

SEQ ID NO: 2127 - DNA, 20 bp, synthetic construct
  misc_feature 1..20: note = CRISPR gRNA sequence
  source 1..20: mol_type = other DNA
cacccagcgcaagtgggagg

SEQ ID NO: 2128 - DNA, 20 bp, synthetic construct
  misc_feature 1..20: note = CRISPR gRNA sequence
  source 1..20: mol_type = other DNA
gcaagtgggaggcggcccgt

SEQ ID NO: 2129 - DNA, 20 bp, synthetic construct
  misc_feature 1..20: note = CRISPR gRNA sequence
  source 1..20: mol_type = other DNA
caagtgggaggcggcccgtg

SEQ ID NO: 2130 - DNA, 20 bp, synthetic construct
  misc_feature 1..20: note = CRISPR gRNA sequence
  source 1..20: mol_type = other DNA
gtgggaggcggcccgtgagg

SEQ ID NO: 2131 - DNA, 20 bp, synthetic construct
  misc_feature 1..20: note = CRISPR gRNA sequence
  source 1..20: mol_type = other DNA
gggaggcggcccgtgaggcg

SEQ ID NO: 2132 - DNA, 20 bp, synthetic construct
  misc_feature 1..20: note = CRISPR gRNA sequence
  source 1..20: mol_type = other DNA
aggcggcccgtgaggcggag

SEQ ID NO: 2133 - DNA, 20 bp, synthetic construct
  misc_feature 1..20: note = CRISPR gRNA sequence
  source 1..20: mol_type = other DNA
cggcccgtgaggcggagcag

SEQ ID NO: 2134 - DNA, 20 bp, synthetic construct
  misc_feature 1..20: note = CRISPR gRNA sequence
  source 1..20: mol_type = other DNA
gcccgtgaggcggagcagcg

SEQ ID NO: 2135 - DNA, 20 bp, synthetic construct
  misc_feature 1..20: note = CRISPR gRNA sequence
  source 1..20: mol_type = other DNA
ccgtgaggcggagcagcgga

SEQ ID NO: 2136 - DNA, 20 bp, synthetic construct
  misc_feature 1..20: note = CRISPR gRNA sequence
  source 1..20: mol_type = other DNA
ggagcagcggagagcctacc

SEQ ID NO: 2137 - DNA, 20 bp, synthetic construct
  misc_feature 1..20: note = CRISPR gRNA sequence
  source 1..20: mol_type = other DNA
agcagcggagagcctacctg

SEQ ID NO: 2138 - DNA, 20 bp, synthetic construct
  misc_feature 1..20: note = CRISPR gRNA sequence
  source 1..20: mol_type = other DNA
gcagcggagagcctacctgg

SEQ ID NO: 2139 - DNA, 20 bp, synthetic construct
  misc_feature 1..20: note = CRISPR gRNA sequence
  source 1..20: mol_type = other DNA
cagcggagagcctacctgga

SEQ ID NO: 2140 - DNA, 20 bp, synthetic construct
  misc_feature 1..20: note = CRISPR gRNA sequence
  source 1..20: mol_type = other DNA
ggagagcctacctggagggc

SEQ ID NO: 2141 - DNA, 20 bp, synthetic construct
  misc_feature 1..20: note = CRISPR gRNA sequence
  source 1..20: mol_type = other DNA
ctacctggagggcgagtgcg

SEQ ID NO: 2142 - DNA, 20 bp, synthetic construct
  misc_feature 1..20: note = CRISPR gRNA sequence
  source 1..20: mol_type = other DNA
acctggagggcgagtgcgtg

SEQ ID NO: 2143 - DNA, 20 bp, synthetic construct
  misc_feature 1..20: note = CRISPR gRNA sequence
  source 1..20: mol_type = other DNA
tggagggcgagtgcgtggag

SEQ ID NO: 2144 - DNA, 20 bp, synthetic construct
  misc_feature 1..20: note = CRISPR gRNA sequence
  source 1..20: mol_type = other DNA
gagtgcgtggagtggctccg

SEQ ID NO: 2145 - DNA, 20 bp, synthetic construct
  misc_feature 1..20: note = CRISPR gRNA sequence
  source 1..20: mol_type = other DNA
ggagtggctccgcagatacc

SEQ ID NO: 2146 - DNA, 20 bp, synthetic construct
  misc_feature 1..20: note = CRISPR gRNA sequence
  source 1..20: mol_type = other DNA
agtggctccgcagatacctg

SEQ ID NO: 2147 - DNA, 20 bp, synthetic construct
  misc_feature 1..20: note = CRISPR gRNA sequence
  source 1..20: mol_type = other DNA
ctccgcagatacctggagaa

SEQ ID NO: 2148 - DNA, 20 bp, synthetic construct
  misc_feature 1..20: note = CRISPR gRNA sequence
  source 1..20: mol_type = other DNA
tccgcagatacctggagaac

SEQ ID NO: 2149 - DNA, 20 bp, synthetic construct
  misc_feature 1..20: note = CRISPR gRNA sequence
  source 1..20: mol_type = other DNA
gcagatacctggagaacggg

SEQ ID NO: 2150 - DNA, 20 bp, synthetic construct
  misc_feature 1..20: note = CRISPR gRNA sequence
  source 1..20: mol_type = other DNA
cagatacctggagaacggga

SEQ ID NO: 2151 - DNA, 20 bp, synthetic construct
  misc_feature 1..20: note = CRISPR gRNA sequence
  source 1..20: mol_type = other DNA
acctggagaacgggaaggac

SEQ ID NO: 2152 - DNA, 20 bp, synthetic construct
  misc_feature 1..20: note = CRISPR gRNA sequence
  source 1..20: mol_type = other DNA
ggagaacgggaaggacaagc

SEQ ID NO: 2153 - DNA, 20 bp, synthetic construct
  misc_feature 1..20: note = CRISPR gRNA sequence
  source 1..20: mol_type = other DNA
agaacgggaaggacaagctg

SEQ ID NO: 2154 - DNA, 20 bp, synthetic construct
  misc_feature 1..20: note = CRISPR gRNA sequence
  source 1..20: mol_type = other DNA
aaggacaagctggagcgcgc

SEQ ID NO: 2155 - DNA, 20 bp, synthetic construct
  misc_feature 1..20: note = CRISPR gRNA sequence
  source 1..20: mol_type = other DNA
aagctggagcgcgctggtac

SEQ ID NO: 2156 - DNA, 20 bp, synthetic construct
  misc_feature 1..20: note = CRISPR gRNA sequence
  source 1..20: mol_type = other DNA
agctggagcgcgctggtacc

SEQ ID NO: 2157 - DNA, 20 bp, synthetic construct
  misc_feature 1..20: note = CRISPR gRNA sequence
  source 1..20: mol_type = other DNA
gctggagcgcgctggtacca

SEQ ID NO: 2158 - DNA, 20 bp, synthetic construct
  misc_feature 1..20: note = CRISPR gRNA sequence
  source 1..20: mol_type = other DNA
ctggagcgcgctggtaccag

SEQ ID NO: 2159 - DNA, 20 bp, synthetic construct
  misc_feature 1..20: note = CRISPR gRNA sequence
  source 1..20: mol_type = other DNA
gagcgcgctggtaccagggg

SEQ ID NO: 2160 - DNA, 20 bp, synthetic construct
  misc_feature 1..20: note = CRISPR gRNA sequence
  source 1..20: mol_type = other DNA
cgcgctggtaccaggggcag

SEQ ID NO: 2161 - DNA, 20 bp, synthetic construct
  misc_feature 1..20: note = CRISPR gRNA sequence
  source 1..20: mol_type = other DNA
gcgctggtaccaggggcagt

SEQ ID NO: 2162 - DNA, 20 bp, synthetic construct
  misc_feature 1..20: note = CRISPR gRNA sequence
  source 1..20: mol_type = other DNA
cgctggtaccaggggcagtg

SEQ ID NO: 2163 - DNA, 20 bp, synthetic construct
  misc_feature 1..20: note = CRISPR gRNA sequence
  source 1..20: mol_type = other DNA
ctggtaccaggggcagtggg

SEQ ID NO: 2164 - DNA, 20 bp, synthetic construct
  misc_feature 1..20: note = CRISPR gRNA sequence
  source 1..20: mol_type = other DNA
ggagccttccccatctccta

SEQ ID NO: 2165 - DNA, 20 bp, synthetic construct
  misc_feature 1..20: note = CRISPR gRNA sequence
  source 1..20: mol_type = other DNA
gagccttccccatctcctat

SEQ ID NO: 2166 - DNA, 20 bp, synthetic construct
  misc_feature 1..20: note = CRISPR gRNA sequence
  source 1..20: mol_type = other DNA
ccccatctcctataggtcgc

SEQ ID NO: 2167 - DNA, 20 bp, synthetic construct
  misc_feature 1..20: note = CRISPR gRNA sequence
  source 1..20: mol_type = other DNA
cccatctcctataggtcgcc

SEQ ID NO: 2168 - DNA, 20 bp, synthetic construct
  misc_feature 1..20: note = CRISPR gRNA sequence
  source 1..20: mol_type = other DNA
ccatctcctataggtcgccg

SEQ ID NO: 2169 - DNA, 20 bp, synthetic construct
  misc_feature 1..20: note = CRISPR gRNA sequence
  source 1..20: mol_type = other DNA
ctcctataggtcgccgggga

SEQ ID NO: 2170 - DNA, 20 bp, synthetic construct
  misc_feature 1..20: note = CRISPR gRNA sequence
  source 1..20: mol_type = other DNA
cgccggggatggcctcccac

SEQ ID NO: 2171 - DNA, 20 bp, synthetic construct
  misc_feature 1..20: note = CRISPR gRNA sequence
  source 1..20: mol_type = other DNA
cggggatggcctcccacgag

SEQ ID NO: 2172 - DNA, 20 bp, synthetic construct
  misc_feature 1..20: note = CRISPR gRNA sequence
  source 1..20: mol_type = other DNA
gggatggcctcccacgagaa

SEQ ID NO: 2173 - DNA, 20 bp, synthetic construct
  misc_feature 1..20: note = CRISPR gRNA sequence
  source 1..20: mol_type = other DNA
ggatggcctcccacgagaag

SEQ ID NO: 2174 - DNA, 20 bp, synthetic construct
  misc_feature 1..20: note = CRISPR gRNA sequence
  source 1..20: mol_type = other DNA
atggcctcccacgagaagag

SEQ ID NO: 2175 - DNA, 20 bp, synthetic construct
  misc_feature 1..20: note = CRISPR gRNA sequence
  source 1..20: mol_type = other DNA
tggcctcccacgagaagagg

SEQ ID NO: 2176 - DNA, 20 bp, synthetic construct
  misc_feature 1..20: note = CRISPR gRNA sequence
  source 1..20: mol_type = other DNA
ccacgagaagaggaggaaaa

SEQ ID NO: 2177 - DNA, 20 bp, synthetic construct
  misc_feature 1..20: note = CRISPR gRNA sequence
  source 1..20: mol_type = other DNA
cacgagaagaggaggaaaat

SEQ ID NO: 2178 - DNA, 20 bp, synthetic construct
  misc_feature 1..20: note = CRISPR gRNA sequence
  source 1..20: mol_type = other DNA
gaagaggaggaaaatgggat

SEQ ID NO: 2179 - DNA, 20 bp, synthetic construct
  misc_feature 1..20: note = CRISPR gRNA sequence
  source 1..20: mol_type = other DNA
gaggaaaatgggatcagcgc

SEQ ID NO: 2180 - DNA, 20 bp, synthetic construct
  misc_feature 1..20: note = CRISPR gRNA sequence
  source 1..20: mol_type = other DNA
gaatgtcgccctccgttgaa

SEQ ID NO: 2181 - DNA, 20 bp, synthetic construct
  misc_feature 1..20: note = CRISPR gRNA sequence
  source 1..20: mol_type = other DNA
atgtcgccctccgttgaatg

SEQ ID NO: 2182 - DNA, 20 bp, synthetic construct
  misc_feature 1..20: note = CRISPR gRNA sequence
  source 1..20: mol_type = other DNA
gccctccgttgaatggagaa

SEQ ID NO: 2183 - DNA, 20 bp, synthetic construct
  misc_feature 1..20: note = CRISPR gRNA sequence
  source 1..20: mol_type = other DNA
cgttgaatggagaatggcat

SEQ ID NO: 2184 - DNA, 20 bp, synthetic construct
  misc_feature 1..20: note = CRISPR gRNA sequence
  source 1..20: mol_type = other DNA
agaatggcatgagttttcct

SEQ ID NO: 2185 - DNA, 20 bp, synthetic construct
  misc_feature 1..20: note = CRISPR gRNA sequence
  source 1..20: mol_type = other DNA
agttttcctgagtttcctct

SEQ ID NO: 2186 - DNA, 20 bp, synthetic construct
  misc_feature 1..20: note = CRISPR gRNA sequence
  source 1..20: mol_type = other DNA
gttttcctgagtttcctctg

SEQ ID NO: 2187 - DNA, 20 bp, synthetic construct
  misc_feature 1..20: note = CRISPR gRNA sequence
  source 1..20: mol_type = other DNA
ttttcctgagtttcctctga

SEQ ID NO: 2188 - DNA, 20 bp, synthetic construct
  misc_feature 1..20: note = CRISPR gRNA sequence
  source 1..20: mol_type = other DNA
tgagggccccctcttctctc

SEQ ID NO: 2189 - DNA, 20 bp, synthetic construct
  misc_feature 1..20: note = CRISPR gRNA sequence
  source 1..20: mol_type = other DNA
cctcttctctctagacaatt

SEQ ID NO: 2190 - DNA, 20 bp, synthetic construct
  misc_feature 1..20: note = CRISPR gRNA sequence
  source 1..20: mol_type = other DNA
ctcttctctctagacaatta

SEQ ID NO: 2191 - DNA, 20 bp, synthetic construct
  misc_feature 1..20: note = CRISPR gRNA sequence
  source 1..20: mol_type = other DNA
aattaaggaatgacgtctct

SEQ ID NO: 2192 - DNA, 20 bp, synthetic construct
  misc_feature 1..20: note = CRISPR gRNA sequence
  source 1..20: mol_type = other DNA
attaaggaatgacgtctctg

SEQ ID NO: 2193 - DNA, 20 bp, synthetic construct
  misc_feature 1..20: note = CRISPR gRNA sequence
  source 1..20: mol_type = other DNA
gaatgacgtctctgaggaaa

SEQ ID NO: 2194 - DNA, 20 bp, synthetic construct
  misc_feature 1..20: note = CRISPR gRNA sequence
  source 1..20: mol_type = other DNA
atgacgtctctgaggaaatg

SEQ ID NO: 2195 - DNA, 20 bp, synthetic construct
  misc_feature 1..20: note = CRISPR gRNA sequence
  source 1..20: mol_type = other DNA
tgacgtctctgaggaaatgg

SEQ ID NO: 2196 - DNA, 20 bp, synthetic construct
  misc_feature 1..20: note = CRISPR gRNA sequence
  source 1..20: mol_type = other DNA
gacgtctctgaggaaatgga

SEQ ID NO: 2197 - DNA, 20 bp, synthetic construct
  misc_feature 1..20: note = CRISPR gRNA sequence
  source 1..20: mol_type = other DNA
acgtctctgaggaaatggag

SEQ ID NO: 2198 - DNA, 20 bp, synthetic construct
  misc_feature 1..20: note = CRISPR gRNA sequence
  source 1..20: mol_type = other DNA
tctctgaggaaatggagggg

SEQ ID NO: 2199 - DNA, 20 bp, synthetic construct
  misc_feature 1..20: note = CRISPR gRNA sequence
  source 1..20: mol_type = other DNA
tgaggaaatggaggggaaga

SEQ ID NO: 2200 - DNA, 20 bp, synthetic construct
  misc_feature 1..20: note = CRISPR gRNA sequence
  source 1..20: mol_type = other DNA
atggaggggaagacagtccc

SEQ ID NO: 2201 - DNA, 20 bp, synthetic construct
  misc_feature 1..20: note = CRISPR gRNA sequence
  source 1..20: mol_type = other DNA
acagtccctagaatactgat

SEQ ID NO: 2202 - DNA, 20 bp, synthetic construct
  misc_feature 1..20: note = CRISPR gRNA sequence
  source 1..20: mol_type = other DNA
cagtccctagaatactgatc

SEQ ID NO: 2203 - DNA, 20 bp, synthetic construct
  misc_feature 1..20: note = CRISPR gRNA sequence
  source 1..20: mol_type = other DNA
agtccctagaatactgatca

SEQ ID NO: 2204 - DNA, 20 bp, synthetic construct
  misc_feature 1..20: note = CRISPR gRNA sequence
  source 1..20: mol_type = other DNA
gtccctagaatactgatcag

SEQ ID NO: 2205 - DNA, 20 bp, synthetic construct
  misc_feature 1..20: note = CRISPR gRNA sequence
  source 1..20: mol_type = other DNA
ggggtcccctttgacccctg

SEQ ID NO: 2206 - DNA, 20 bp, synthetic construct
  misc_feature 1..20: note = CRISPR gRNA sequence
  source 1..20: mol_type = other DNA
gtcccctttgacccctgcag

SEQ ID NO: 2207 - DNA, 20 bp, synthetic construct
  misc_feature 1..20: note = CRISPR gRNA sequence
  source 1..20: mol_type = other DNA
tttgacccctgcagcagcct

SEQ ID NO: 2208 - DNA, 20 bp, synthetic construct
  misc_feature 1..20: note = CRISPR gRNA sequence
  source 1..20: mol_type = other DNA
ttgacccctgcagcagcctt

SEQ ID NO: 2209 - DNA, 20 bp, synthetic construct
  misc_feature 1..20: note = CRISPR gRNA sequence
  source 1..20: mol_type = other DNA
ggaaccgtgacttttcctct

SEQ ID NO: 2210 - DNA, 20 bp, synthetic construct
  misc_feature 1..20: note = CRISPR gRNA sequence
  source 1..20: mol_type = other DNA
gaaccgtgacttttcctctc

SEQ ID NO: 2211 - DNA, 20 bp, synthetic construct
  misc_feature 1..20: note = CRISPR gRNA sequence
  source 1..20: mol_type = other DNA
cttgttctctgcctcacact

SEQ ID NO: 2212 - DNA, 20 bp, synthetic construct
  misc_feature 1..20: note = CRISPR gRNA sequence
  source 1..20: mol_type = other DNA
tgcctcacactcagtgtgtt

SEQ ID NO: 2213 - DNA, 20 bp, synthetic construct
  misc_feature 1..20: note = CRISPR gRNA sequence
  source 1..20: mol_type = other DNA
gcctcacactcagtgtgttt

SEQ ID NO: 2214 - DNA, 20 bp, synthetic construct
  misc_feature 1..20: note = CRISPR gRNA sequence
  source 1..20: mol_type = other DNA
cctcacactcagtgtgtttg

SEQ ID NO: 2215 - DNA, 20 bp, synthetic construct
  misc_feature 1..20: note = CRISPR gRNA sequence
  source 1..20: mol_type = other DNA
tgtgtttggggctctgattc

SEQ ID NO: 2216 - DNA, 20 bp, synthetic construct
  misc_feature 1..20: note = CRISPR gRNA sequence
  source 1..20: mol_type = other DNA
gctctgattccagcacttct

SEQ ID NO: 2217 - DNA, 20 bp, synthetic construct
  misc_feature 1..20: note = CRISPR gRNA sequence
  source 1..20: mol_type = other DNA
tgagtcactttacctccact

SEQ ID NO: 2218 - DNA, 20 bp, synthetic construct
  misc_feature 1..20: note = CRISPR gRNA sequence
  source 1..20: mol_type = other DNA
cactttacctccactcagat

SEQ ID NO: 2219 - DNA, 20 bp, synthetic construct
  misc_feature 1..20: note = CRISPR gRNA sequence
  source 1..20: mol_type = other DNA
actttacctccactcagatc

SEQ ID NO: 2220 - DNA, 20 bp, synthetic construct
  misc_feature 1..20: note = CRISPR gRNA sequence
  source 1..20: mol_type = other DNA
tttacctccactcagatcag

SEQ ID NO: 2221 - DNA, 20 bp, synthetic construct
  misc_feature 1..20: note = CRISPR gRNA sequence
  source 1..20: mol_type = other DNA
acctccactcagatcaggag

SEQ ID NO: 2222 - DNA, 20 bp, synthetic construct
  misc_feature 1..20: note = CRISPR gRNA sequence
  source 1..20: mol_type = other DNA
tccactcagatcaggagcag

SEQ ID NO: 2223 - DNA, 20 bp, synthetic construct
  misc_feature 1..20: note = CRISPR gRNA sequence
  source 1..20: mol_type = other DNA
agaagtccctgttccccgct

SEQ ID NO: 2224 - DNA, 20 bp, synthetic construct
  misc_feature 1..20: note = CRISPR gRNA sequence
  source 1..20: mol_type = other DNA
aagtccctgttccccgctca

SEQ ID NO: 2225 - DNA, 20 bp, synthetic construct
  misc_feature 1..20: note = CRISPR gRNA sequence
  source 1..20: mol_type = other DNA
gactcgaactttccaatgaa

SEQ ID NO: 2226 - DNA, 20 bp, synthetic construct
  misc_feature 1..20: note = CRISPR gRNA sequence
  source 1..20: mol_type = other DNA
actcgaactttccaatgaat

SEQ ID NO: 2227 - DNA, 20 bp, synthetic construct
  misc_feature 1..20: note = CRISPR gRNA sequence
  source 1..20: mol_type = other DNA
tcgaactttccaatgaatag

SEQ ID NO: 2228 - DNA, 20 bp, synthetic construct
  misc_feature 1..20: note = CRISPR gRNA sequence
  source 1..20: mol_type = other DNA
caatgaataggagattatcc

SEQ ID NO: 2229 - DNA, 20 bp, synthetic construct
  misc_feature 1..20: note = CRISPR gRNA sequence
  source 1..20: mol_type = other DNA
aatgaataggagattatccc

SEQ ID NO: 2230 - DNA, 20 bp, synthetic construct
  misc_feature 1..20: note = CRISPR gRNA sequence
  source 1..20: mol_type = other DNA
ttatcccaggtgcctgcgtc

SEQ ID NO: 2231 - DNA, 20 bp, synthetic construct
  misc_feature 1..20: note = CRISPR gRNA sequence
  source 1..20: mol_type = other DNA
tatcccaggtgcctgcgtcc

SEQ ID NO: 2232 - DNA, 20 bp, synthetic construct
  misc_feature 1..20: note = CRISPR gRNA sequence
  source 1..20: mol_type = other DNA
ccaggtgcctgcgtccaggc

SEQ ID NO: 2233 - DNA, 20 bp, synthetic construct
  misc_feature 1..20: note = CRISPR gRNA sequence
  source 1..20: mol_type = other DNA
cctgcgtccaggctggtgtc

SEQ ID NO: 2234 - DNA, 20 bp, synthetic construct
  misc_feature 1..20: note = CRISPR gRNA sequence
  source 1..20: mol_type = other DNA
ctgcgtccaggctggtgtct

SEQ ID NO: 2235 - DNA, 20 bp, synthetic construct
  misc_feature 1..20: note = CRISPR gRNA sequence
  source 1..20: mol_type = other DNA
tctgtgccccttccccaccc

SEQ ID NO: 2236 - DNA, 20 bp, synthetic construct
  misc_feature 1..20: note = CRISPR gRNA sequence
  source 1..20: mol_type = other DNA
ctgtgccccttccccacccc

SEQ ID NO: 2237 - DNA, 20 bp, synthetic construct
  misc_feature 1..20: note = CRISPR gRNA sequence
  source 1..20: mol_type = other DNA
ccaggtgtcctgtccattct

SEQ ID NO: 2238 - DNA, 20 bp, synthetic construct
  misc_feature 1..20: note = CRISPR gRNA sequence
  source 1..20: mol_type = other DNA
caggtgtcctgtccattctc

SEQ ID NO: 2239 - DNA, 20 bp, synthetic construct
  misc_feature 1..20: note = CRISPR gRNA sequence
  source 1..20: mol_type = other DNA
tgtcctgtccattctcaggc

SEQ ID NO: 2240 - DNA, 20 bp, synthetic construct
  misc_feature 1..20: note = CRISPR gRNA sequence
  source 1..20: mol_type = other DNA
ccattctcaggctggtcaca

SEQ ID NO: 2241 - DNA, 20 bp, synthetic construct
  misc_feature 1..20: note = CRISPR gRNA sequence
  source 1..20: mol_type = other DNA
cattctcaggctggtcacat

SEQ ID NO: 2242 - DNA, 20 bp, synthetic construct
  misc_feature 1..20: note = CRISPR gRNA sequence
  source 1..20: mol_type = other DNA
tctcaggctggtcacatggg

SEQ ID NO: 2243 - DNA, 20 bp, synthetic construct
  misc_feature 1..20: note = CRISPR gRNA sequence
  source 1..20: mol_type = other DNA
gctggtcacatgggtggtcc

SEQ ID NO: 2244 - DNA, 20 bp, synthetic construct
  misc_feature 1..20: note = CRISPR gRNA sequence
  source 1..20: mol_type = other DNA
ctggtcacatgggtggtcct

SEQ ID NO: 2245 - DNA, 20 bp, synthetic construct
  misc_feature 1..20: note = CRISPR gRNA sequence
  source 1..20: mol_type = other DNA
tggtcacatgggtggtccta

SEQ ID NO: 2246 - DNA, 20 bp, synthetic construct
  misc_feature 1..20: note = CRISPR gRNA sequence
  source 1..20: mol_type = other DNA
ggtcctagggtgtcccatga

SEQ ID NO: 2247 - DNA, 20 bp, synthetic construct
  misc_feature 1..20: note = CRISPR gRNA sequence
  source 1..20: mol_type = other DNA
ggtgtcccatgaaagatgca

SEQ ID NO: 2248 - DNA, 20 bp, synthetic construct
  misc_feature 1..20: note = CRISPR gRNA sequence
  source 1..20: mol_type = other DNA
aattttctgactcttcccat

SEQ ID NO: 2249 - DNA, 20 bp, synthetic construct
  misc_feature 1..20: note = CRISPR gRNA sequence
  source 1..20: mol_type = other DNA
tcttcccatcagacccccca

SEQ ID NO: 2250 - DNA, 20 bp, synthetic construct
  misc_feature 1..20: note = CRISPR gRNA sequence
  source 1..20: mol_type = other DNA
accaccccatctctgaccat

SEQ ID NO: 2251 - DNA, 20 bp, synthetic construct
  misc_feature 1..20: note = CRISPR gRNA sequence
  source 1..20: mol_type = other DNA
ccaccccatctctgaccatg

SEQ ID NO: 2252 - DNA, 20 bp, synthetic construct
  misc_feature 1..20: note = CRISPR gRNA sequence
  source 1..20: mol_type = other DNA
tctgaccatgaggccaccct

SEQ ID NO: 2253 - DNA, 20 bp, synthetic construct
  misc_feature 1..20: note = CRISPR gRNA sequence
  source 1..20: mol_type = other DNA
ctgaccatgaggccaccctg

SEQ ID NO: 2254 - DNA, 20 bp, synthetic construct
  misc_feature 1..20: note = CRISPR gRNA sequence
  source 1..20: mol_type = other DNA
atgaggccaccctgaggtgc

SEQ ID NO: 2255 - DNA, 20 bp, synthetic construct
  misc_feature 1..20: note = CRISPR gRNA sequence
  source 1..20: mol_type = other DNA
tgaggccaccctgaggtgct

SEQ ID NO: 2256 - DNA, 20 bp, synthetic construct
  misc_feature 1..20: note = CRISPR gRNA sequence
  source 1..20: mol_type = other DNA
caccctgaggtgctgggccc

SEQ ID NO: 2257 - DNA, 20 bp, synthetic construct
  misc_feature 1..20: note = CRISPR gRNA sequence
  source 1..20: mol_type = other DNA
accctgaggtgctgggccct

SEQ ID NO: 2258 - DNA, 20 bp, synthetic construct
  misc_feature 1..20: note = CRISPR gRNA sequence
  source 1..20: mol_type = other DNA
ggccctgggtttctaccctg

SEQ ID NO: 2259 - DNA, 20 bp, synthetic construct
  misc_feature 1..20: note = CRISPR gRNA sequence
  source 1..20: mol_type = other DNA
ccctgggtttctaccctgcg

SEQ ID NO: 2260 - DNA, 20 bp, synthetic construct
  misc_feature 1..20: note = CRISPR gRNA sequence
  source 1..20: mol_type = other DNA
ctgcggagatcacactgacc

SEQ ID NO: 2261 - DNA, 20 bp, synthetic construct
  misc_feature 1..20: note = CRISPR gRNA sequence
  source 1..20: mol_type = other DNA
cggagatcacactgacctgg

SEQ ID NO: 2262 - DNA, 20 bp, synthetic construct
  misc_feature 1..20: note = CRISPR gRNA sequence
  source 1..20: mol_type = other DNA
agatcacactgacctggcag

SEQ ID NO: 2263 - DNA, 20 bp, synthetic construct
  misc_feature 1..20: note = CRISPR gRNA sequence
  source 1..20: mol_type = other DNA
gatcacactgacctggcagc

SEQ ID NO: 2264 - DNA, 20 bp, synthetic construct
  misc_feature 1..20: note = CRISPR gRNA sequence
  source 1..20: mol_type = other DNA
acactgacctggcagcggga

SEQ ID NO: 2265 - DNA, 20 bp, synthetic construct
  misc_feature 1..20: note = CRISPR gRNA sequence
  source 1..20: mol_type = other DNA
tgacctggcagcgggatggc

SEQ ID NO: 2266 - DNA, 20 bp, synthetic construct
  misc_feature 1..20: note = CRISPR gRNA sequence
  source 1..20: mol_type = other DNA
gacctggcagcgggatggcg

SEQ ID NO: 2267 - DNA, 20 bp, synthetic construct
  misc_feature 1..20: note = CRISPR gRNA sequence
  source 1..20: mol_type = other DNA
gggatggcgaggaccaaact

SEQ ID NO: 2268 - DNA, 20 bp, synthetic construct
  misc_feature 1..20: note = CRISPR gRNA sequence
  source 1..20: mol_type = other DNA
ggatggcgaggaccaaactc

SEQ ID NO: 2269 - DNA, 20 bp, synthetic construct
  misc_feature 1..20: note = CRISPR gRNA sequence
  source 1..20: mol_type = other DNA
aggaccaaactcaggacact

SEQ ID NO: 2270 - DNA, 20 bp, synthetic construct
  misc_feature 1..20: note = CRISPR gRNA sequence
  source 1..20: mol_type = other DNA
aactcaggacactgagcttg

SEQ ID NO: 2271 - DNA, 20 bp, synthetic construct
  misc_feature 1..20: note = CRISPR gRNA sequence
  source 1..20: mol_type = other DNA
ctcaggacactgagcttgtg

SEQ ID NO: 2272 - DNA, 20 bp, synthetic construct
  misc_feature 1..20: note = CRISPR gRNA sequence
  source 1..20: mol_type = other DNA
gacactgagcttgtggagac

SEQ ID NO: 2273 - DNA, 20 bp, synthetic construct
  misc_feature 1..20: note = CRISPR gRNA sequence
  source 1..20: mol_type = other DNA
tgagcttgtggagaccagac

SEQ ID NO: 2274 - DNA, 20 bp, synthetic construct
  misc_feature 1..20: note = CRISPR gRNA sequence
  source 1..20: mol_type = other DNA
gcttgtggagaccagaccag

SEQ ID NO: 2275 - DNA, 20 bp, synthetic construct
  misc_feature 1..20: note = CRISPR gRNA sequence
  source 1..20: mol_type = other DNA
cttgtggagaccagaccagc

SEQ ID NO: 2276 - DNA, 20 bp, synthetic construct
  misc_feature 1..20: note = CRISPR gRNA sequence
  source 1..20: mol_type = other DNA
tgtggagaccagaccagcag

SEQ ID NO: 2277 - DNA, 20 bp, synthetic construct
  misc_feature 1..20: note = CRISPR gRNA sequence
  source 1..20: mol_type = other DNA
gagaccagaccagcaggaga

SEQ ID NO: 2278 - DNA, 20 bp, synthetic construct
  misc_feature 1..20: note = CRISPR gRNA sequence
  source 1..20: mol_type = other DNA
cagcaggagatagaaccttc

SEQ ID NO: 2279 - DNA, 20 bp, synthetic construct
  misc_feature 1..20: note = CRISPR gRNA sequence
  source 1..20: mol_type = other DNA
caggagatagaaccttccag

SEQ ID NO: 2280 - DNA, 20 bp, synthetic construct
  misc_feature 1..20: note = CRISPR gRNA sequence
  source 1..20: mol_type = other DNA
gagatagaaccttccagaag

SEQ ID NO: 2281 - DNA, 20 bp, synthetic construct
  misc_feature 1..20: note = CRISPR gRNA sequence
  source 1..20: mol_type = other DNA
agatagaaccttccagaagt

SEQ ID NO: 2282 - DNA, 20 bp, synthetic construct
  misc_feature 1..20: note = CRISPR gRNA sequence
  source 1..20: mol_type = other DNA
tagaaccttccagaagtggg

SEQ ID NO: 2283 - DNA, 20 bp, synthetic construct
  misc_feature 1..20: note = CRISPR gRNA sequence
  source 1..20: mol_type = other DNA
cttccagaagtgggcagctg

SEQ ID NO: 2284 - DNA, 20 bp, synthetic construct
  misc_feature 1..20: note = CRISPR gRNA sequence
  source 1..20: mol_type = other DNA
ccagaagtgggcagctgtgg

SEQ ID NO: 2285 - DNA, 20 bp, synthetic construct
  misc_feature 1..20: note = CRISPR gRNA sequence
  source 1..20: mol_type = other DNA
gcagctgtggtggtgccttc

SEQ ID NO: 2286 - DNA, 20 bp, synthetic construct
  misc_feature 1..20: note = CRISPR gRNA sequence
  source 1..20: mol_type = other DNA
agctgtggtggtgccttctg

SEQ ID NO: 2287 - DNA, 20 bp, synthetic construct
  misc_feature 1..20: note = CRISPR gRNA sequence
  source 1..20: mol_type = other DNA
tgtggtggtgccttctggag

SEQ ID NO: 2288 - DNA, 20 bp, synthetic construct
  misc_feature 1..20: note = CRISPR gRNA sequence
  source 1..20: mol_type = other DNA
tggtggtgccttctggagaa

SEQ ID NO: 2289 - DNA, 20 bp, synthetic construct
  misc_feature 1..20: note = CRISPR gRNA sequence
  source 1..20: mol_type = other DNA
tggtgccttctggagaagag

SEQ ID NO: 2290 - DNA, 20 bp, synthetic construct
  misc_feature 1..20: note = CRISPR gRNA sequence
  source 1..20: mol_type = other DNA
gtgccttctggagaagagca

SEQ ID NO: 2291 - DNA, 20 bp, synthetic construct
  misc_feature 1..20: note = CRISPR gRNA sequence
  source 1..20: mol_type = other DNA
agagatacacatgccatgta

SEQ ID NO: 2292 - DNA, 20 bp, synthetic construct
  misc_feature 1..20: note = CRISPR gRNA sequence
  source 1..20: mol_type = other DNA
acacatgccatgtacagcat

SEQ ID NO: 2293 - DNA, 20 bp, synthetic construct
  misc_feature 1..20: note = CRISPR gRNA sequence
  source 1..20: mol_type = other DNA
cacatgccatgtacagcatg

SEQ ID NO: 2294 - DNA, 20 bp, synthetic construct
  misc_feature 1..20: note = CRISPR gRNA sequence
  source 1..20: mol_type = other DNA
acatgccatgtacagcatga

SEQ ID NO: 2295 - DNA, 20 bp, synthetic construct
  misc_feature 1..20: note = CRISPR gRNA sequence
  source 1..20: mol_type = other DNA
catgccatgtacagcatgag

SEQ ID NO: 2296 - DNA, 20 bp, synthetic construct
  misc_feature 1..20: note = CRISPR gRNA sequence
  source 1..20: mol_type = other DNA
tacagcatgaggggctgccg

SEQ ID NO: 2297 - DNA, 20 bp, synthetic construct
  misc_feature 1..20: note = CRISPR gRNA sequence
  source 1..20: mol_type = other DNA
ctgccgaagcccctcaccct

SEQ ID NO: 2298 - DNA, 20 bp, synthetic construct
  misc_feature 1..20: note = CRISPR gRNA sequence
  source 1..20: mol_type = other DNA
cgaagcccctcaccctgaga

SEQ ID NO: 2299 - DNA, 20 bp, synthetic construct
  misc_feature 1..20: note = CRISPR gRNA sequence
  source 1..20: mol_type = other DNA
gaagcccctcaccctgagat

SEQ ID NO: 2300 - DNA, 20 bp, synthetic construct
  misc_feature 1..20: note = CRISPR gRNA sequence
  source 1..20: mol_type = other DNA
aagcccctcaccctgagatg

SEQ ID NO: 2301 - DNA, 20 bp, synthetic construct
  misc_feature 1..20: note = CRISPR gRNA sequence
  source 1..20: mol_type = other DNA
ccctcaccctgagatggggt

SEQ ID NO: 2302 - DNA, 20 bp, synthetic construct
  misc_feature 1..20: note = CRISPR gRNA sequence
  source 1..20: mol_type = other DNA
cctcaccctgagatggggta

SEQ ID NO: 2303 - DNA, 20 bp, synthetic construct
  misc_feature 1..20: note = CRISPR gRNA sequence
  source 1..20: mol_type = other DNA
tcaccctgagatggggtaag

SEQ ID NO: 2304 - DNA, 20 bp, synthetic construct
  misc_feature 1..20: note = CRISPR gRNA sequence
  source 1..20: mol_type = other DNA
caccctgagatggggtaagg

SEQ ID NO: 2305 - DNA, 20 bp, synthetic construct
  misc_feature 1..20: note = CRISPR gRNA sequence
  source 1..20: mol_type = other DNA
accctgagatggggtaagga

SEQ ID NO: 2306 - DNA, 20 bp, synthetic construct
  misc_feature 1..20: note = CRISPR gRNA sequence
  source 1..20: mol_type = other DNA
ccctgagatggggtaaggag

SEQ ID NO: 2307 - DNA, 20 bp, synthetic construct
  misc_feature 1..20: note = CRISPR gRNA sequence
  source 1..20: mol_type = other DNA
cctgagatggggtaaggagg

SEQ ID NO: 2308 - DNA, 20 bp, synthetic construct
  misc_feature 1..20: note = CRISPR gRNA sequence
  source 1..20: mol_type = other DNA
gatggggtaaggagggggat

SEQ ID NO: 2309 - DNA, 20 bp, synthetic construct
  misc_feature 1..20: note = CRISPR gRNA sequence
  source 1..20: mol_type = other DNA
atggggtaaggagggggatg

SEQ ID NO: 2310 - DNA, 20 bp, synthetic construct
  misc_feature 1..20: note = CRISPR gRNA sequence
  source 1..20: mol_type = other DNA
tggggtaaggagggggatga

SEQ ID NO: 2311 - DNA, 20 bp, synthetic construct
  misc_feature 1..20: note = CRISPR gRNA sequence
  source 1..20: mol_type = other DNA
ggggtaaggagggggatgag

SEQ ID NO: 2312 - DNA, 20 bp, synthetic construct
  misc_feature 1..20: note = CRISPR gRNA sequence
  source 1..20: mol_type = other DNA
tgaggggtcatatctcttct

SEQ ID NO: 2313 - DNA, 20 bp, synthetic construct
  misc_feature 1..20: note = CRISPR gRNA sequence
  source 1..20: mol_type = other DNA
gaggggtcatatctcttctc

SEQ ID NO: 2314 - DNA, 20 bp, synthetic construct
  misc_feature 1..20: note = CRISPR gRNA sequence
  source 1..20: mol_type = other DNA
aggggtcatatctcttctca

SEQ ID NO: 2315 - DNA, 20 bp, synthetic construct
  misc_feature 1..20: note = CRISPR gRNA sequence
  source 1..20: mol_type = other DNA
gtcatatctcttctcaggga

SEQ ID NO: 2316 - DNA, 20 bp, synthetic construct
  misc_feature 1..20: note = CRISPR gRNA sequence
  source 1..20: mol_type = other DNA
atatctcttctcagggaaag

SEQ ID NO: 2317 - DNA, 20 bp, synthetic construct
  misc_feature 1..20: note = CRISPR gRNA sequence
  source 1..20: mol_type = other DNA
tatctcttctcagggaaagc

SEQ ID NO: 2318 - DNA, 20 bp, synthetic construct
  misc_feature 1..20: note = CRISPR gRNA sequence
  source 1..20: mol_type = other DNA
tctcttctcagggaaagcag

SEQ ID NO: 2319 - DNA, 20 bp, synthetic construct
  misc_feature 1..20: note = CRISPR gRNA sequence
  source 1..20: mol_type = other DNA
cagggaaagcaggagccctt

SEQ ID NO: 2320 - DNA, 20 bp, synthetic construct
  misc_feature 1..20: note = CRISPR gRNA sequence
  source 1..20: mol_type = other DNA
ggaaagcaggagcccttcag

SEQ ID NO: 2321 - DNA, 20 bp, synthetic construct
  misc_feature 1..20: note = CRISPR gRNA sequence
  source 1..20: mol_type = other DNA
gaaagcaggagcccttcagc

SEQ ID NO: 2322 - DNA, 20 bp, synthetic construct
  misc_feature 1..20: note = CRISPR gRNA sequence
  source 1..20: mol_type = other DNA
aaagcaggagcccttcagca

SEQ ID NO: 2323 - DNA, 20 bp, synthetic construct
  misc_feature 1..20: note = CRISPR gRNA sequence
  source 1..20: mol_type = other DNA
caggagcccttcagcagggt

SEQ ID NO: 2324 - DNA, 20 bp, synthetic construct
  misc_feature 1..20: note = CRISPR gRNA sequence
  source 1..20: mol_type = other DNA
aggagcccttcagcagggtc

SEQ ID NO: 2325 - DNA, 20 bp, synthetic construct
  misc_feature 1..20: note = CRISPR gRNA sequence
  source 1..20: mol_type = other DNA
ggagcccttcagcagggtca

SEQ ID NO: 2326 - DNA, 20 bp, synthetic construct
  misc_feature 1..20: note = CRISPR gRNA sequence
  source 1..20: mol_type = other DNA
ctcatcttcccctcctttcc

SEQ ID NO: 2327 - DNA, 20 bp, synthetic construct
  misc_feature 1..20: note = CRISPR gRNA sequence
  source 1..20: mol_type = other DNA
catcttcccctcctttccca

SEQ ID NO: 2328 - DNA, 20 bp, synthetic construct
  misc_feature 1..20: note = CRISPR gRNA sequence
  source 1..20: mol_type = other DNA
ctttcccagagccgtcttcc

SEQ ID NO: 2329 - DNA, 20 bp, synthetic construct
  misc_feature 1..20: note = CRISPR gRNA sequence
  source 1..20: mol_type = other DNA
ccagtccaccgtccccatcg

SEQ ID NO: 2330 - DNA, 20 bp, synthetic construct
  misc_feature 1..20: note = CRISPR gRNA sequence
  source 1..20: mol_type = other DNA
cagtccaccgtccccatcgt

SEQ ID NO: 2331 - DNA, 20 bp, synthetic construct
  misc_feature 1..20: note = CRISPR gRNA sequence
  source 1..20: mol_type = other DNA
cccatcgtgggcattgttgc

SEQ ID NO: 2332 - DNA, 20 bp, synthetic construct
  misc_feature 1..20: note = CRISPR gRNA sequence
  source 1..20: mol_type = other DNA
cgtgggcattgttgctggcc

SEQ ID NO: 2333 - DNA, 20 bp, synthetic construct
  misc_feature 1..20: note = CRISPR gRNA sequence
  source 1..20: mol_type = other DNA
tgttgctggcctggctgtcc

SEQ ID NO: 2334 - DNA, 20 bp, synthetic construct
  misc_feature 1..20: note = CRISPR gRNA sequence
  source 1..20: mol_type = other DNA
tgctggcctggctgtcctag

SEQ ID NO: 2335 - DNA, 20 bp, synthetic construct
  misc_feature 1..20: note = CRISPR gRNA sequence
  source 1..20: mol_type = other DNA
cctggctgtcctagcagttg

SEQ ID NO: 2336 - DNA, 20 bp, synthetic construct
  misc_feature 1..20: note = CRISPR gRNA sequence
  source 1..20: mol_type = other DNA
gtcctagcagttgtggtcat

SEQ ID NO: 2337 - DNA, 20 bp, synthetic construct
  misc_feature 1..20: note = CRISPR gRNA sequence
  source 1..20: mol_type = other DNA
cctagcagttgtggtcatcg

SEQ ID NO: 2338 - DNA, 20 bp, synthetic construct
  misc_feature 1..20: note = CRISPR gRNA sequence
  source 1..20: mol_type = other DNA
agttgtggtcatcggagctg

SEQ ID NO: 2339 - DNA, 20 bp, synthetic construct
  misc_feature 1..20: note = CRISPR gRNA sequence
  source 1..20: mol_type = other DNA
gtggtcgctgctgtgatgtg

SEQ ID NO: 2340 - DNA, 20 bp, synthetic construct
  misc_feature 1..20: note = CRISPR gRNA sequence
  source 1..20: mol_type = other DNA
tggtcgctgctgtgatgtgt

SEQ ID NO: 2341 - DNA, 20 bp, synthetic construct
  misc_feature 1..20: note = CRISPR gRNA sequence
  source 1..20: mol_type = other DNA
gtcgctgctgtgatgtgtag

SEQ ID NO: 2342 - DNA, 20 bp, synthetic construct
  misc_feature 1..20: note = CRISPR gRNA sequence
  source 1..20: mol_type = other DNA
tcgctgctgtgatgtgtagg

SEQ ID NO: 2343 - DNA, 20 bp, synthetic construct
  misc_feature 1..20: note = CRISPR gRNA sequence
  source 1..20: mol_type = other DNA
ctgctgtgatgtgtaggagg

SEQ ID NO: 2344 - DNA, 20 bp, synthetic construct
  misc_feature 1..20: note = CRISPR gRNA sequence
  source 1..20: mol_type = other DNA
gctgtgatgtgtaggaggaa

SEQ ID NO: 2345 - DNA, 20 bp, synthetic construct
  misc_feature 1..20: note = CRISPR gRNA sequence
  source 1..20: mol_type = other DNA
gatgtgtaggaggaagagtt

SEQ ID NO: 2346 - DNA, 20 bp, synthetic construct
  misc_feature 1..20: note = CRISPR gRNA sequence
  source 1..20: mol_type = other DNA
atgtgtaggaggaagagttc

SEQ ID NO: 2347 - DNA, 20 bp, synthetic construct
  misc_feature 1..20: note = CRISPR gRNA sequence
  source 1..20: mol_type = other DNA
tgtaggaggaagagttcagg

SEQ ID NO: 2348 - DNA, 20 bp, synthetic construct
  misc_feature 1..20: note = CRISPR gRNA sequence
  source 1..20: mol_type = other DNA
gtaggaggaagagttcaggt

SEQ ID NO: 2349 - DNA, 20 bp, synthetic construct
  misc_feature 1..20: note = CRISPR gRNA sequence
  source 1..20: mol_type = other DNA
taggaggaagagttcaggta

SEQ ID NO: 2350 - DNA, 20 bp, synthetic construct
  misc_feature 1..20: note = CRISPR gRNA sequence
  source 1..20: mol_type = other DNA
gaggaagagttcaggtaggg

SEQ ID NO: 2351 - DNA, 20 bp, synthetic construct
  misc_feature 1..20: note = CRISPR gRNA sequence
  source 1..20: mol_type = other DNA
aggaagagttcaggtaggga

SEQ ID NO: 2352 - DNA, 20 bp, synthetic construct
  misc_feature 1..20: note = CRISPR gRNA sequence
  source 1..20: mol_type = other DNA
ggaagagttcaggtagggaa

SEQ ID NO: 2353 - DNA, 20 bp, synthetic construct
  misc_feature 1..20: note = CRISPR gRNA sequence
  source 1..20: mol_type = other DNA
gaagagttcaggtagggaag

SEQ ID NO: 2354 - DNA, 20 bp, synthetic construct
  misc_feature 1..20: note = CRISPR gRNA sequence
  source 1..20: mol_type = other DNA
agttcaggtagggaaggggt

SEQ ID NO: 2355 - DNA, 20 bp, synthetic construct
  misc_feature 1..20: note = CRISPR gRNA sequence
  source 1..20: mol_type = other DNA
gttcaggtagggaaggggtg

SEQ ID NO: 2356 - DNA, 20 bp, synthetic construct
  misc_feature 1..20: note = CRISPR gRNA sequence
  source 1..20: mol_type = other DNA
ttcaggtagggaaggggtga

SEQ ID NO: 2357 - DNA, 20 bp, synthetic construct
  misc_feature 1..20: note = CRISPR gRNA sequence
  source 1..20: mol_type = other DNA
tcaggtagggaaggggtgag

SEQ ID NO: 2358 - DNA, 20 bp, synthetic construct
  misc_feature 1..20: note = CRISPR gRNA sequence
  source 1..20: mol_type = other DNA
ggtagggaaggggtgagggg

SEQ ID NO: 2359 - DNA, 20 bp, synthetic construct
  misc_feature 1..20: note = CRISPR gRNA sequence
  source 1..20: mol_type = other DNA
gtagggaaggggtgaggggt

SEQ ID NO: 2360 - DNA, 20 bp, synthetic construct
  misc_feature 1..20: note = CRISPR gRNA sequence
  source 1..20: mol_type = other DNA
tagggaaggggtgaggggtg

SEQ ID NO: 2361 - DNA, 20 bp, synthetic construct
  misc_feature 1..20: note = CRISPR gRNA sequence
  source 1..20: mol_type = other DNA
aaggggtgaggggtggggtc

SEQ ID NO: 2362 - DNA, 20 bp, synthetic construct
  misc_feature 1..20: note = CRISPR gRNA sequence
  source 1..20: mol_type = other DNA
aggggtgaggggtggggtct

SEQ ID NO: 2363 - DNA, 20 bp, synthetic construct
  misc_feature 1..20: note = CRISPR gRNA sequence
  source 1..20: mol_type = other DNA
tctgggttttcttgtcccac

SEQ ID NO: 2364 - DNA, 20 bp, synthetic construct
  misc_feature 1..20: note = CRISPR gRNA sequence
  source 1..20: mol_type = other DNA
ctgggttttcttgtcccact

SEQ ID NO: 2365 - DNA, 20 bp, synthetic construct
  misc_feature 1..20: note = CRISPR gRNA sequence
  source 1..20: mol_type = other DNA
tgggttttcttgtcccactg

SEQ ID NO: 2366 - DNA, 20 bp, synthetic construct
  misc_feature 1..20: note = CRISPR gRNA sequence
  source 1..20: mol_type = other DNA
gggttttcttgtcccactgg

SEQ ID NO: 2367 - DNA, 20 bp, synthetic construct
  misc_feature 1..20: note = CRISPR gRNA sequence
  source 1..20: mol_type = other DNA
cttgtcccactgggggtttc

SEQ ID NO: 2368 - DNA, 20 bp, synthetic construct
  misc_feature 1..20: note = CRISPR gRNA sequence
  source 1..20: mol_type = other DNA
ccactgggggtttcaagccc

SEQ ID NO: 2369 - DNA, 20 bp, synthetic construct
  misc_feature 1..20: note = CRISPR gRNA sequence
  source 1..20: mol_type = other DNA
cactgggggtttcaagcccc

SEQ ID NO: 2370 - DNA, 20 bp, synthetic construct
  misc_feature 1..20: note = CRISPR gRNA sequence
  source 1..20: mol_type = other DNA
tgggggtttcaagccccagg

SEQ ID NO: 2371 - DNA, 20 bp, synthetic construct
  misc_feature 1..20: note = CRISPR gRNA sequence
  source 1..20: mol_type = other DNA
gggtttcaagccccaggtag

SEQ ID NO: 2372 - DNA, 20 bp, synthetic construct
  misc_feature 1..20: note = CRISPR gRNA sequence
  source 1..20: mol_type = other DNA
agtgttccctgcctcattac

SEQ ID NO: 2373 - DNA, 20 bp, synthetic construct
  misc_feature 1..20: note = CRISPR gRNA sequence
  source 1..20: mol_type = other DNA
gtgttccctgcctcattact

SEQ ID NO: 2374 - DNA, 20 bp, synthetic construct
  misc_feature 1..20: note = CRISPR gRNA sequence
  source 1..20: mol_type = other DNA
ttccctgcctcattactggg

SEQ ID NO: 2375 - DNA, 20 bp, synthetic construct
  misc_feature 1..20: note = CRISPR gRNA sequence
  source 1..20: mol_type = other DNA
cctgcctcattactgggaag

SEQ ID NO: 2376 - DNA, 20 bp, synthetic construct
  misc_feature 1..20: note = CRISPR gRNA sequence
  source 1..20: mol_type = other DNA
actgggaagcagcatgcaca

SEQ ID NO: 2377 - DNA, 20 bp, synthetic construct
  misc_feature 1..20: note = CRISPR gRNA sequence
  source 1..20: mol_type = other DNA
ctgggaagcagcatgcacac

SEQ ID NO: 2378 - DNA, 20 bp, synthetic construct
  misc_feature 1..20: note = CRISPR gRNA sequence
  source 1..20: mol_type = other DNA
tgggaagcagcatgcacaca

SEQ ID NO: 2379 - DNA, 20 bp, synthetic construct
  misc_feature 1..20: note = CRISPR gRNA sequence
  source 1..20: mol_type = other DNA
gggaagcagcatgcacacag

SEQ ID NO: 2380 - DNA, 20 bp, synthetic construct
  misc_feature 1..20: note = CRISPR gRNA sequence
  source 1..20: mol_type = other DNA
catgcacacaggggctaacg

SEQ ID NO: 2381 - DNA, 20 bp, synthetic construct
  misc_feature 1..20: note = CRISPR gRNA sequence
  source 1..20: mol_type = other DNA
acacaggggctaacgcagcc

SEQ ID NO: 2382 - DNA, 20 bp, synthetic construct
  misc_feature 1..20: note = CRISPR gRNA sequence
  source 1..20: mol_type = other DNA
cacaggggctaacgcagcct

SEQ ID NO: 2383 - DNA, 20 bp, synthetic construct
  misc_feature 1..20: note = CRISPR gRNA sequence
  source 1..20: mol_type = other DNA
cagcctgggaccctgtgtgc

SEQ ID NO: 2384 - DNA, 20 bp, synthetic construct
  misc_feature 1..20: note = CRISPR gRNA sequence
  source 1..20: mol_type = other DNA
ccagcacttactcttttgtg

SEQ ID NO: 2385 - DNA, 20 bp, synthetic construct
  misc_feature 1..20: note = CRISPR gRNA sequence
  source 1..20: mol_type = other DNA
gtgcagcacatgtgacaatg

SEQ ID NO: 2386 - DNA, 20 bp, synthetic construct
  misc_feature 1..20: note = CRISPR gRNA sequence
  source 1..20: mol_type = other DNA
tgcagcacatgtgacaatga

SEQ ID NO: 2387 - DNA, 20 bp, synthetic construct
  misc_feature 1..20: note = CRISPR gRNA sequence
  source 1..20: mol_type = other DNA
gcacatgtgacaatgaagga

SEQ ID NO: 2388 - DNA, 20 bp, synthetic construct
  misc_feature 1..20: note = CRISPR gRNA sequence
  source 1..20: mol_type = other DNA
ggatggatgtatcaccttga

SEQ ID NO: 2389 - DNA, 20 bp, synthetic construct
  misc_feature 1..20: note = CRISPR gRNA sequence
  source 1..20: mol_type = other DNA
atgtatcaccttgatggttg

SEQ ID NO: 2390 - DNA, 20 bp, synthetic construct
  misc_feature 1..20: note = CRISPR gRNA sequence
  source 1..20: mol_type = other DNA
caccttgatggttgtggtgt

SEQ ID NO: 2391 - DNA, 20 bp, synthetic construct
  misc_feature 1..20: note = CRISPR gRNA sequence
  source 1..20: mol_type = other DNA
accttgatggttgtggtgtt

SEQ ID NO: 2392 - DNA, 20 bp, synthetic construct
  misc_feature 1..20: note = CRISPR gRNA sequence
  source 1..20: mol_type = other DNA
ccttgatggttgtggtgttg

SEQ ID NO: 2393 - DNA, 20 bp, synthetic construct
  misc_feature 1..20: note = CRISPR gRNA sequence
  source 1..20: mol_type = other DNA
tggtgttggggtcctgattc

SEQ ID NO: 2394 - DNA, 20 bp, synthetic construct
  misc_feature 1..20: note = CRISPR gRNA sequence
  source 1..20: mol_type = other DNA
gtcctgattccagcattcat

SEQ ID NO: 2395 - DNA, 20 bp, synthetic construct
  misc_feature 1..20: note = CRISPR gRNA sequence
  source 1..20: mol_type = other DNA
tgattccagcattcatgagt

SEQ ID NO: 2396 - DNA, 20 bp, synthetic construct
  misc_feature 1..20: note = CRISPR gRNA sequence
  source 1..20: mol_type = other DNA
gattccagcattcatgagtc

SEQ ID NO: 2397 - DNA, 20 bp, synthetic construct
  misc_feature 1..20: note = CRISPR gRNA sequence
  source 1..20: mol_type = other DNA
attccagcattcatgagtca

SEQ ID NO: 2398 - DNA, 20 bp, synthetic construct
  misc_feature 1..20: note = CRISPR gRNA sequence
  source 1..20: mol_type = other DNA
ttccagcattcatgagtcag

SEQ ID NO: 2399 - DNA, 20 bp, synthetic construct
  misc_feature 1..20: note = CRISPR gRNA sequence
  source 1..20: mol_type = other DNA
cagcattcatgagtcagggg

SEQ ID NO: 2400 - DNA, 20 bp, synthetic construct
  misc_feature 1..20: note = CRISPR gRNA sequence
  source 1..20: mol_type = other DNA
agcattcatgagtcagggga

SEQ ID NO: 2401 - DNA, 20 bp, synthetic construct
  misc_feature 1..20: note = CRISPR gRNA sequence
  source 1..20: mol_type = other DNA
gtcaggggaaggtccctgct

SEQ ID NO: 2402 - DNA, 20 bp, synthetic construct
  misc_feature 1..20: note = CRISPR gRNA sequence
  source 1..20: mol_type = other DNA
tcaggggaaggtccctgcta

SEQ ID NO: 2403 - DNA, 20 bp, synthetic construct
  misc_feature 1..20: note = CRISPR gRNA sequence
  source 1..20: mol_type = other DNA
gggaaggtccctgctaagga

SEQ ID NO: 2404 - DNA, 20 bp, synthetic construct
  misc_feature 1..20: note = CRISPR gRNA sequence
  source 1..20: mol_type = other DNA
tccctgctaaggacagacct

SEQ ID NO: 2405 - DNA, 20 bp, synthetic construct
  misc_feature 1..20: note = CRISPR gRNA sequence
  source 1..20: mol_type = other DNA
ccctgctaaggacagacctt

SEQ ID NO: 2406 - DNA, 20 bp, synthetic construct
  misc_feature 1..20: note = CRISPR gRNA sequence
  source 1..20: mol_type = other DNA
ctgctaaggacagaccttag

SEQ ID NO: 2407 - DNA, 20 bp, synthetic construct
  misc_feature 1..20: note = CRISPR gRNA sequence
  source 1..20: mol_type = other DNA
tgctaaggacagaccttagg

SEQ ID NO: 2408 - DNA, 20 bp, synthetic construct
  misc_feature 1..20: note = CRISPR gRNA sequence
  source 1..20: mol_type = other DNA
gctaaggacagaccttagga

SEQ ID NO: 2409 - DNA, 20 bp, synthetic construct
  misc_feature 1..20: note = CRISPR gRNA sequence
  source 1..20: mol_type = other DNA
aaggacagaccttaggaggg

SEQ ID NO: 2410 - DNA, 20 bp, synthetic construct
  misc_feature 1..20: note = CRISPR gRNA sequence
  source 1..20: mol_type = other DNA
acagaccttaggagggcagt

SEQ ID NO: 2411 - DNA, 20 bp, synthetic construct
  misc_feature 1..20: note = CRISPR gRNA sequence
  source 1..20: mol_type = other DNA
ccttaggagggcagttggtc

SEQ ID NO: 2412 - DNA, 20 bp, synthetic construct
  misc_feature 1..20: note = CRISPR gRNA sequence
  source 1..20: mol_type = other DNA
cttaggagggcagttggtcc

SEQ ID NO: 2413 - DNA, 20 bp, synthetic construct
  misc_feature 1..20: note = CRISPR gRNA sequence
  source 1..20: mol_type = other DNA
cgtgtttcctgatcctgccc

SEQ ID NO: 2414 - DNA, 20 bp, synthetic construct
  misc_feature 1..20: note = CRISPR gRNA sequence
  source 1..20: mol_type = other DNA
gtgtttcctgatcctgccct

SEQ ID NO: 2415 - DNA, 20 bp, synthetic construct
  misc_feature 1..20: note = CRISPR gRNA sequence
  source 1..20: mol_type = other DNA
ctgatcctgccctgggtctg

SEQ ID NO: 2416 - DNA, 20 bp, synthetic construct
  misc_feature 1..20: note = CRISPR gRNA sequence
  source 1..20: mol_type = other DNA
tgggtctgtagtcatacttc

SEQ ID NO: 2417 - DNA, 20 bp, synthetic construct
  misc_feature 1..20: note = CRISPR gRNA sequence
  source 1..20: mol_type = other DNA
atacttctggaaattccttt

SEQ ID NO: 2418 - DNA, 20 bp, synthetic construct
  misc_feature 1..20: note = CRISPR gRNA sequence
  source 1..20: mol_type = other DNA
tacttctggaaattcctttt

SEQ ID NO: 2419 - DNA, 20 bp, synthetic construct
  misc_feature 1..20: note = CRISPR gRNA sequence
  source 1..20: mol_type = other DNA
tggaaattccttttgggtcc

SEQ ID NO: 2420 - DNA, 20 bp, synthetic construct
  misc_feature 1..20: note = CRISPR gRNA sequence
  source 1..20: mol_type = other DNA
attccttttgggtccaagac

SEQ ID NO: 2421 - DNA, 20 bp, synthetic construct
  misc_feature 1..20: note = CRISPR gRNA sequence
  source 1..20: mol_type = other DNA
ttccttttgggtccaagact

SEQ ID NO: 2422 - DNA, 20 bp, synthetic construct
  misc_feature 1..20: note = CRISPR gRNA sequence
  source 1..20: mol_type = other DNA
ccttttgggtccaagactag

SEQ ID NO: 2423 - DNA, 20 bp, synthetic construct
  misc_feature 1..20: note = CRISPR gRNA sequence
  source 1..20: mol_type = other DNA
cttttgggtccaagactagg

SEQ ID NO: 2424 - DNA, 20 bp, synthetic construct
  misc_feature 1..20: note = CRISPR gRNA sequence
  source 1..20: mol_type = other DNA
caagactaggaggttcctct

SEQ ID NO: 2425 - DNA, 20 bp, synthetic construct
  misc_feature 1..20: note = CRISPR gRNA sequence
  source 1..20: mol_type = other DNA
gaggttcctctaagatctca

SEQ ID NO: 2426 - DNA, 20 bp, synthetic construct
  misc_feature 1..20: note = CRISPR gRNA sequence
  source 1..20: mol_type = other DNA
ctcatggccctgcttcctcc

SEQ ID NO: 2427 - DNA, 20 bp, synthetic construct
  misc_feature 1..20: note = CRISPR gRNA sequence
  source 1..20: mol_type = other DNA
gcttcctcccagtgccctca

SEQ ID NO: 2428 - DNA, 20 bp, synthetic construct
  misc_feature 1..20: note = CRISPR gRNA sequence
  source 1..20: mol_type = other DNA
cttcctcccagtgccctcac

SEQ ID NO: 2429 - DNA, 20 bp, synthetic construct
  misc_feature 1..20: note = CRISPR gRNA sequence
  source 1..20: mol_type = other DNA
cacaggacattttcttccca

SEQ ID NO: 2430 - DNA, 20 bp, synthetic construct
  misc_feature 1..20: note = CRISPR gRNA sequence
  source 1..20: mol_type = other DNA
acaggacattttcttcccac

SEQ ID NO: 2431 - DNA, 20 bp, synthetic construct
  misc_feature 1..20: note = CRISPR gRNA sequence
  source 1..20: mol_type = other DNA
ggacattttcttcccacagg

SEQ ID NO: 2432 - DNA, 20 bp, synthetic construct
  misc_feature 1..20: note = CRISPR gRNA sequence
  source 1..20: mol_type = other DNA
ttttcttcccacaggtggaa

SEQ ID NO: 2433 - DNA, 20 bp, synthetic construct
  misc_feature 1..20: note = CRISPR gRNA sequence
  source 1..20: mol_type = other DNA
tttcttcccacaggtggaaa

SEQ ID NO: 2434 - DNA, 20 bp, synthetic construct
  misc_feature 1..20: note = CRISPR gRNA sequence
  source 1..20: mol_type = other DNA
tcttcccacaggtggaaaag

SEQ ID NO: 2435 - DNA, 20 bp, synthetic construct
  misc_feature 1..20: note = CRISPR gRNA sequence
  source 1..20: mol_type = other DNA
cttcccacaggtggaaaagg

SEQ ID NO: 2436 - DNA, 20 bp, synthetic construct
  misc_feature 1..20: note = CRISPR gRNA sequence
  source 1..20: mol_type = other DNA
ttcccacaggtggaaaagga

SEQ ID NO: 2437 - DNA, 20 bp, synthetic construct
  misc_feature 1..20: note = CRISPR gRNA sequence
  source 1..20: mol_type = other DNA
cccacaggtggaaaaggagg

SEQ ID NO: 2438 - DNA, 20 bp, synthetic construct
  misc_feature 1..20: note = CRISPR gRNA sequence
  source 1..20: mol_type = other DNA
gaaaaggagggagctactct

SEQ ID NO: 2439 - DNA, 20 bp, synthetic construct
  misc_feature 1..20: note = CRISPR gRNA sequence
  source 1..20: mol_type = other DNA
aaaaggagggagctactctc

SEQ ID NO: 2440 - DNA, 20 bp, synthetic construct
  misc_feature 1..20: note = CRISPR gRNA sequence
  source 1..20: mol_type = other DNA
gctactctcaggctgcgtgt

SEQ ID NO: 2441 - DNA, 20 bp, synthetic construct
  misc_feature 1..20: note = CRISPR gRNA sequence
  source 1..20: mol_type = other DNA
actctcaggctgcgtgtaag

SEQ ID NO: 2442 - DNA, 20 bp, synthetic construct
  misc_feature 1..20: note = CRISPR gRNA sequence
  source 1..20: mol_type = other DNA
ctcaggctgcgtgtaagtgg

SEQ ID NO: 2443 - DNA, 20 bp, synthetic construct
  misc_feature 1..20: note = CRISPR gRNA sequence
  source 1..20: mol_type = other DNA
tcaggctgcgtgtaagtggt

SEQ ID NO: 2444 - DNA, 20 bp, synthetic construct
  misc_feature 1..20: note = CRISPR gRNA sequence
  source 1..20: mol_type = other DNA
caggctgcgtgtaagtggtg

SEQ ID NO: 2445 - DNA, 20 bp, synthetic construct
  misc_feature 1..20: note = CRISPR gRNA sequence
  source 1..20: mol_type = other DNA
aggctgcgtgtaagtggtgg

SEQ ID NO: 2446 - DNA, 20 bp, synthetic construct
  misc_feature 1..20: note = CRISPR gRNA sequence
  source 1..20: mol_type = other DNA
ctgcgtgtaagtggtggggg

SEQ ID NO: 2447 - DNA, 20 bp, synthetic construct
  misc_feature 1..20: note = CRISPR gRNA sequence
  source 1..20: mol_type = other DNA
tgcgtgtaagtggtgggggt

SEQ ID NO: 2448 - DNA, 20 bp, synthetic construct
  misc_feature 1..20: note = CRISPR gRNA sequence
  source 1..20: mol_type = other DNA
cgtgtaagtggtgggggtgg

SEQ ID NO: 2449 - DNA, 20 bp, synthetic construct
  misc_feature 1..20: note = CRISPR gRNA sequence
  source 1..20: mol_type = other DNA
aagtggtgggggtgggagtg

SEQ ID NO: 2450 - DNA, 20 bp, synthetic construct
  misc_feature 1..20: note = CRISPR gRNA sequence
  source 1..20: mol_type = other DNA
gtggtgggggtgggagtgtg

SEQ ID NO: 2451 - DNA, 20 bp, synthetic construct
  misc_feature 1..20: note = CRISPR gRNA sequence
  source 1..20: mol_type = other DNA
tggtgggggtgggagtgtgg

SEQ ID NO: 2452 - DNA, 20 bp, synthetic construct
  misc_feature 1..20: note = CRISPR gRNA sequence
  source 1..20: mol_type = other DNA
gtgggggtgggagtgtggag

SEQ ID NO: 2453 - DNA, 20 bp, synthetic construct
  misc_feature 1..20: note = CRISPR gRNA sequence
  source 1..20: mol_type = other DNA
ctcctgtcccacgtctcctg

SEQ ID NO: 2454 - DNA, 20 bp, synthetic construct
  misc_feature 1..20: note = CRISPR gRNA sequence
  source 1..20: mol_type = other DNA
tcctgtcccacgtctcctgc

SEQ ID NO: 2455 - DNA, 20 bp, synthetic construct
  misc_feature 1..20: note = CRISPR gRNA sequence
  source 1..20: mol_type = other DNA
cgtctcctgcgggctctgac

SEQ ID NO: 2456 - DNA, 20 bp, synthetic construct
  misc_feature 1..20: note = CRISPR gRNA sequence
  source 1..20: mol_type = other DNA
gtctcctgcgggctctgacc

SEQ ID NO: 2457 - DNA, 20 bp, synthetic construct
  misc_feature 1..20: note = CRISPR gRNA sequence
  source 1..20: mol_type = other DNA
gtcctgtttttgttctactc

SEQ ID NO: 2458 - DNA, 20 bp, synthetic construct
  misc_feature 1..20: note = CRISPR gRNA sequence
  source 1..20: mol_type = other DNA
tcctgtttttgttctactcc

SEQ ID NO: 2459 - DNA, 20 bp, synthetic construct
  misc_feature 1..20: note = CRISPR gRNA sequence
  source 1..20: mol_type = other DNA
tgtttttgttctactccagg

SEQ ID NO: 2460 - DNA, 20 bp, synthetic construct
  misc_feature 1..20: note = CRISPR gRNA sequence
  source 1..20: mol_type = other DNA
tgttctactccaggcagcga

SEQ ID NO: 2461 - DNA, 20 bp, synthetic construct
  misc_feature 1..20: note = CRISPR gRNA sequence
  source 1..20: mol_type = other DNA
ctccaggcagcgacagtgcc

SEQ ID NO: 2462 - DNA, 20 bp, synthetic construct
  misc_feature 1..20: note = CRISPR gRNA sequence
  source 1..20: mol_type = other DNA
tccaggcagcgacagtgccc

SEQ ID NO: 2463 - DNA, 20 bp, synthetic construct
  misc_feature 1..20: note = CRISPR gRNA sequence
  source 1..20: mol_type = other DNA
ccaggcagcgacagtgccca

SEQ ID NO: 2464 - DNA, 20 bp, synthetic construct
  misc_feature 1..20: note = CRISPR gRNA sequence
  source 1..20: mol_type = other DNA
gggctctgatgtgtctctca

SEQ ID NO: 2465 - DNA, 20 bp, synthetic construct
  misc_feature 1..20: note = CRISPR gRNA sequence
  source 1..20: mol_type = other DNA
tgtgtctctcacagcttgaa

SEQ ID NO: 2466 - DNA, 20 bp, synthetic construct
  misc_feature 1..20: note = CRISPR gRNA sequence
  source 1..20: mol_type = other DNA
gtgtctctcacagcttgaaa

SEQ ID NO: 2467 - DNA, 20 bp, synthetic construct
  misc_feature 1..20: note = CRISPR gRNA sequence
  source 1..20: mol_type = other DNA
ctctcacagcttgaaaaggt

SEQ ID NO: 2468 - DNA, 20 bp, synthetic construct
  misc_feature 1..20: note = CRISPR gRNA sequence
  source 1..20: mol_type = other DNA
gcttgaaaaggtgagattct

SEQ ID NO: 2469 - DNA, 20 bp, synthetic construct
  misc_feature 1..20: note = CRISPR gRNA sequence
  source 1..20: mol_type = other DNA
cttgaaaaggtgagattctt

SEQ ID NO: 2470 - DNA, 20 bp, synthetic construct
  misc_feature 1..20: note = CRISPR gRNA sequence
  source 1..20: mol_type = other DNA
ttgaaaaggtgagattcttg

SEQ ID NO: 2471 - DNA, 20 bp, synthetic construct
  misc_feature 1..20: note = CRISPR gRNA sequence
  source 1..20: mol_type = other DNA
aaggtgagattcttggggtc

SEQ ID NO: 2472 - DNA, 20 bp, synthetic construct
  misc_feature 1..20: note = CRISPR gRNA sequence
  source 1..20: mol_type = other DNA
ggtgagattcttggggtcta

SEQ ID NO: 2473 - DNA, 20 bp, synthetic construct
  misc_feature 1..20: note = CRISPR gRNA sequence
  source 1..20: mol_type = other DNA
gagattcttggggtctagag

SEQ ID NO: 2474 - DNA, 20 bp, synthetic construct
  misc_feature 1..20: note = CRISPR gRNA sequence
  source 1..20: mol_type = other DNA
agattcttggggtctagagt

SEQ ID NO: 2475 - DNA, 20 bp, synthetic construct
  misc_feature 1..20: note = CRISPR gRNA sequence
  source 1..20: mol_type = other DNA
ttcttggggtctagagtggg

SEQ ID NO: 2476 - DNA, 20 bp, synthetic construct
  misc_feature 1..20: note = CRISPR gRNA sequence
  source 1..20: mol_type = other DNA
tcttggggtctagagtgggt

SEQ ID NO: 2477 - DNA, 20 bp, synthetic construct
  misc_feature 1..20: note = CRISPR gRNA sequence
  source 1..20: mol_type = other DNA
cttggggtctagagtgggtg

SEQ ID NO: 2478 - DNA, 20 bp, synthetic construct
  misc_feature 1..20: note = CRISPR gRNA sequence
  source 1..20: mol_type = other DNA
ggggtctagagtgggtgggg

SEQ ID NO: 2479 - DNA, 20 bp, synthetic construct
  misc_feature 1..20: note = CRISPR gRNA sequence
  source 1..20: mol_type = other DNA
gtctagagtgggtggggtgg

SEQ ID NO: 2480 - DNA, 20 bp, synthetic construct
  misc_feature 1..20: note = CRISPR gRNA sequence
  source 1..20: mol_type = other DNA
tctagagtgggtggggtggc

SEQ ID NO: 2481 - DNA, 20 bp, synthetic construct
  misc_feature 1..20: note = CRISPR gRNA sequence
  source 1..20: mol_type = other DNA
agtgggtggggtggcgggtc

SEQ ID NO: 2482 - DNA, 20 bp, synthetic construct
  misc_feature 1..20: note = CRISPR gRNA sequence
  source 1..20: mol_type = other DNA
gtgggtggggtggcgggtct

SEQ ID NO: 2483 - DNA, 20 bp, synthetic construct
  misc_feature 1..20: note = CRISPR gRNA sequence
  source 1..20: mol_type = other DNA
tgggtggggtggcgggtctg

SEQ ID NO: 2484 - DNA, 20 bp, synthetic construct
  misc_feature 1..20: note = CRISPR gRNA sequence
  source 1..20: mol_type = other DNA
gggtggggtggcgggtctgg

SEQ ID NO: 2485 - DNA, 20 bp, synthetic construct
  misc_feature 1..20: note = CRISPR gRNA sequence
  source 1..20: mol_type = other DNA
tggggtggcgggtctggggg

SEQ ID NO: 2486 - DNA, 20 bp, synthetic construct
  misc_feature 1..20: note = CRISPR gRNA sequence
  source 1..20: mol_type = other DNA
ggggtggcgggtctgggggt

SEQ ID NO: 2487 - DNA, 20 bp, synthetic construct
  misc_feature 1..20: note = CRISPR gRNA sequence
  source 1..20: mol_type = other DNA
gtggcgggtctgggggtggg

SEQ ID NO: 2488 - DNA, 20 bp, synthetic construct
  misc_feature 1..20: note = CRISPR gRNA sequence
  source 1..20: mol_type = other DNA
tggcgggtctgggggtgggt

SEQ ID NO: 2489 - DNA, 20 bp, synthetic construct
  misc_feature 1..20: note = CRISPR gRNA sequence
  source 1..20: mol_type = other DNA
ggcgggtctgggggtgggtg

SEQ ID NO: 2490 - DNA, 20 bp, synthetic construct
  misc_feature 1..20: note = CRISPR gRNA sequence
  source 1..20: mol_type = other DNA
gggtctgggggtgggtgggg

SEQ ID NO: 2491 - DNA, 20 bp, synthetic construct
  misc_feature 1..20: note = CRISPR gRNA sequence
  source 1..20: mol_type = other DNA
gtctgggggtgggtggggca

SEQ ID NO: 2492 - DNA, 20 bp, synthetic construct
  misc_feature 1..20: note = CRISPR gRNA sequence
  source 1..20: mol_type = other DNA
tctgggggtgggtggggcag

SEQ ID NO: 2493 - DNA, 20 bp, synthetic construct
  misc_feature 1..20: note = CRISPR gRNA sequence
  source 1..20: mol_type = other DNA
ctgggggtgggtggggcaga

SEQ ID NO: 2494 - DNA, 20 bp, synthetic construct
  misc_feature 1..20: note = CRISPR gRNA sequence
  source 1..20: mol_type = other DNA
tgggggtgggtggggcagag

SEQ ID NO: 2495 - DNA, 20 bp, synthetic construct
  misc_feature 1..20: note = CRISPR gRNA sequence
  source 1..20: mol_type = other DNA
ggtgggtggggcagagggga

SEQ ID NO: 2496 - DNA, 20 bp, synthetic construct
  misc_feature 1..20: note = CRISPR gRNA sequence
  source 1..20: mol_type = other DNA
gtgggtggggcagaggggaa

SEQ ID NO: 2497 - DNA, 20 bp, synthetic construct
  misc_feature 1..20: note = CRISPR gRNA sequence
  source 1..20: mol_type = other DNA
tggggcagaggggaaaggcc

SEQ ID NO: 2498 - DNA, 20 bp, synthetic construct
  misc_feature 1..20: note = CRISPR gRNA sequence
  source 1..20: mol_type = other DNA
ggggcagaggggaaaggcct

SEQ ID NO: 2499 - DNA, 20 bp, synthetic construct
  misc_feature 1..20: note = CRISPR gRNA sequence
  source 1..20: mol_type = other DNA
gaggggaaaggcctgggtaa

SEQ ID NO: 2500 - DNA, 20 bp, synthetic construct
  misc_feature 1..20: note = CRISPR gRNA sequence
  source 1..20: mol_type = other DNA
aggggaaaggcctgggtaat

SEQ ID NO: 2501 - DNA, 20 bp, synthetic construct
  misc_feature 1..20: note = CRISPR gRNA sequence
  source 1..20: mol_type = other DNA
ggggaaaggcctgggtaatg

SEQ ID NO: 2502 - DNA, 20 bp, synthetic construct
  misc_feature 1..20: note = CRISPR gRNA sequence
  source 1..20: mol_type = other DNA
ggtaatggggattctttgat

SEQ ID NO: 2503 - DNA, 20 bp, synthetic construct
  misc_feature 1..20: note = CRISPR gRNA sequence
  source 1..20: mol_type = other DNA
gtaatggggattctttgatt

SEQ ID NO: 2504 - DNA, 20 bp, synthetic construct
  misc_feature 1..20: note = CRISPR gRNA sequence
  source 1..20: mol_type = other DNA
ccccacccactctagacccc

SEQ ID NO: 2505 - DNA, 20 bp, synthetic construct
  misc_feature 1..20: note = CRISPR gRNA sequence
  source 1..20: mol_type = other DNA
ccctgggcactgtcgctgcc

SEQ ID NO: 2506 - DNA, 20 bp, synthetic construct
  misc_feature 1..20: note = CRISPR gRNA sequence
  source 1..20: mol_type = other DNA
cgcaggagacgtgggacagg

SEQ ID NO: 2507 - DNA, 20 bp, synthetic construct
  misc_feature 1..20: note = CRISPR gRNA sequence
  source 1..20: mol_type = other DNA
acgtgggacaggaggaatta

SEQ ID NO: 2508 - DNA, 20 bp, synthetic construct
  misc_feature 1..20: note = CRISPR gRNA sequence
  source 1..20: mol_type = other DNA
gggacaggaggaattatggg

SEQ ID NO: 2509 - DNA, 20 bp, synthetic construct
  misc_feature 1..20: note = CRISPR gRNA sequence
  source 1..20: mol_type = other DNA
ccaccacttacacgcagcct

SEQ ID NO: 2510 - DNA, 20 bp, synthetic construct
  misc_feature 1..20: note = CRISPR gRNA sequence
  source 1..20: mol_type = other DNA
ctcctagtcttggacccaaa

SEQ ID NO: 2511 - DNA, 20 bp, synthetic construct
  misc_feature 1..20: note = CRISPR gRNA sequence
  source 1..20: mol_type = other DNA
gtatgactacagacccaggg

SEQ ID NO: 2512 - DNA, 20 bp, synthetic construct
  misc_feature 1..20: note = CRISPR gRNA sequence
  source 1..20: mol_type = other DNA
gaaacacgaggaaagcaagt

SEQ ID NO: 2513 - DNA, 20 bp, synthetic construct
  misc_feature 1..20: note = CRISPR gRNA sequence
  source 1..20: mol_type = other DNA
cagggaccttcccctgactc

SEQ ID NO: 2514 - DNA, 20 bp, synthetic construct
  misc_feature 1..20: note = CRISPR gRNA sequence
  source 1..20: mol_type = other DNA
ttcccctgactcatgaatgc

SEQ ID NO: 2515 - DNA, 20 bp, synthetic construct
  misc_feature 1..20: note = CRISPR gRNA sequence
  source 1..20: mol_type = other DNA
ttgtcacatgtgctgcacaa

SEQ ID NO: 2516 - DNA, 20 bp, synthetic construct
  misc_feature 1..20: note = CRISPR gRNA sequence
  source 1..20: mol_type = other DNA
aaagagtaagtgctggcaca

SEQ ID NO: 2517 - DNA, 20 bp, synthetic construct
  misc_feature 1..20: note = CRISPR gRNA sequence
  source 1..20: mol_type = other DNA
tccccctccttaccccatct

SEQ ID NO: 2518 - DNA, 20 bp, synthetic construct
  misc_feature 1..20: note = CRISPR gRNA sequence
  source 1..20: mol_type = other DNA
gtctccacaagctcagtgtc

SEQ ID NO: 2519 - DNA, 20 bp, synthetic construct
  misc_feature 1..20: note = CRISPR gRNA sequence
  source 1..20: mol_type = other DNA
ccaggtcagtgtgatctccg

SEQ ID NO: 2520 - DNA, 20 bp, synthetic construct
  misc_feature 1..20: note = CRISPR gRNA sequence
  source 1..20: mol_type = other DNA
aaacccagggcccagcacct

SEQ ID NO: 2521 - DNA, 20 bp, synthetic construct
  misc_feature 1..20: note = CRISPR gRNA sequence
  source 1..20: mol_type = other DNA
ggtggcctcatggtcagaga

SEQ ID NO: 2522 - DNA, 20 bp, synthetic construct
  misc_feature 1..20: note = CRISPR gRNA sequence
  source 1..20: mol_type = other DNA
tcatggtcagagatggggtg

SEQ ID NO: 2523 - DNA, 20 bp, synthetic construct
  misc_feature 1..20: note = CRISPR gRNA sequence
  source 1..20: mol_type = other DNA
gtgggtcacgtgtgtctttg

SEQ ID NO: 2524 - DNA, 20 bp, synthetic construct
  misc_feature 1..20: note = CRISPR gRNA sequence
  source 1..20: mol_type = other DNA
tctttggggggtctgatggg

SEQ ID NO: 2525 - DNA, 20 bp, synthetic construct
  misc_feature 1..20: note = CRISPR gRNA sequence
  source 1..20: mol_type = other DNA
accacccatgtgaccagcct

SEQ ID NO: 2526 - DNA, 20 bp, synthetic construct
  misc_feature 1..20: note = CRISPR gRNA sequence
  source 1..20: mol_type = other DNA
ctgagaatggacaggacacc

SEQ ID NO: 2527 - DNA, 20 bp, synthetic construct
  misc_feature 1..20: note = CRISPR gRNA sequence
  source 1..20: mol_type = other DNA
ccagcctggacgcaggcacc

SEQ ID NO: 2528 - DNA, 20 bp, synthetic construct
  misc_feature 1..20: note = CRISPR gRNA sequence
  source 1..20: mol_type = other DNA
tctcctattcattggaaagt

SEQ ID NO: 2529 - DNA, 20 bp, synthetic construct
  misc_feature 1..20: note = CRISPR gRNA sequence
  source 1..20: mol_type = other DNA
cagggacttctgctcctgat

SEQ ID NO: 2530 - DNA, 20 bp, synthetic construct
  misc_feature 1..20: note = CRISPR gRNA sequence
  source 1..20: mol_type = other DNA
gtaaagtgactcagaagtgc

SEQ ID NO: 2531 - DNA, 20 bp, synthetic construct
  misc_feature 1..20: note = CRISPR gRNA sequence
  source 1..20: mol_type = other DNA
gaatcagagccccaaacaca

SEQ ID NO: 2532 - DNA, 20 bp, synthetic construct
  misc_feature 1..20: note = CRISPR gRNA sequence
  source 1..20: mol_type = other DNA
acggttcccaaggctgctgc

SEQ ID NO: 2533 - DNA, 20 bp, synthetic construct
  misc_feature 1..20: note = CRISPR gRNA sequence
  source 1..20: mol_type = other DNA
cgggccgcctcccacttgcg

SEQ ID NO: 2534 - DNA, 20 bp, synthetic construct
  misc_feature 1..20: note = CRISPR gRNA sequence
  source 1..20: mol_type = other DNA
tcgcagccgtacatgctctg

SEQ ID NO: 2535 - DNA, 20 bp, synthetic construct
  misc_feature 1..20: note = CRISPR gRNA sequence
  source 1..20: mol_type = other DNA
ccccgccccgaccaacccgc

SEQ ID NO: 2536 - DNA, 20 bp, synthetic construct
  misc_feature 1..20: note = CRISPR gRNA sequence
  source 1..20: mol_type = other DNA
ggcctcaactgaaaatgaaa

SEQ ID NO: 2537 - DNA, 20 bp, synthetic construct
  misc_feature 1..20: note = CRISPR gRNA sequence
  source 1..20: mol_type = other DNA
gcctggggctctcgccggtc

SEQ ID NO: 2538 - DNA, 20 bp, synthetic construct
  misc_feature 1..20: note = CRISPR gRNA sequence
  source 1..20: mol_type = other DNA
ctcgccggtcgagggtctgg

SEQ ID NO: 2539 - DNA, 20 bp, synthetic construct
  misc_feature 1..20: note = CRISPR gRNA sequence
  source 1..20: mol_type = other DNA
ggtcccgcggcctcagggag

SEQ ID NO: 2540 - DNA, 20 bp, synthetic construct
  misc_feature 1..20: note = CRISPR gRNA sequence
  source 1..20: mol_type = other DNA
ggcgacccgggccgtacgtg

SEQ ID NO: 2541 - DNA, 20 bp, synthetic construct
  misc_feature 1..20: note = CRISPR gRNA sequence
  source 1..20: mol_type = other DNA
cgggccgtacgtgggggatg

SEQ ID NO: 2542 - DNA, 20 bp, synthetic construct
  misc_feature 1..20: note = CRISPR gRNA sequence
  source 1..20: mol_type = other DNA
tcgtgacctgcgccccgggc

SEQ ID NO: 2543 - DNA, 20 bp, synthetic construct
  misc_feature 1..20: note = CRISPR gRNA sequence
  source 1..20: mol_type = other DNA
tcgctgtcgaacctcacgaa

SEQ ID NO: 2544 - DNA, 20 bp, synthetic construct
  misc_feature 1..20: note = CRISPR gRNA sequence
  source 1..20: mol_type = other DNA
ggaggtgtagaaatacctca

SEQ ID NO: 2545 - DNA, 20 bp, synthetic construct
  misc_feature 1..20: note = CRISPR gRNA sequence
  source 1..20: mol_type = other DNA
acctcatggagtgggagcct

SEQ ID NO: 2546 - DNA, 20 bp, synthetic construct
  misc_feature 1..20: note = CRISPR gRNA sequence
  source 1..20: mol_type = other DNA
tctcggcgtctgaggagact

SEQ ID NO: 2547 - DNA, 20 bp, synthetic construct
  misc_feature 1..20: note = CRISPR gRNA sequence
  source 1..20: mol_type = other DNA
cgtctgaggagactctgagt

SEQ ID NO: 2548 - DNA, 20 bp, synthetic construct
  misc_feature 1..20: note = CRISPR gRNA sequence
  source 1..20: mol_type = other DNA
tgaggagactctgagtccgg

SEQ ID NO: 2549 - DNA, 20 bp, synthetic construct
  misc_feature 1..20: note = CRISPR gRNA sequence
  source 1..20: mol_type = other DNA
cccacgcacccacccggact

SEQ ID NO: 2550 - DNA, 20 bp, synthetic construct
  misc_feature 1..20: note = CRISPR gRNA sequence
  source 1..20: mol_type = other DNA
cctgaccgagacctgggccg

SEQ ID NO: 2551 - DNA, 20 bp, synthetic construct
  misc_feature 1..20: note = CRISPR gRNA sequence
  source 1..20: mol_type = other DNA
cgagacctgggccggtgagt

SEQ ID NO: 2552 - DNA, 20 bp, synthetic construct
  misc_feature 1..20: note = CRISPR gRNA sequence
  source 1..20: mol_type = other DNA
ctgaggagccgcgccgggag

SEQ ID NO: 2553 - DNA, 20 bp, synthetic construct
  misc_feature 1..20: note = CRISPR gRNA sequence
  source 1..20: mol_type = other DNA
cgcgccgggaggagggtcgg

SEQ ID NO: 2554 - DNA, 20 bp, synthetic construct
  misc_feature 1..20: note = CRISPR gRNA sequence
  source 1..20: mol_type = other DNA
tgaggttcgacagcgacgcc

SEQ ID NO: 2555 - DNA, 20 bp, synthetic construct
  misc_feature 1..20: note = CRISPR gRNA sequence
  source 1..20: mol_type = other DNA
agagaggagccgcgggcgcc

SEQ ID NO: 2556 - DNA, 20 bp, synthetic construct
  misc_feature 1..20: note = CRISPR gRNA sequence
  source 1..20: mol_type = other DNA
gtggatagagcaggaggggc

SEQ ID NO: 2557 - DNA, 20 bp, synthetic construct
  misc_feature 1..20: note = CRISPR gRNA sequence
  source 1..20: mol_type = other DNA
ctacaaccagagcgaggccg

SEQ ID NO: 2558 - DNA, 20 bp, synthetic construct
  misc_feature 1..20: note = CRISPR gRNA sequence
  source 1..20: mol_type = other DNA
ccccatcccccacgtacggc

SEQ ID NO: 2559 - DNA, 20 bp, synthetic construct
  misc_feature 1..20: note = CRISPR gRNA sequence
  source 1..20: mol_type = other DNA
cacgtacggcccgggtcgcc

SEQ ID NO: 2560 - DNA, 20 bp, synthetic construct
  misc_feature 1..20: note = CRISPR gRNA sequence
  source 1..20: mol_type = other DNA
gcccgggtcgccccgagtct

SEQ ID NO: 2561 - DNA, 20 bp, synthetic construct
  misc_feature 1..20: note = CRISPR gRNA sequence
  source 1..20: mol_type = other DNA
cagttgaggccaaaatcccc

SEQ ID NO: 2562 - DNA, 20 bp, synthetic construct
  misc_feature 1..20: note = CRISPR gRNA sequence
  source 1..20: mol_type = other DNA
gctgaccgcggggccggggc

SEQ ID NO: 2563 - DNA, 20 bp, synthetic construct
  misc_feature 1..20: note = CRISPR gRNA sequence
  source 1..20: mol_type = other DNA
accagtacgcctacgacggc

SEQ ID NO: 2564 - DNA, 20 bp, synthetic construct
  misc_feature 1..20: note = CRISPR gRNA sequence
  source 1..20: mol_type = other DNA
gcggagagcctacctggagg

SEQ ID NO: 2565 - DNA, 20 bp, synthetic construct
  misc_feature 1..20: note = CRISPR gRNA sequence
  source 1..20: mol_type = other DNA
ctacctggagggcgagtgcg

SEQ ID NO: 2566 - DNA, 20 bp, synthetic construct
  misc_feature 1..20: note = CRISPR gRNA sequence
  source 1..20: mol_type = other DNA
cccatctcctataggtcgcc

SEQ ID NO: 2567 - DNA, 20 bp, synthetic construct
  misc_feature 1..20: note = CRISPR gRNA sequence
  source 1..20: mol_type = other DNA
ccacgagaagaggaggaaaa

SEQ ID NO: 2568 - DNA, 20 bp, synthetic construct
  misc_feature 1..20: note = CRISPR gRNA sequence
  source 1..20: mol_type = other DNA
gaggaaaatgggatcagcgc

SEQ ID NO: 2569 - DNA, 20 bp, synthetic construct
  misc_feature 1..20: note = CRISPR gRNA sequence
  source 1..20: mol_type = other DNA
cgctagaatgtcgccctccg

SEQ ID NO: 2570 - DNA, 20 bp, synthetic construct
  misc_feature 1..20: note = CRISPR gRNA sequence
  source 1..20: mol_type = other DNA
atgtcgccctccgttgaatg

SEQ ID NO: 2571 - DNA, 20 bp, synthetic construct
  misc_feature 1..20: note = CRISPR gRNA sequence
  source 1..20: mol_type = other DNA
tccgttgaatggagaatggc

SEQ ID NO: 2572 - DNA, 20 bp, synthetic construct
  misc_feature 1..20: note = CRISPR gRNA sequence
  source 1..20: mol_type = other DNA
ggagaatggcatgagttttc

SEQ ID NO: 2573 - DNA, 20 bp, synthetic construct
  misc_feature 1..20: note = CRISPR gRNA sequence
  source 1..20: mol_type = other DNA
ctcttctctctagacaatta

SEQ ID NO: 2574 - DNA, 20 bp, synthetic construct
  misc_feature 1..20: note = CRISPR gRNA sequence
  source 1..20: mol_type = other DNA
atggaggggaagacagtccc

SEQ ID NO: 2575 - DNA, 20 bp, synthetic construct
  misc_feature 1..20: note = CRISPR gRNA sequence
  source 1..20: mol_type = other DNA
cagtccctagaatactgatc

SEQ ID NO: 2576 - DNA, 20 bp, synthetic construct
  misc_feature 1..20: note = CRISPR gRNA sequence
  source 1..20: mol_type = other DNA
gggctctgattccagcactt

SEQ ID NO: 2577 - DNA, 20 bp, synthetic construct
  misc_feature 1..20: note = CRISPR gRNA sequence
  source 1..20: mol_type = other DNA
tcagagactcgaactttcca

SEQ ID NO: 2578 - DNA, 20 bp, synthetic construct
  misc_feature 1..20: note = CRISPR gRNA sequence
  source 1..20: mol_type = other DNA
gcctgcgtccaggctggtgt

SEQ ID NO: 2579 - DNA, 20 bp, synthetic construct
  misc_feature 1..20: note = CRISPR gRNA sequence
  source 1..20: mol_type = other DNA
tccattctcaggctggtcac

SEQ ID NO: 2580 - DNA, 20 bp, synthetic construct
  misc_feature 1..20: note = CRISPR gRNA sequence
  source 1..20: mol_type = other DNA
gctggtcacatgggtggtcc

SEQ ID NO: 2581 - DNA, 20 bp, synthetic construct
  misc_feature 1..20: note = CRISPR gRNA sequence
  source 1..20: mol_type = other DNA
ccatgaaagatgcaaagcgc

SEQ ID NO: 2582 - DNA, 20 bp, synthetic construct
  misc_feature 1..20: note = CRISPR gRNA sequence
  source 1..20: mol_type = other DNA
ccaccctgaggtgctgggcc

SEQ ID NO: 2583 - DNA, 20 bp, synthetic construct
  misc_feature 1..20: note = CRISPR gRNA sequence
  source 1..20: mol_type = other DNA
agatcacactgacctggcag

SEQ ID NO: 2584 - DNA, 20 bp, synthetic construct
  misc_feature 1..20: note = CRISPR gRNA sequence
  source 1..20: mol_type = other DNA
cgaagcccctcaccctgaga

SEQ ID NO: 2585 - DNA, 20 bp, synthetic construct
  misc_feature 1..20: note = CRISPR gRNA sequence
  source 1..20: mol_type = other DNA
ccctgagatggggtaaggag

SEQ ID NO: 2586 - DNA, 20 bp, synthetic construct
  misc_feature 1..20: note = CRISPR gRNA sequence
  source 1..20: mol_type = other DNA
atggggtaaggagggggatg

SEQ ID NO: 2587 - DNA, 20 bp, synthetic construct
  misc_feature 1..20: note = CRISPR gRNA sequence
  source 1..20: mol_type = other DNA
ggaaagcaggagcccttcag

SEQ ID NO: 2588 - DNA, 20 bp, synthetic construct
  misc_feature 1..20: note = CRISPR gRNA sequence
  source 1..20: mol_type = other DNA
ctgctgtgatgtgtaggagg

SEQ ID NO: 2589 - DNA, 20 bp, synthetic construct
  misc_feature 1..20: note = CRISPR gRNA sequence
  source 1..20: mol_type = other DNA
aggaagagttcaggtaggga

SEQ ID NO: 2590 - DNA, 20 bp, synthetic construct
  misc_feature 1..20: note = CRISPR gRNA sequence
  source 1..20: mol_type = other DNA
gttcaggtagggaaggggtg

SEQ ID NO: 2591 - DNA, 20 bp, synthetic construct
  misc_feature 1..20: note = CRISPR gRNA sequence
  source 1..20: mol_type = other DNA
ggtagggaaggggtgagggg

SEQ ID NO: 2592 - DNA, 20 bp, synthetic construct
  misc_feature 1..20: note = CRISPR gRNA sequence
  source 1..20: mol_type = other DNA
gaaggggtgaggggtggggt

SEQ ID NO: 2593 - DNA, 20 bp, synthetic construct
  misc_feature 1..20: note = CRISPR gRNA sequence
  source 1..20: mol_type = other DNA
ctgggttttcttgtcccact

SEQ ID NO: 2594 - DNA, 20 bp, synthetic construct
  misc_feature 1..20: note = CRISPR gRNA sequence
  source 1..20: mol_type = other DNA
gtgcagcacatgtgacaatg

SEQ ID NO: 2595 - DNA, 20 bp, synthetic construct
  misc_feature 1..20: note = CRISPR gRNA sequence
  source 1..20: mol_type = other DNA
agcacatgtgacaatgaagg

SEQ ID NO: 2596 - DNA, 20 bp, synthetic construct
  misc_feature 1..20: note = CRISPR gRNA sequence
  source 1..20: mol_type = other DNA
caccttgatggttgtggtgt

SEQ ID NO: 2597 - DNA, 20 bp, synthetic construct
  misc_feature 1..20: note = CRISPR gRNA sequence
  source 1..20: mol_type = other DNA
gggtcctgattccagcattc

SEQ ID NO: 2598 - DNA, 20 bp, synthetic construct
  misc_feature 1..20: note = CRISPR gRNA sequence
  source 1..20: mol_type = other DNA
tcgtgtttcctgatcctgcc

SEQ ID NO: 2599 - DNA, 20 bp, synthetic construct
  misc_feature 1..20: note = CRISPR gRNA sequence
  source 1..20: mol_type = other DNA
catacttctggaaattcctt

SEQ ID NO: 2600 - DNA, 20 bp, synthetic construct
  misc_feature 1..20: note = CRISPR gRNA sequence
  source 1..20: mol_type = other DNA
tcaggctgcgtgtaagtggt

SEQ ID NO: 2601 - DNA, 20 bp, synthetic construct
  misc_feature 1..20: note = CRISPR gRNA sequence
  source 1..20: mol_type = other DNA
tgcgtgtaagtggtgggggt

SEQ ID NO: 2602 - DNA, 20 bp, synthetic construct
  misc_feature 1..20: note = CRISPR gRNA sequence
  source 1..20: mol_type = other DNA
gcttgaaaaggtgagattct

SEQ ID NO: 2603 - DNA, 20 bp, synthetic construct
  misc_feature 1..20: note = CRISPR gRNA sequence
  source 1..20: mol_type = other DNA
aaggtgagattcttggggtc

SEQ ID NO: 2604 - DNA, 20 bp, synthetic construct
  misc_feature 1..20: note = CRISPR gRNA sequence
  source 1..20: mol_type = other DNA
tgagattcttggggtctaga

SEQ ID NO: 2605 - DNA, 20 bp, synthetic construct
  misc_feature 1..20: note = CRISPR gRNA sequence
  source 1..20: mol_type = other DNA
ttcttggggtctagagtggg

SEQ ID NO: 2606 - DNA, 20 bp, synthetic construct
  misc_feature 1..20: note = CRISPR gRNA sequence
  source 1..20: mol_type = other DNA
ggtctagagtgggtggggtg

SEQ ID NO: 2607 - DNA, 20 bp, synthetic construct
  misc_feature 1..20: note = CRISPR gRNA sequence
  source 1..20: mol_type = other DNA
gtgggtggggtggcgggtct

SEQ ID NO: 2608 - DNA, 20 bp, synthetic construct
  misc_feature 1..20: note = CRISPR gRNA sequence
  source 1..20: mol_type = other DNA
gtggggtggcgggtctgggg

SEQ ID NO: 2609 - DNA, 20 bp, synthetic construct
  misc_feature 1..20: note = CRISPR gRNA sequence
  source 1..20: mol_type = other DNA
gtggggcagaggggaaaggc

SEQ ID NO: 2610 - DNA, 20 bp, synthetic construct
  misc_feature 1..20: note = CRISPR gRNA sequence
  source 1..20: mol_type = other DNA
aggggaaaggcctgggtaat

SEQ ID NO: 2611 - DNA, 20 bp, synthetic construct
  misc_feature 1..20: note = CRISPR gRNA sequence
  source 1..20: mol_type = other DNA
tgcgttagcccctgtgtgca

SEQ ID NO: 2612 - DNA, 20 bp, synthetic construct
  misc_feature 1..20: note = CRISPR gRNA sequence
  source 1..20: mol_type = other DNA
aggcagggaacacttctacc

SEQ ID NO: 2613 - DNA, 20 bp, synthetic construct
  misc_feature 1..20: note = CRISPR gRNA sequence
  source 1..20: mol_type = other DNA
ccctgaccctgctgaagggc

SEQ ID NO: 2614 - DNA, 20 bp, synthetic construct
  misc_feature 1..20: note = CRISPR gRNA sequence
  source 1..20: mol_type = other DNA
ccttaccccatctcagggtg

SEQ ID NO: 2615 - DNA, 20 bp, synthetic construct
  misc_feature 1..20: note = CRISPR gRNA sequence
  source 1..20: mol_type = other DNA
gtctccacaagctcagtgtc

SEQ ID NO: 2616 - DNA, 20 bp, synthetic construct
  misc_feature 1..20: note = CRISPR gRNA sequence
  source 1..20: mol_type = other DNA
tgggaagagtcagaaaattc

SEQ ID NO: 2617 - DNA, 20 bp, synthetic construct
  misc_feature 1..20: note = CRISPR gRNA sequence
  source 1..20: mol_type = other DNA
tgcccctggtaccagcgcgc

SEQ ID NO: 2618 - DNA, 20 bp, synthetic construct
  misc_feature 1..20: note = CRISPR gRNA sequence
  source 1..20: mol_type = other DNA
gccccgccccgaccaacccg

SEQ ID NO: 2619 - DNA, 20 bp, synthetic construct
  misc_feature 1..20: note = CRISPR gRNA sequence
  source 1..20: mol_type = other DNA
tagaactgggaccgcggcga

SEQ ID NO: 2620 - DNA, 20 bp, synthetic construct
  misc_feature 1..20: note = CRISPR gRNA sequence
  source 1..20: mol_type = other DNA
ctgggaccgcggcgacgctg

SEQ ID NO: 2621 - DNA, 20 bp, synthetic construct
  misc_feature 1..20: note = CRISPR gRNA sequence
  source 1..20: mol_type = other DNA
cccggcccggccgcggggag

SEQ ID NO: 2622 - DNA, 20 bp, synthetic construct
  misc_feature 1..20: note = CRISPR gRNA sequence
  source 1..20: mol_type = other DNA
tcgaccggcgagagccccag

SEQ ID NO: 2623 - DNA, 20 bp, synthetic construct
  misc_feature 1..20: note = CRISPR gRNA sequence
  source 1..20: mol_type = other DNA
gagagccccaggcgcgttta

SEQ ID NO: 2624 - DNA, 20 bp, synthetic construct
  misc_feature 1..20: note = CRISPR gRNA sequence
  source 1..20: mol_type = other DNA
gaccagtacgcctacgacgg

SEQ ID NO: 2625 - DNA, 20 bp, synthetic construct
  misc_feature 1..20: note = CRISPR gRNA sequence
  source 1..20: mol_type = other DNA
tccgttgaatggagaatggc

SEQ ID NO: 2626 - DNA, 20 bp, synthetic construct
  misc_feature 1..20: note = CRISPR gRNA sequence
  source 1..20: mol_type = other DNA
ggagaatggcatgagttttc

SEQ ID NO: 2627 - DNA, 20 bp, synthetic construct
  misc_feature 1..20: note = CRISPR gRNA sequence
  source 1..20: mol_type = other DNA
tgttctctgcctcacactca

SEQ ID NO: 2628 - DNA, 20 bp, synthetic construct
  misc_feature 1..20: note = CRISPR gRNA sequence
  source 1..20: mol_type = other DNA
cacactcagtgtgtttgggg

SEQ ID NO: 2629 - DNA, 20 bp, synthetic construct
  misc_feature 1..20: note = CRISPR gRNA sequence
  source 1..20: mol_type = other DNA
actcgaactttccaatgaat

SEQ ID NO: 2630 - DNA, 20 bp, synthetic construct
  misc_feature 1..20: note = CRISPR gRNA sequence
  source 1..20: mol_type = other DNA
ccaccctgaggtgctgggcc

SEQ ID NO: 2631 - DNA, 20 bp, synthetic construct
  misc_feature 1..20: note = CRISPR gRNA sequence
  source 1..20: mol_type = other DNA
cgaggaccaaactcaggaca

SEQ ID NO: 2632 - DNA, 20 bp, synthetic construct
  misc_feature 1..20: note = CRISPR gRNA sequence
  source 1..20: mol_type = other DNA
gaaggggtgaggggtggggt

SEQ ID NO: 2633 - DNA, 20 bp, synthetic construct
  misc_feature 1..20: note = CRISPR gRNA sequence
  source 1..20: mol_type = other DNA
ctgggttttcttgtcccact

SEQ ID NO: 2634 - DNA, 20 bp, synthetic construct
  misc_feature 1..20: note = CRISPR gRNA sequence
  source 1..20: mol_type = other DNA
tgatggttgtggtgttgggg

SEQ ID NO: 2635 - DNA, 20 bp, synthetic construct
  misc_feature 1..20: note = CRISPR gRNA sequence
  source 1..20: mol_type = other DNA
gcagttggtccaggacccac

SEQ ID NO: 2636 - DNA, 20 bp, synthetic construct
  misc_feature 1..20: note = CRISPR gRNA sequence
  source 1..20: mol_type = other DNA
aggacccacacttgctttcc

SEQ ID NO: 2637 - DNA, 20 bp, synthetic construct
  misc_feature 1..20: note = CRISPR gRNA sequence
  source 1..20: mol_type = other DNA
gttcctctaagatctcatgg

SEQ ID NO: 2638 - DNA, 20 bp, synthetic construct
  misc_feature 1..20: note = CRISPR gRNA sequence
  source 1..20: mol_type = other DNA
tcctgcgggctctgaccagg

SEQ ID NO: 2639 - DNA, 20 bp, synthetic construct
  misc_feature 1..20: note = CRISPR gRNA sequence
  source 1..20: mol_type = other DNA
cagggctctgatgtgtctct

SEQ ID NO: 2640 - DNA, 20 bp, synthetic construct
  misc_feature 1..20: note = CRISPR gRNA sequence
  source 1..20: mol_type = other DNA
gtctctcacagcttgaaaag

SEQ ID NO: 2641 - DNA, 20 bp, synthetic construct
  misc_feature 1..20: note = CRISPR gRNA sequence
  source 1..20: mol_type = other DNA
gaggggaaaggcctgggtaa

SEQ ID NO: 2642 - DNA, 20 bp, synthetic construct
  misc_feature 1..20: note = CRISPR gRNA sequence
  source 1..20: mol_type = other DNA
aggcctgggtaatggggatt

SEQ ID NO: 2643 - DNA, 20 bp, synthetic construct
  misc_feature 1..20: note = CRISPR gRNA sequence
  source 1..20: mol_type = other DNA
accccacccactctagaccc

SEQ ID NO: 2644 - DNA, 20 bp, synthetic construct
  misc_feature 1..20: note = CRISPR gRNA sequence
  source 1..20: mol_type = other DNA
ccctccttttccacctgtgg

SEQ ID NO: 2645 - DNA, 20 bp, synthetic construct
  misc_feature 1..20: note = CRISPR gRNA sequence
  source 1..20: mol_type = other DNA
gcttgaaacccccagtggga

SEQ ID NO: 2646 - DNA, 20 bp, synthetic construct
  misc_feature 1..20: note = CRISPR gRNA sequence
  source 1..20: mol_type = other DNA
gtcagtgtgatctccgcagg

SEQ ID NO: 2647 - DNA, 20 bp, synthetic construct
  misc_feature 1..20: note = CRISPR gRNA sequence
  source 1..20: mol_type = other DNA
ggggggtctgatgggaagag

SEQ ID NO: 2648 - DNA, 20 bp, synthetic construct
  misc_feature 1..20: note = CRISPR gRNA sequence
  source 1..20: mol_type = other DNA
gaccacccatgtgaccagcc

SEQ ID NO: 2649 - DNA, 20 bp, synthetic construct
  misc_feature 1..20: note = CRISPR gRNA sequence
  source 1..20: mol_type = other DNA
ccgggccgggacacggaggt

SEQ ID NO: 2650 - DNA, 20 bp, synthetic construct
  misc_feature 1..20: note = CRISPR gRNA sequence
  source 1..20: mol_type = other DNA
ggaggaaaatgggatcagcg

SEQ ID NO: 2651 - DNA, 20 bp, synthetic construct
  misc_feature 1..20: note = CRISPR gRNA sequence
  source 1..20: mol_type = other DNA
aatgtcgccctccgttgaat

SEQ ID NO: 2652 - DNA, 20 bp, synthetic construct
  misc_feature 1..20: note = CRISPR gRNA sequence
  source 1..20: mol_type = other DNA
aatggaggggaagacagtcc

SEQ ID NO: 2653 - DNA, 20 bp, synthetic construct
  misc_feature 1..20: note = CRISPR gRNA sequence
  source 1..20: mol_type = other DNA
gtcgctgcctggagtagaac

SEQ ID NO: 2654 - DNA, 20 bp, synthetic construct
  misc_feature 1..20: note = CRISPR gRNA sequence
  source 1..20: mol_type = other DNA
tgaaacccccagtgggacaa

SEQ ID NO: 2655 - DNA, 20 bp, synthetic construct
  misc_feature 1..20: note = CRISPR gRNA sequence
  source 1..20: mol_type = other DNA
ggccctcagaggaaactcag

SEQ ID NO: 2656 - DNA, 20 bp, synthetic construct
  misc_feature 1..20: note = CRISPR gRNA sequence
  source 1..20: mol_type = other DNA
cccaggcctttcccctctgc

SEQ ID NO: 2657 - DNA, 20 bp, synthetic construct
  misc_feature 1..20: note = CRISPR gRNA sequence
  source 1..20: mol_type = other DNA
tcccctctgccccacccacc

SEQ ID NO: 2658 - DNA, 20 bp, synthetic construct
  misc_feature 1..20: note = CRISPR gRNA sequence
  source 1..20: mol_type = other DNA
cccctctgccccacccaccc

SEQ ID NO: 2659 - DNA, 20 bp, synthetic construct
  misc_feature 1..20: note = CRISPR gRNA sequence
  source 1..20: mol_type = other DNA
ccctctgccccacccacccc

SEQ ID NO: 2660 - DNA, 20 bp, synthetic construct
  misc_feature 1..20: note = CRISPR gRNA sequence
  source 1..20: mol_type = other DNA
tgccccacccacccccagac

SEQ ID NO: 2661 - DNA, 20 bp, synthetic construct
  misc_feature 1..20: note = CRISPR gRNA sequence
  source 1..20: mol_type = other DNA
ccccacccacccccagaccc

SEQ ID NO: 2662 - DNA, 20 bp, synthetic construct
  misc_feature 1..20: note = CRISPR gRNA sequence
  source 1..20: mol_type = other DNA
tagaccccaagaatctcacc

SEQ ID NO: 2663 - DNA, 20 bp, synthetic construct
  misc_feature 1..20: note = CRISPR gRNA sequence
  source 1..20: mol_type = other DNA
gaccccaagaatctcacctt

SEQ ID NO: 2664 - DNA, 20 bp, synthetic construct
  misc_feature 1..20: note = CRISPR gRNA sequence
  source 1..20: mol_type = other DNA
accttttcaagctgtgagag

SEQ ID NO: 2665 - DNA, 20 bp, synthetic construct
  misc_feature 1..20: note = CRISPR gRNA sequence
  source 1..20: mol_type = other DNA
ttcaagctgtgagagacaca

SEQ ID NO: 2666 - DNA, 20 bp, synthetic construct
  misc_feature 1..20: note = CRISPR gRNA sequence
  source 1..20: mol_type = other DNA
tcaagctgtgagagacacat

SEQ ID NO: 2667 - DNA, 20 bp, synthetic construct
  misc_feature 1..20: note = CRISPR gRNA sequence
  source 1..20: mol_type = other DNA
caagctgtgagagacacatc

SEQ ID NO: 2668 - DNA, 20 bp, synthetic construct
  misc_feature 1..20: note = CRISPR gRNA sequence
  source 1..20: mol_type = other DNA
aagctgtgagagacacatca

SEQ ID NO: 2669 - DNA, 20 bp, synthetic construct
  misc_feature 1..20: note = CRISPR gRNA sequence
  source 1..20: mol_type = other DNA
tgagagacacatcagagccc

SEQ ID NO: 2670 - DNA, 20 bp, synthetic construct
  misc_feature 1..20: note = CRISPR gRNA sequence
  source 1..20: mol_type = other DNA
ggcactgtcgctgcctggag

SEQ ID NO: 2671 - DNA, 20 bp, synthetic construct
  misc_feature 1..20: note = CRISPR gRNA sequence
  source 1..20: mol_type = other DNA
tcgctgcctggagtagaaca

SEQ ID NO: 2672 - DNA, 20 bp, synthetic construct
  misc_feature 1..20: note = CRISPR gRNA sequence
  source 1..20: mol_type = other DNA
cctggagtagaacaaaaaca

SEQ ID NO: 2673 - DNA, 20 bp, synthetic construct
  misc_feature 1..20: note = CRISPR gRNA sequence
  source 1..20: mol_type = other DNA
gagtagaacaaaaacaggac

SEQ ID NO: 2674 - DNA, 20 bp, synthetic construct
  misc_feature 1..20: note = CRISPR gRNA sequence
  source 1..20: mol_type = other DNA
gtcagagcccgcaggagacg

SEQ ID NO: 2675 - DNA, 20 bp, synthetic construct
  misc_feature 1..20: note = CRISPR gRNA sequence
  source 1..20: mol_type = other DNA
tggggtgggtgagctcctcc

SEQ ID NO: 2676 - DNA, 20 bp, synthetic construct
  misc_feature 1..20: note = CRISPR gRNA sequence
  source 1..20: mol_type = other DNA
ctccacactcccacccccac

SEQ ID NO: 2677 - DNA, 20 bp, synthetic construct
  misc_feature 1..20: note = CRISPR gRNA sequence
  source 1..20: mol_type = other DNA
cacactcccacccccaccac

SEQ ID NO: 2678 - DNA, 20 bp, synthetic construct
  misc_feature 1..20: note = CRISPR gRNA sequence
  source 1..20: mol_type = other DNA
ccacccccaccacttacacg

SEQ ID NO: 2679 - DNA, 20 bp, synthetic construct
  misc_feature 1..20: note = CRISPR gRNA sequence
  source 1..20: mol_type = other DNA
acacgcagcctgagagtagc

SEQ ID NO: 2680 - DNA, 20 bp, synthetic construct
  misc_feature 1..20: note = CRISPR gRNA sequence
  source 1..20: mol_type = other DNA
cacgcagcctgagagtagct

SEQ ID NO: 2681 - DNA, 20 bp, synthetic construct
  misc_feature 1..20: note = CRISPR gRNA sequence
  source 1..20: mol_type = other DNA
agagtagctccctccttttc

SEQ ID NO: 2682 - DNA, 20 bp, synthetic construct
  misc_feature 1..20: note = CRISPR gRNA sequence
  source 1..20: mol_type = other DNA
cctccttttccacctgtggg

SEQ ID NO: 2683 - DNA, 20 bp, synthetic construct
  misc_feature 1..20: note = CRISPR gRNA sequence
  source 1..20: mol_type = other DNA
cttttccacctgtgggaaga

SEQ ID NO: 2684 - DNA, 20 bp, synthetic construct
  misc_feature 1..20: note = CRISPR gRNA sequence
  source 1..20: mol_type = other DNA
ttccacctgtgggaagaaaa

SEQ ID NO: 2685 - DNA, 20 bp, synthetic construct
  misc_feature 1..20: note = CRISPR gRNA sequence
  source 1..20: mol_type = other DNA
tccacctgtgggaagaaaat

SEQ ID NO: 2686 - DNA, 20 bp, synthetic construct
  misc_feature 1..20: note = CRISPR gRNA sequence
  source 1..20: mol_type = other DNA
ccacctgtgggaagaaaatg

SEQ ID NO: 2687 - DNA, 20 bp, synthetic construct
  misc_feature 1..20: note = CRISPR gRNA sequence
  source 1..20: mol_type = other DNA
cacctgtgggaagaaaatgt

SEQ ID NO: 2688 - DNA, 20 bp, synthetic construct
  misc_feature 1..20: note = CRISPR gRNA sequence
  source 1..20: mol_type = other DNA
tgggaagaaaatgtcctgtg

SEQ ID NO: 2689 - DNA, 20 bp, synthetic construct
  misc_feature 1..20: note = CRISPR gRNA sequence
  source 1..20: mol_type = other DNA
tgagggcactgggaggaagc

SEQ ID NO: 2690 - DNA, 20 bp, synthetic construct
  misc_feature 1..20: note = CRISPR gRNA sequence
  source 1..20: mol_type = other DNA
ggaggaagcagggccatgag

SEQ ID NO: 2691 - DNA, 20 bp, synthetic construct
  misc_feature 1..20: note = CRISPR gRNA sequence
  source 1..20: mol_type = other DNA
agaggaacctcctagtcttg

SEQ ID NO: 2692 - DNA, 20 bp, synthetic construct
  misc_feature 1..20: note = CRISPR gRNA sequence
  source 1..20: mol_type = other DNA
gaggaacctcctagtcttgg

SEQ ID NO: 2693 - DNA, 20 bp, synthetic construct
  misc_feature 1..20: note = CRISPR gRNA sequence
  source 1..20: mol_type = other DNA
ctagtcttggacccaaaagg

SEQ ID NO: 2694 - DNA, 20 bp, synthetic construct
  misc_feature 1..20: note = CRISPR gRNA sequence
  source 1..20: mol_type = other DNA
gtcttggacccaaaaggaat

SEQ ID NO: 2695 - DNA, 20 bp, synthetic construct
  misc_feature 1..20: note = CRISPR gRNA sequence
  source 1..20: mol_type = other DNA
ggacccaaaaggaatttcca

SEQ ID NO: 2696 - DNA, 20 bp, synthetic construct
  misc_feature 1..20: note = CRISPR gRNA sequence
  source 1..20: mol_type = other DNA
gacccaaaaggaatttccag

SEQ ID NO: 2697 - DNA, 20 bp, synthetic construct
  misc_feature 1..20: note = CRISPR gRNA sequence
  source 1..20: mol_type = other DNA
ccagaagtatgactacagac

SEQ ID NO: 2698 - DNA, 20 bp, synthetic construct
  misc_feature 1..20: note = CRISPR gRNA sequence
  source 1..20: mol_type = other DNA
cagaagtatgactacagacc

SEQ ID NO: 2699 - DNA, 20 bp, synthetic construct
  misc_feature 1..20: note = CRISPR gRNA sequence
  source 1..20: mol_type = other DNA
cagacccagggcaggatcag

SEQ ID NO: 2700 - DNA, 20 bp, synthetic construct
  misc_feature 1..20: note = CRISPR gRNA sequence
  source 1..20: mol_type = other DNA
gaccaactgccctcctaagg

SEQ ID NO: 2701 - DNA, 20 bp, synthetic construct
  misc_feature 1..20: note = CRISPR gRNA sequence
  source 1..20: mol_type = other DNA
ccctcctaaggtctgtcctt

SEQ ID NO: 2702 - DNA, 20 bp, synthetic construct
  misc_feature 1..20: note = CRISPR gRNA sequence
  source 1..20: mol_type = other DNA
ctaaggtctgtccttagcag

SEQ ID NO: 2703 - DNA, 20 bp, synthetic construct
  misc_feature 1..20: note = CRISPR gRNA sequence
  source 1..20: mol_type = other DNA
aggtctgtccttagcaggga

SEQ ID NO: 2704 - DNA, 20 bp, synthetic construct
  misc_feature 1..20: note = CRISPR gRNA sequence
  source 1..20: mol_type = other DNA
tccttagcagggaccttccc

SEQ ID NO: 2705 - DNA, 20 bp, synthetic construct
  misc_feature 1..20: note = CRISPR gRNA sequence
  source 1..20: mol_type = other DNA
agcagggaccttcccctgac

SEQ ID NO: 2706 - DNA, 20 bp, synthetic construct
  misc_feature 1..20: note = CRISPR gRNA sequence
  source 1..20: mol_type = other DNA
gcagggaccttcccctgact

SEQ ID NO: 2707 - DNA, 20 bp, synthetic construct
  misc_feature 1..20: note = CRISPR gRNA sequence
  source 1..20: mol_type = other DNA
cccctgactcatgaatgctg

SEQ ID NO: 2708 - DNA, 20 bp, synthetic construct
  misc_feature 1..20: note = CRISPR gRNA sequence
  source 1..20: mol_type = other DNA
ccctgactcatgaatgctgg

SEQ ID NO: 2709 - DNA, 20 bp, synthetic construct
  misc_feature 1..20: note = CRISPR gRNA sequence
  source 1..20: mol_type = other DNA
actcatgaatgctggaatca

SEQ ID NO: 2710 - DNA, 20 bp, synthetic construct
  misc_feature 1..20: note = CRISPR gRNA sequence
  source 1..20: mol_type = other DNA
atgaatgctggaatcaggac

SEQ ID NO: 2711 - DNA, 20 bp, synthetic construct
  misc_feature 1..20: note = CRISPR gRNA sequence
  source 1..20: mol_type = other DNA
gaatcaggaccccaacacca

SEQ ID NO: 2712 - DNA, 20 bp, synthetic construct
  misc_feature 1..20: note = CRISPR gRNA sequence
  source 1..20: mol_type = other DNA
cattgtcacatgtgctgcac

SEQ ID NO: 2713 - DNA, 20 bp, synthetic construct
  misc_feature 1..20: note = CRISPR gRNA sequence
  source 1..20: mol_type = other DNA
attgtcacatgtgctgcaca

SEQ ID NO: 2714 - DNA, 20 bp, synthetic construct
  misc_feature 1..20: note = CRISPR gRNA sequence
  source 1..20: mol_type = other DNA
tcacatgtgctgcacaaaag

SEQ ID NO: 2715 - DNA, 20 bp, synthetic construct
  misc_feature 1..20: note = CRISPR gRNA sequence
  source 1..20: mol_type = other DNA
cacaaaagagtaagtgctgg

SEQ ID NO: 2716 - DNA, 20 bp, synthetic construct
  misc_feature 1..20: note = CRISPR gRNA sequence
  source 1..20: mol_type = other DNA
gcacacagggtcccaggctg

SEQ ID NO: 2717 - DNA, 20 bp, synthetic construct
  misc_feature 1..20: note = CRISPR gRNA sequence
  source 1..20: mol_type = other DNA
cgttagcccctgtgtgcatg

SEQ ID NO: 2718 - DNA, 20 bp, synthetic construct
  misc_feature 1..20: note = CRISPR gRNA sequence
  source 1..20: mol_type = other DNA
gcccctgtgtgcatgctgct

SEQ ID NO: 2719 - DNA, 20 bp, synthetic construct
  misc_feature 1..20: note = CRISPR gRNA sequence
  source 1..20: mol_type = other DNA
tgtgcatgctgcttcccagt

SEQ ID NO: 2720 - DNA, 20 bp, synthetic construct
  misc_feature 1..20: note = CRISPR gRNA sequence
  source 1..20: mol_type = other DNA
cttcccagtaatgaggcagg

SEQ ID NO: 2721 - DNA, 20 bp, synthetic construct
  misc_feature 1..20: note = CRISPR gRNA sequence
  source 1..20: mol_type = other DNA
cccagtaatgaggcagggaa

SEQ ID NO: 2722 - DNA, 20 bp, synthetic construct
  misc_feature 1..20: note = CRISPR gRNA sequence
  source 1..20: mol_type = other DNA
ccagtaatgaggcagggaac

SEQ ID NO: 2723 - DNA, 20 bp, synthetic construct
  misc_feature 1..20: note = CRISPR gRNA sequence
  source 1..20: mol_type = other DNA
ctacctggggcttgaaaccc

SEQ ID NO: 2724 - DNA, 20 bp, synthetic construct
  misc_feature 1..20: note = CRISPR gRNA sequence
  source 1..20: mol_type = other DNA
tacctggggcttgaaacccc

SEQ ID NO: 2725 - DNA, 20 bp, synthetic construct
  misc_feature 1..20: note = CRISPR gRNA sequence
  source 1..20: mol_type = other DNA
cctggggcttgaaaccccca

SEQ ID NO: 2726 - DNA, 20 bp, synthetic construct
  misc_feature 1..20: note = CRISPR gRNA sequence
  source 1..20: mol_type = other DNA
gggcttgaaacccccagtgg

SEQ ID NO: 2727 - DNA, 20 bp, synthetic construct
  misc_feature 1..20: note = CRISPR gRNA sequence
  source 1..20: mol_type = other DNA
gaaacccccagtgggacaag

SEQ ID NO: 2728 - DNA, 20 bp, synthetic construct
  misc_feature 1..20: note = CRISPR gRNA sequence
  source 1..20: mol_type = other DNA
aaacccccagtgggacaaga

SEQ ID NO: 2729 - DNA, 20 bp, synthetic construct
  misc_feature 1..20: note = CRISPR gRNA sequence
  source 1..20: mol_type = other DNA
accccttccctacctgaact

SEQ ID NO: 2730 - DNA, 20 bp, synthetic construct
  misc_feature 1..20: note = CRISPR gRNA sequence
  source 1..20: mol_type = other DNA
ccctacctgaactcttcctc

SEQ ID NO: 2731 - DNA, 20 bp, synthetic construct
  misc_feature 1..20: note = CRISPR gRNA sequence
  source 1..20: mol_type = other DNA
cctacctgaactcttcctcc

SEQ ID NO: 2732 - DNA, 20 bp, synthetic construct
  misc_feature 1..20: note = CRISPR gRNA sequence
  source 1..20: mol_type = other DNA
cctgaactcttcctcctaca

SEQ ID NO: 2733 - DNA, 20 bp, synthetic construct
  misc_feature 1..20: note = CRISPR gRNA sequence
  source 1..20: mol_type = other DNA
aactcttcctcctacacatc

SEQ ID NO: 2734 - DNA, 20 bp, synthetic construct
  misc_feature 1..20: note = CRISPR gRNA sequence
  source 1..20: mol_type = other DNA
ttcctcctacacatcacagc

SEQ ID NO: 2735 - DNA, 20 bp, synthetic construct
  misc_feature 1..20: note = CRISPR gRNA sequence
  source 1..20: mol_type = other DNA
cctcctacacatcacagcag

SEQ ID NO: 2736 - DNA, 20 bp, synthetic construct
  misc_feature 1..20: note = CRISPR gRNA sequence
  source 1..20: mol_type = other DNA
ctcctacacatcacagcagc

SEQ ID NO: 2737 - DNA, 20 bp, synthetic construct
  misc_feature 1..20: note = CRISPR gRNA sequence
  source 1..20: mol_type = other DNA
ctacacatcacagcagcgac

SEQ ID NO: 2738 - DNA, 20 bp, synthetic construct
  misc_feature 1..20: note = CRISPR gRNA sequence
  source 1..20: mol_type = other DNA
cacatcacagcagcgaccac

SEQ ID NO: 2739 - DNA, 20 bp, synthetic construct
  misc_feature 1..20: note = CRISPR gRNA sequence
  source 1..20: mol_type = other DNA
cgatgaccacaactgctagg

SEQ ID NO: 2740 - DNA, 20 bp, synthetic construct
  misc_feature 1..20: note = CRISPR gRNA sequence
  source 1..20: mol_type = other DNA
ctaggacagccaggccagca

SEQ ID NO: 2741 - DNA, 20 bp, synthetic construct
  misc_feature 1..20: note = CRISPR gRNA sequence
  source 1..20: mol_type = other DNA
ggacagccaggccagcaaca

SEQ ID NO: 2742 - DNA, 20 bp, synthetic construct
  misc_feature 1..20: note = CRISPR gRNA sequence
  source 1..20: mol_type = other DNA
ggaagacggctctgggaaag

SEQ ID NO: 2743 - DNA, 20 bp, synthetic construct
  misc_feature 1..20: note = CRISPR gRNA sequence
  source 1..20: mol_type = other DNA
tgggaaaggaggggaagatg

SEQ ID NO: 2744 - DNA, 20 bp, synthetic construct
  misc_feature 1..20: note = CRISPR gRNA sequence
  source 1..20: mol_type = other DNA
ggaaaggaggggaagatgag

SEQ ID NO: 2745 - DNA, 20 bp, synthetic construct
  misc_feature 1..20: note = CRISPR gRNA sequence
  source 1..20: mol_type = other DNA
accctgctgaagggctcctg

SEQ ID NO: 2746 - DNA, 20 bp, synthetic construct
  misc_feature 1..20: note = CRISPR gRNA sequence
  source 1..20: mol_type = other DNA
ctgaagggctcctgctttcc

SEQ ID NO: 2747 - DNA, 20 bp, synthetic construct
  misc_feature 1..20: note = CRISPR gRNA sequence
  source 1..20: mol_type = other DNA
aagggctcctgctttccctg

SEQ ID NO: 2748 - DNA, 20 bp, synthetic construct
  misc_feature 1..20: note = CRISPR gRNA sequence
  source 1..20: mol_type = other DNA
ctgctttccctgagaagaga

SEQ ID NO: 2749 - DNA, 20 bp, synthetic construct
  misc_feature 1..20: note = CRISPR gRNA sequence
  source 1..20: mol_type = other DNA
ctttccctgagaagagatat

SEQ ID NO: 2750 - DNA, 20 bp, synthetic construct
  misc_feature 1..20: note = CRISPR gRNA sequence
  source 1..20: mol_type = other DNA
tccctgagaagagatatgac

SEQ ID NO: 2751 - DNA, 20 bp, synthetic construct
  misc_feature 1..20: note = CRISPR gRNA sequence
  source 1..20: mol_type = other DNA
ccctgagaagagatatgacc

SEQ ID NO: 2752 - DNA, 20 bp, synthetic construct
  misc_feature 1..20: note = CRISPR gRNA sequence
  source 1..20: mol_type = other DNA
cctgagaagagatatgaccc

SEQ ID NO: 2753 - DNA, 20 bp, synthetic construct
  misc_feature 1..20: note = CRISPR gRNA sequence
  source 1..20: mol_type = other DNA
agaagagatatgacccctca

SEQ ID NO: 2754 - DNA, 20 bp, synthetic construct
  misc_feature 1..20: note = CRISPR gRNA sequence
  source 1..20: mol_type = other DNA
atccccctccttaccccatc

SEQ ID NO: 2755 - DNA, 20 bp, synthetic construct
  misc_feature 1..20: note = CRISPR gRNA sequence
  source 1..20: mol_type = other DNA
cttaccccatctcagggtga

SEQ ID NO: 2756 - DNA, 20 bp, synthetic construct
  misc_feature 1..20: note = CRISPR gRNA sequence
  source 1..20: mol_type = other DNA
accccatctcagggtgaggg

SEQ ID NO: 2757 - DNA, 20 bp, synthetic construct
  misc_feature 1..20: note = CRISPR gRNA sequence
  source 1..20: mol_type = other DNA
ccccatctcagggtgagggg

SEQ ID NO: 2758 - DNA, 20 bp, synthetic construct
  misc_feature 1..20: note = CRISPR gRNA sequence
  source 1..20: mol_type = other DNA
agggtgaggggcttcggcag

SEQ ID NO: 2759 - DNA, 20 bp, synthetic construct
  misc_feature 1..20: note = CRISPR gRNA sequence
  source 1..20: mol_type = other DNA
cggcagcccctcatgctgta

SEQ ID NO: 2760 - DNA, 20 bp, synthetic construct
  misc_feature 1..20: note = CRISPR gRNA sequence
  source 1..20: mol_type = other DNA
ggcagcccctcatgctgtac

SEQ ID NO: 2761 - DNA, 20 bp, synthetic construct
  misc_feature 1..20: note = CRISPR gRNA sequence
  source 1..20: mol_type = other DNA
atgctgtacatggcatgtgt

SEQ ID NO: 2762 - DNA, 20 bp, synthetic construct
  misc_feature 1..20: note = CRISPR gRNA sequence
  source 1..20: mol_type = other DNA
tacatggcatgtgtatctct

SEQ ID NO: 2763 - DNA, 20 bp, synthetic construct
  misc_feature 1..20: note = CRISPR gRNA sequence
  source 1..20: mol_type = other DNA
tgctcttctccagaaggcac

SEQ ID NO: 2764 - DNA, 20 bp, synthetic construct
  misc_feature 1..20: note = CRISPR gRNA sequence
  source 1..20: mol_type = other DNA
ctcttctccagaaggcacca

SEQ ID NO: 2765 - DNA, 20 bp, synthetic construct
  misc_feature 1..20: note = CRISPR gRNA sequence
  source 1..20: mol_type = other DNA
ttctccagaaggcaccacca

SEQ ID NO: 2766 - DNA, 20 bp, synthetic construct
  misc_feature 1..20: note = CRISPR gRNA sequence
  source 1..20: mol_type = other DNA
ctccagaaggcaccaccaca

SEQ ID NO: 2767 - DNA, 20 bp, synthetic construct
  misc_feature 1..20: note = CRISPR gRNA sequence
  source 1..20: mol_type = other DNA
tccagaaggcaccaccacag

SEQ ID NO: 2768 - DNA, 20 bp, synthetic construct
  misc_feature 1..20: note = CRISPR gRNA sequence
  source 1..20: mol_type = other DNA
cagaaggcaccaccacagct

SEQ ID NO: 2769 - DNA, 20 bp, synthetic construct
  misc_feature 1..20: note = CRISPR gRNA sequence
  source 1..20: mol_type = other DNA
cccacttctggaaggttcta

SEQ ID NO: 2770 - DNA, 20 bp, synthetic construct
  misc_feature 1..20: note = CRISPR gRNA sequence
  source 1..20: mol_type = other DNA
ctggaaggttctatctcctg

SEQ ID NO: 2771 - DNA, 20 bp, synthetic construct
  misc_feature 1..20: note = CRISPR gRNA sequence
  source 1..20: mol_type = other DNA
tggaaggttctatctcctgc

SEQ ID NO: 2772 - DNA, 20 bp, synthetic construct
  misc_feature 1..20: note = CRISPR gRNA sequence
  source 1..20: mol_type = other DNA
gaaggttctatctcctgctg

SEQ ID NO: 2773 - DNA, 20 bp, synthetic construct
  misc_feature 1..20: note = CRISPR gRNA sequence
  source 1..20: mol_type = other DNA
tatctcctgctggtctggtc

SEQ ID NO: 2774 - DNA, 20 bp, synthetic construct
  misc_feature 1..20: note = CRISPR gRNA sequence
  source 1..20: mol_type = other DNA
tctcctgctggtctggtctc

SEQ ID NO: 2775 - DNA, 20 bp, synthetic construct
  misc_feature 1..20: note = CRISPR gRNA sequence
  source 1..20: mol_type = other DNA
ctgctggtctggtctccaca

SEQ ID NO: 2776 - DNA, 20 bp, synthetic construct
  misc_feature 1..20: note = CRISPR gRNA sequence
  source 1..20: mol_type = other DNA
ctggtctggtctccacaagc

SEQ ID NO: 2777 - DNA, 20 bp, synthetic construct
  misc_feature 1..20: note = CRISPR gRNA sequence
  source 1..20: mol_type = other DNA
gtctggtctccacaagctca

SEQ ID NO: 2778 - DNA, 20 bp, synthetic construct
  misc_feature 1..20: note = CRISPR gRNA sequence
  source 1..20: mol_type = other DNA
gtctccacaagctcagtgtc

SEQ ID NO: 2779 - DNA, 20 bp, synthetic construct
  misc_feature 1..20: note = CRISPR gRNA sequence
  source 1..20: mol_type = other DNA
cacaagctcagtgtcctgag

SEQ ID NO: 2780 - DNA, 20 bp, synthetic construct
  misc_feature 1..20: note = CRISPR gRNA sequence
  source 1..20: mol_type = other DNA
agtgtcctgagtttggtcct

SEQ ID NO: 2781 - DNA, 20 bp, synthetic construct
  misc_feature 1..20: note = CRISPR gRNA sequence
  source 1..20: mol_type = other DNA
agtttggtcctcgccatccc

SEQ ID NO: 2782 - DNA, 20 bp, synthetic construct
  misc_feature 1..20: note = CRISPR gRNA sequence
  source 1..20: mol_type = other DNA
ggtcctcgccatcccgctgc

SEQ ID NO: 2783 - DNA, 20 bp, synthetic construct
  misc_feature 1..20: note = CRISPR gRNA sequence
  source 1..20: mol_type = other DNA
gtcctcgccatcccgctgcc

SEQ ID NO: 2784 - DNA, 20 bp, synthetic construct
  misc_feature 1..20: note = CRISPR gRNA sequence
  source 1..20: mol_type = other DNA
gccatcccgctgccaggtca

SEQ ID NO: 2785 - DNA, 20 bp, synthetic construct
  misc_feature 1..20: note = CRISPR gRNA sequence
  source 1..20: mol_type = other DNA
ccaggtcagtgtgatctccg

SEQ ID NO: 2786 - DNA, 20 bp, synthetic construct
  misc_feature 1..20: note = CRISPR gRNA sequence
  source 1..20: mol_type = other DNA
cgcagggtagaaacccaggg

SEQ ID NO: 2787 - DNA, 20 bp, synthetic construct
  misc_feature 1..20: note = CRISPR gRNA sequence
  source 1..20: mol_type = other DNA
agggtggcctcatggtcaga

SEQ ID NO: 2788 - DNA, 20 bp, synthetic construct
  misc_feature 1..20: note = CRISPR gRNA sequence
  source 1..20: mol_type = other DNA
atggtcagagatggggtggt

SEQ ID NO: 2789 - DNA, 20 bp, synthetic construct
  misc_feature 1..20: note = CRISPR gRNA sequence
  source 1..20: mol_type = other DNA
tggggggtctgatgggaaga

SEQ ID NO: 2790 - DNA, 20 bp, synthetic construct
  misc_feature 1..20: note = CRISPR gRNA sequence
  source 1..20: mol_type = other DNA
ggggggtctgatgggaagag

SEQ ID NO: 2791 - DNA, 20 bp, synthetic construct
  misc_feature 1..20: note = CRISPR gRNA sequence
  source 1..20: mol_type = other DNA
gggggtctgatgggaagagt

SEQ ID NO: 2792 - DNA, 20 bp, synthetic construct
  misc_feature 1..20: note = CRISPR gRNA sequence
  source 1..20: mol_type = other DNA
atgggaagagtcagaaaatt

SEQ ID NO: 2793 - DNA, 20 bp, synthetic construct
  misc_feature 1..20: note = CRISPR gRNA sequence
  source 1..20: mol_type = other DNA
aggcgctttgcatctttcat

SEQ ID NO: 2794 - DNA, 20 bp, synthetic construct
  misc_feature 1..20: note = CRISPR gRNA sequence
  source 1..20: mol_type = other DNA
tgcatctttcatgggacacc

SEQ ID NO: 2795 - DNA, 20 bp, synthetic construct
  misc_feature 1..20: note = CRISPR gRNA sequence
  source 1..20: mol_type = other DNA
gcatctttcatgggacaccc

SEQ ID NO: 2796 - DNA, 20 bp, synthetic construct
  misc_feature 1..20: note = CRISPR gRNA sequence
  source 1..20: mol_type = other DNA
catctttcatgggacaccct

SEQ ID NO: 2797 - DNA, 20 bp, synthetic construct
  misc_feature 1..20: note = CRISPR gRNA sequence
  source 1..20: mol_type = other DNA
tcatgggacaccctaggacc

SEQ ID NO: 2798 - DNA, 20 bp, synthetic construct
  misc_feature 1..20: note = CRISPR gRNA sequence
  source 1..20: mol_type = other DNA
catgggacaccctaggacca

SEQ ID NO: 2799 - DNA, 20 bp, synthetic construct
  misc_feature 1..20: note = CRISPR gRNA sequence
  source 1..20: mol_type = other DNA
atgggacaccctaggaccac

SEQ ID NO: 2800 - DNA, 20 bp, synthetic construct
  misc_feature 1..20: note = CRISPR gRNA sequence
  source 1..20: mol_type = other DNA
ggaccacccatgtgaccagc

SEQ ID NO: 2801 - DNA, 20 bp, synthetic construct
  misc_feature 1..20: note = CRISPR gRNA sequence
  source 1..20: mol_type = other DNA
agaatggacaggacacctgg

SEQ ID NO: 2802 - DNA, 20 bp, synthetic construct
  misc_feature 1..20: note = CRISPR gRNA sequence
  source 1..20: mol_type = other DNA
gggtggggaaggggcacaga

SEQ ID NO: 2803 - DNA, 20 bp, synthetic construct
  misc_feature 1..20: note = CRISPR gRNA sequence
  source 1..20: mol_type = other DNA
gacgcaggcacctgggataa

SEQ ID NO: 2804 - DNA, 20 bp, synthetic construct
  misc_feature 1..20: note = CRISPR gRNA sequence
  source 1..20: mol_type = other DNA
ggataatctcctattcattg

SEQ ID NO: 2805 - DNA, 20 bp, synthetic construct
  misc_feature 1..20: note = CRISPR gRNA sequence
  source 1..20: mol_type = other DNA
ctattcattggaaagttcga

SEQ ID NO: 2806 - DNA, 20 bp, synthetic construct
  misc_feature 1..20: note = CRISPR gRNA sequence
  source 1..20: mol_type = other DNA
ttcattggaaagttcgagtc

SEQ ID NO: 2807 - DNA, 20 bp, synthetic construct
  misc_feature 1..20: note = CRISPR gRNA sequence
  source 1..20: mol_type = other DNA
attggaaagttcgagtctct

SEQ ID NO: 2808 - DNA, 20 bp, synthetic construct
  misc_feature 1..20: note = CRISPR gRNA sequence
  source 1..20: mol_type = other DNA
gaaagttcgagtctctgagc

SEQ ID NO: 2809 - DNA, 20 bp, synthetic construct
  misc_feature 1..20: note = CRISPR gRNA sequence
  source 1..20: mol_type = other DNA
gagtctctgagcggggaaca

SEQ ID NO: 2810 - DNA, 20 bp, synthetic construct
  misc_feature 1..20: note = CRISPR gRNA sequence
  source 1..20: mol_type = other DNA
tgagcggggaacagggactt

SEQ ID NO: 2811 - DNA, 20 bp, synthetic construct
  misc_feature 1..20: note = CRISPR gRNA sequence
  source 1..20: mol_type = other DNA
agcggggaacagggacttct

SEQ ID NO: 2812 - DNA, 20 bp, synthetic construct
  misc_feature 1..20: note = CRISPR gRNA sequence
  source 1..20: mol_type = other DNA
ctgctcctgatctgagtgga

SEQ ID NO: 2813 - DNA, 20 bp, synthetic construct
  misc_feature 1..20: note = CRISPR gRNA sequence
  source 1..20: mol_type = other DNA
tgctcctgatctgagtggag

SEQ ID NO: 2814 - DNA, 20 bp, synthetic construct
  misc_feature 1..20: note = CRISPR gRNA sequence
  source 1..20: mol_type = other DNA
ctcctgatctgagtggaggt

SEQ ID NO: 2815 - DNA, 20 bp, synthetic construct
  misc_feature 1..20: note = CRISPR gRNA sequence
  source 1..20: mol_type = other DNA
ctgatctgagtggaggtaaa

SEQ ID NO: 2816 - DNA, 20 bp, synthetic construct
  misc_feature 1..20: note = CRISPR gRNA sequence
  source 1..20: mol_type = other DNA
atctgagtggaggtaaagtg

SEQ ID NO: 2817 - DNA, 20 bp, synthetic construct
  misc_feature 1..20: note = CRISPR gRNA sequence
  source 1..20: mol_type = other DNA
agtggaggtaaagtgactca

SEQ ID NO: 2818 - DNA, 20 bp, synthetic construct
  misc_feature 1..20: note = CRISPR gRNA sequence
  source 1..20: mol_type = other DNA
agaagtgctggaatcagagc

SEQ ID NO: 2819 - DNA, 20 bp, synthetic construct
  misc_feature 1..20: note = CRISPR gRNA sequence
  source 1..20: mol_type = other DNA
gaatcagagccccaaacaca

SEQ ID NO: 2820 - DNA, 20 bp, synthetic construct
  misc_feature 1..20: note = CRISPR gRNA sequence
  source 1..20: mol_type = other DNA
agtgtgaggcagagaacaag

SEQ ID NO: 2821 - DNA, 20 bp, synthetic construct
  misc_feature 1..20: note = CRISPR gRNA sequence
  source 1..20: mol_type = other DNA
agaggaaaagtcacggttcc

SEQ ID NO: 2822 - DNA, 20 bp, synthetic construct
  misc_feature 1..20: note = CRISPR gRNA sequence
  source 1..20: mol_type = other DNA
ccaaggctgctgcaggggtc

SEQ ID NO: 2823 - DNA, 20 bp, synthetic construct
  misc_feature 1..20: note = CRISPR gRNA sequence
  source 1..20: mol_type = other DNA
ctgcaggggtcaaaggggac

SEQ ID NO: 2824 - DNA, 20 bp, synthetic construct
  misc_feature 1..20: note = CRISPR gRNA sequence
  source 1..20: mol_type = other DNA
caggggtcaaaggggacccc

SEQ ID NO: 2825 - DNA, 20 bp, synthetic construct
  misc_feature 1..20: note = CRISPR gRNA sequence
  source 1..20: mol_type = other DNA
atcagtattctagggactgt

SEQ ID NO: 2826 - DNA, 20 bp, synthetic construct
  misc_feature 1..20: note = CRISPR gRNA sequence
  source 1..20: mol_type = other DNA
tagggactgtcttcccctcc

SEQ ID NO: 2827 - DNA, 20 bp, synthetic construct
  misc_feature 1..20: note = CRISPR gRNA sequence
  source 1..20: mol_type = other DNA
gggactgtcttcccctccat

SEQ ID NO: 2828 - DNA, 20 bp, synthetic construct
  misc_feature 1..20: note = CRISPR gRNA sequence
  source 1..20: mol_type = other DNA
tcttcccctccatttcctca

SEQ ID NO: 2829 - DNA, 20 bp, synthetic construct
  misc_feature 1..20: note = CRISPR gRNA sequence
  source 1..20: mol_type = other DNA
cccctccatttcctcagaga

SEQ ID NO: 2830 - DNA, 20 bp, synthetic construct
  misc_feature 1..20: note = CRISPR gRNA sequence
  source 1..20: mol_type = other DNA
ccctccatttcctcagagac

SEQ ID NO: 2831 - DNA, 20 bp, synthetic construct
  misc_feature 1..20: note = CRISPR gRNA sequence
  source 1..20: mol_type = other DNA
catttcctcagagacgtcat

SEQ ID NO: 2832 - DNA, 20 bp, synthetic construct
  misc_feature 1..20: note = CRISPR gRNA sequence
  source 1..20: mol_type = other DNA
cctcagagacgtcattcctt

SEQ ID NO: 2833 - DNA, 20 bp, synthetic construct
  misc_feature 1..20: note = CRISPR gRNA sequence
  source 1..20: mol_type = other DNA
ctcagagacgtcattcctta

SEQ ID NO: 2834 - DNA, 20 bp, synthetic construct
  misc_feature 1..20: note = CRISPR gRNA sequence
  source 1..20: mol_type = other DNA
agagacgtcattccttaatt

SEQ ID NO: 2835 - DNA, 20 bp, synthetic construct
  misc_feature 1..20: note = CRISPR gRNA sequence
  source 1..20: mol_type = other DNA
cttaattgtctagagagaag

SEQ ID NO: 2836 - DNA, 20 bp, synthetic construct
  misc_feature 1..20: note = CRISPR gRNA sequence
  source 1..20: mol_type = other DNA
aattgtctagagagaagagg

SEQ ID NO: 2837 - DNA, 20 bp, synthetic construct
  misc_feature 1..20: note = CRISPR gRNA sequence
  source 1..20: mol_type = other DNA
attgtctagagagaagaggg

SEQ ID NO: 2838 - DNA, 20 bp, synthetic construct
  misc_feature 1..20: note = CRISPR gRNA sequence
  source 1..20: mol_type = other DNA
tctagagagaagagggggcc

SEQ ID NO: 2839 - DNA, 20 bp, synthetic construct
  misc_feature 1..20: note = CRISPR gRNA sequence
  source 1..20: mol_type = other DNA
gagagaagagggggccctca

SEQ ID NO: 2840 - DNA, 20 bp, synthetic construct
  misc_feature 1..20: note = CRISPR gRNA sequence
  source 1..20: mol_type = other DNA
agaggaaactcaggaaaact

SEQ ID NO: 2841 - DNA, 20 bp, synthetic construct
  misc_feature 1..20: note = CRISPR gRNA sequence
  source 1..20: mol_type = other DNA
aggaaaactcatgccattct

SEQ ID NO: 2842 - DNA, 20 bp, synthetic construct
  misc_feature 1..20: note = CRISPR gRNA sequence
  source 1..20: mol_type = other DNA
atgccattctccattcaacg

SEQ ID NO: 2843 - DNA, 20 bp, synthetic construct
  misc_feature 1..20: note = CRISPR gRNA sequence
  source 1..20: mol_type = other DNA
tccattcaacggagggcgac

SEQ ID NO: 2844 - DNA, 20 bp, synthetic construct
  misc_feature 1..20: note = CRISPR gRNA sequence
  source 1..20: mol_type = other DNA
cattcaacggagggcgacat

SEQ ID NO: 2845 - DNA, 20 bp, synthetic construct
  misc_feature 1..20: note = CRISPR gRNA sequence
  source 1..20: mol_type = other DNA
aacggagggcgacattctag

SEQ ID NO: 2846 - DNA, 20 bp, synthetic construct
  misc_feature 1..20: note = CRISPR gRNA sequence
  source 1..20: mol_type = other DNA
tagcgctgatcccattttcc

SEQ ID NO: 2847 - DNA, 20 bp, synthetic construct
  misc_feature 1..20: note = CRISPR gRNA sequence
  source 1..20: mol_type = other DNA
gcgctgatcccattttcctc

SEQ ID NO: 2848 - DNA, 20 bp, synthetic construct
  misc_feature 1..20: note = CRISPR gRNA sequence
  source 1..20: mol_type = other DNA
atcccattttcctcctcttc

SEQ ID NO: 2849 - DNA, 20 bp, synthetic construct
  misc_feature 1..20: note = CRISPR gRNA sequence
  source 1..20: mol_type = other DNA
tcctcctcttctcgtgggag

SEQ ID NO: 2850 - DNA, 20 bp, synthetic construct
  misc_feature 1..20: note = CRISPR gRNA sequence
  source 1..20: mol_type = other DNA
cctcctcttctcgtgggagg

SEQ ID NO: 2851 - DNA, 20 bp, synthetic construct
  misc_feature 1..20: note = CRISPR gRNA sequence
  source 1..20: mol_type = other DNA
ctcctcttctcgtgggaggc

SEQ ID NO: 2852 - DNA, 20 bp, synthetic construct
  misc_feature 1..20: note = CRISPR gRNA sequence
  source 1..20: mol_type = other DNA
ctcttctcgtgggaggccat

SEQ ID NO: 2853 - DNA, 20 bp, synthetic construct
  misc_feature 1..20: note = CRISPR gRNA sequence
  source 1..20: mol_type = other DNA
ttctcgtgggaggccatccc

SEQ ID NO: 2854 - DNA, 20 bp, synthetic construct
  misc_feature 1..20: note = CRISPR gRNA sequence
  source 1..20: mol_type = other DNA
ctcgtgggaggccatccccg

SEQ ID NO: 2855 - DNA, 20 bp, synthetic construct
  misc_feature 1..20: note = CRISPR gRNA sequence
  source 1..20: mol_type = other DNA
tcgtgggaggccatccccgg

SEQ ID NO: 2856 - DNA, 20 bp, synthetic construct
  misc_feature 1..20: note = CRISPR gRNA sequence
  source 1..20: mol_type = other DNA
gtgggaggccatccccggcg

SEQ ID NO: 2857 - DNA, 20 bp, synthetic construct
  misc_feature 1..20: note = CRISPR gRNA sequence
  source 1..20: mol_type = other DNA
taggagatggggaaggctcc

SEQ ID NO: 2858 - DNA, 20 bp, synthetic construct
  misc_feature 1..20: note = CRISPR gRNA sequence
  source 1..20: mol_type = other DNA
cccactgcccctggtaccag

SEQ ID NO: 2859 - DNA, 20 bp, synthetic construct
  misc_feature 1..20: note = CRISPR gRNA sequence
  source 1..20: mol_type = other DNA
cccctggtaccagcgcgctc

SEQ ID NO: 2860 - DNA, 20 bp, synthetic construct
  misc_feature 1..20: note = CRISPR gRNA sequence
  source 1..20: mol_type = other DNA
gtaccagcgcgctccagctt

SEQ ID NO: 2861 - DNA, 20 bp, synthetic construct
  misc_feature 1..20: note = CRISPR gRNA sequence
  source 1..20: mol_type = other DNA
cagcttgtccttcccgttct

SEQ ID NO: 2862 - DNA, 20 bp, synthetic construct
  misc_feature 1..20: note = CRISPR gRNA sequence
  source 1..20: mol_type = other DNA
gtccttcccgttctccaggt

SEQ ID NO: 2863 - DNA, 20 bp, synthetic construct
  misc_feature 1..20: note = CRISPR gRNA sequence
  source 1..20: mol_type = other DNA
tccttcccgttctccaggta

SEQ ID NO: 2864 - DNA, 20 bp, synthetic construct
  misc_feature 1..20: note = CRISPR gRNA sequence
  source 1..20: mol_type = other DNA
cccgttctccaggtatctgc

SEQ ID NO: 2865 - DNA, 20 bp, synthetic construct
  misc_feature 1..20: note = CRISPR gRNA sequence
  source 1..20: mol_type = other DNA
ccgttctccaggtatctgcg

SEQ ID NO: 2866 - DNA, 20 bp, synthetic construct
  misc_feature 1..20: note = CRISPR gRNA sequence
  source 1..20: mol_type = other DNA
tccaggtatctgcggagcca

SEQ ID NO: 2867 - DNA, 20 bp, synthetic construct
  misc_feature 1..20: note = CRISPR gRNA sequence
  source 1..20: mol_type = other DNA
caggtatctgcggagccact

SEQ ID NO: 2868 - DNA, 20 bp, synthetic construct
  misc_feature 1..20: note = CRISPR gRNA sequence
  source 1..20: mol_type = other DNA
cggagccactccacgcactc

SEQ ID NO: 2869 - DNA, 20 bp, synthetic construct
  misc_feature 1..20: note = CRISPR gRNA sequence
  source 1..20: mol_type = other DNA
cacgcactcgccctccaggt

SEQ ID NO: 2870 - DNA, 20 bp, synthetic construct
  misc_feature 1..20: note = CRISPR gRNA sequence
  source 1..20: mol_type = other DNA
gccctccaggtaggctctcc

SEQ ID NO: 2871 - DNA, 20 bp, synthetic construct
  misc_feature 1..20: note = CRISPR gRNA sequence
  source 1..20: mol_type = other DNA
caggtaggctctccgctgct

SEQ ID NO: 2872 - DNA, 20 bp, synthetic construct
  misc_feature 1..20: note = CRISPR gRNA sequence
  source 1..20: mol_type = other DNA
tccgctgctccgcctcacgg

SEQ ID NO: 2873 - DNA, 20 bp, synthetic construct
  misc_feature 1..20: note = CRISPR gRNA sequence
  source 1..20: mol_type = other DNA
cgctgctccgcctcacgggc

SEQ ID NO: 2874 - DNA, 20 bp, synthetic construct
  misc_feature 1..20: note = CRISPR gRNA sequence
  source 1..20: mol_type = other DNA
ctccgcctcacgggccgcct

SEQ ID NO: 2875 - DNA, 20 bp, synthetic construct
  misc_feature 1..20: note = CRISPR gRNA sequence
  source 1..20: mol_type = other DNA
cgcctcacgggccgcctccc

SEQ ID NO: 2876 - DNA, 20 bp, synthetic construct
  misc_feature 1..20: note = CRISPR gRNA sequence
  source 1..20: mol_type = other DNA
acgggccgcctcccacttgc

SEQ ID NO: 2877 - DNA, 20 bp, synthetic construct
  misc_feature 1..20: note = CRISPR gRNA sequence
  source 1..20: mol_type = other DNA
ccacttgcgctgggtgatct

SEQ ID NO: 2878 - DNA, 20 bp, synthetic construct
  misc_feature 1..20: note = CRISPR gRNA sequence
  source 1..20: mol_type = other DNA
gcgctgggtgatctgagccg

SEQ ID NO: 2879 - DNA, 20 bp, synthetic construct
  misc_feature 1..20: note = CRISPR gRNA sequence
  source 1..20: mol_type = other DNA
cgctgggtgatctgagccgc

SEQ ID NO: 2880 - DNA, 20 bp, synthetic construct
  misc_feature 1..20: note = CRISPR gRNA sequence
  source 1..20: mol_type = other DNA
ggtgatctgagccgccgtgt

SEQ ID NO: 2881 - DNA, 20 bp, synthetic construct
  misc_feature 1..20: note = CRISPR gRNA sequence
  source 1..20: mol_type = other DNA
agccgccgtgtccgcggcgg

SEQ ID NO: 2882 - DNA, 20 bp, synthetic construct
  misc_feature 1..20: note = CRISPR gRNA sequence
  source 1..20: mol_type = other DNA
gttcagggcgatgtaatcct

SEQ ID NO: 2883 - DNA, 20 bp, synthetic construct
  misc_feature 1..20: note = CRISPR gRNA sequence
  source 1..20: mol_type = other DNA
agggcgatgtaatccttgcc

SEQ ID NO: 2884 - DNA, 20 bp, synthetic construct
  misc_feature 1..20: note = CRISPR gRNA sequence
  source 1..20: mol_type = other DNA
gccgtcgtaggcgtactggt

SEQ ID NO: 2885 - DNA, 20 bp, synthetic construct
  misc_feature 1..20: note = CRISPR gRNA sequence
  source 1..20: mol_type = other DNA
ccgtcgtaggcgtactggtc

SEQ ID NO: 2886 - DNA, 20 bp, synthetic construct
  misc_feature 1..20: note = CRISPR gRNA sequence
  source 1..20: mol_type = other DNA
gtcatgcccgcggaggaggc

SEQ ID NO: 2887 - DNA, 20 bp, synthetic construct
  misc_feature 1..20: note = CRISPR gRNA sequence
  source 1..20: mol_type = other DNA
tggagggtgtgagaccctgg

SEQ ID NO: 2888 - DNA, 20 bp, synthetic construct
  misc_feature 1..20: note = CRISPR gRNA sequence
  source 1..20: mol_type = other DNA
gagggtgtgagaccctggcc

SEQ ID NO: 2889 - DNA, 20 bp, synthetic construct
  misc_feature 1..20: note = CRISPR gRNA sequence
  source 1..20: mol_type = other DNA
gccccggccccgcggtcagc

SEQ ID NO: 2890 - DNA, 20 bp, synthetic construct
  misc_feature 1..20: note = CRISPR gRNA sequence
  source 1..20: mol_type = other DNA
tggcctcaactgaaaatgaa

SEQ ID NO: 2891 - DNA, 20 bp, synthetic construct
  misc_feature 1..20: note = CRISPR gRNA sequence
  source 1..20: mol_type = other DNA
ggcctcaactgaaaatgaaa

SEQ ID NO: 2892 - DNA, 20 bp, synthetic construct
  misc_feature 1..20: note = CRISPR gRNA sequence
  source 1..20: mol_type = other DNA
gcctcaactgaaaatgaaac

SEQ ID NO: 2893 - DNA, 20 bp, synthetic construct
  misc_feature 1..20: note = CRISPR gRNA sequence
  source 1..20: mol_type = other DNA
aactgaaaatgaaaccgggt

SEQ ID NO: 2894 - DNA, 20 bp, synthetic construct
  misc_feature 1..20: note = CRISPR gRNA sequence
  source 1..20: mol_type = other DNA
aaaatgaaaccgggtaaacg

SEQ ID NO: 2895 - DNA, 20 bp, synthetic construct
  misc_feature 1..20: note = CRISPR gRNA sequence
  source 1..20: mol_type = other DNA
gggctctcgccggtcgaggg

SEQ ID NO: 2896 - DNA, 20 bp, synthetic construct
  misc_feature 1..20: note = CRISPR gRNA sequence
  source 1..20: mol_type = other DNA
tcgccggtcgagggtctggg

SEQ ID NO: 2897 - DNA, 20 bp, synthetic construct
  misc_feature 1..20: note = CRISPR gRNA sequence
  source 1..20: mol_type = other DNA
gccggtcgagggtctgggcg

SEQ ID NO: 2898 - DNA, 20 bp, synthetic construct
  misc_feature 1..20: note = CRISPR gRNA sequence
  source 1..20: mol_type = other DNA
ggcgggtcccgcggcctcag

SEQ ID NO: 2899 - DNA, 20 bp, synthetic construct
  misc_feature 1..20: note = CRISPR gRNA sequence
  source 1..20: mol_type = other DNA
agggaggcggatctcggacc

SEQ ID NO: 2900 - DNA, 20 bp, synthetic construct
  misc_feature 1..20: note = CRISPR gRNA sequence
  source 1..20: mol_type = other DNA
ggacccggagactcggggcg

SEQ ID NO: 2901 - DNA, 20 bp, synthetic construct
  misc_feature 1..20: note = CRISPR gRNA sequence
  source 1..20: mol_type = other DNA
ggggcgacccgggccgtacg

SEQ ID NO: 2902 - DNA, 20 bp, synthetic construct
  misc_feature 1..20: note = CRISPR gRNA sequence
  source 1..20: mol_type = other DNA
cgccccgggccggggtcact

SEQ ID NO: 2903 - DNA, 20 bp, synthetic construct
  misc_feature 1..20: note = CRISPR gRNA sequence
  source 1..20: mol_type = other DNA
accggcctcgctctggttgt

SEQ ID NO: 2904 - DNA, 20 bp, synthetic construct
  misc_feature 1..20: note = CRISPR gRNA sequence
  source 1..20: mol_type = other DNA
gctctggttgtagtagccgc

SEQ ID NO: 2905 - DNA, 20 bp, synthetic construct
  misc_feature 1..20: note = CRISPR gRNA sequence
  source 1..20: mol_type = other DNA
tggttgtagtagccgcgcag

SEQ ID NO: 2906 - DNA, 20 bp, synthetic construct
  misc_feature 1..20: note = CRISPR gRNA sequence
  source 1..20: mol_type = other DNA
gttgtagtagccgcgcaggt

SEQ ID NO: 2907 - DNA, 20 bp, synthetic construct
  misc_feature 1..20: note = CRISPR gRNA sequence
  source 1..20: mol_type = other DNA
tagtagccgcgcaggttccg

SEQ ID NO: 2908 - DNA, 20 bp, synthetic construct
  misc_feature 1..20: note = CRISPR gRNA sequence
  source 1..20: mol_type = other DNA
cgcaggctctctcggtcagt

SEQ ID NO: 2909 - DNA, 20 bp, synthetic construct
  misc_feature 1..20: note = CRISPR gRNA sequence
  source 1..20: mol_type = other DNA
tctcggtcagtctgtgcctg

SEQ ID NO: 2910 - DNA, 20 bp, synthetic construct
  misc_feature 1..20: note = CRISPR gRNA sequence
  source 1..20: mol_type = other DNA
tcggtcagtctgtgcctggg

SEQ ID NO: 2911 - DNA, 20 bp, synthetic construct
  misc_feature 1..20: note = CRISPR gRNA sequence
  source 1..20: mol_type = other DNA
ggtcagtctgtgcctgggcc

SEQ ID NO: 2912 - DNA, 20 bp, synthetic construct
  misc_feature 1..20: note = CRISPR gRNA sequence
  source 1..20: mol_type = other DNA
tgcctgggccttgtagatct

SEQ ID NO: 2913 - DNA, 20 bp, synthetic construct
  misc_feature 1..20: note = CRISPR gRNA sequence
  source 1..20: mol_type = other DNA
ggccttgtagatctgtgtgt

SEQ ID NO: 2914 - DNA, 20 bp, synthetic construct
  misc_feature 1..20: note = CRISPR gRNA sequence
  source 1..20: mol_type = other DNA
gtagatctgtgtgttccggt

SEQ ID NO: 2915 - DNA, 20 bp, synthetic construct
  misc_feature 1..20: note = CRISPR gRNA sequence
  source 1..20: mol_type = other DNA
tagatctgtgtgttccggtc

SEQ ID NO: 2916 - DNA, 20 bp, synthetic construct
  misc_feature 1..20: note = CRISPR gRNA sequence
  source 1..20: mol_type = other DNA
tgtgttccggtcccaatact

SEQ ID NO: 2917 - DNA, 20 bp, synthetic construct
  misc_feature 1..20: note = CRISPR gRNA sequence
  source 1..20: mol_type = other DNA
cggtcccaatactccggccc

SEQ ID NO: 2918 - DNA, 20 bp, synthetic construct
  misc_feature 1..20: note = CRISPR gRNA sequence
  source 1..20: mol_type = other DNA
cggcccctcctgctctatcc

SEQ ID NO: 2919 - DNA, 20 bp, synthetic construct
  misc_feature 1..20: note = CRISPR gRNA sequence
  source 1..20: mol_type = other DNA
ctgctctatccacggcgccc

SEQ ID NO: 2920 - DNA, 20 bp, synthetic construct
  misc_feature 1..20: note = CRISPR gRNA sequence
  source 1..20: mol_type = other DNA
ctctatccacggcgcccgcg

SEQ ID NO: 2921 - DNA, 20 bp, synthetic construct
  misc_feature 1..20: note = CRISPR gRNA sequence
  source 1..20: mol_type = other DNA
tatccacggcgcccgcggct

SEQ ID NO: 2922 - DNA, 20 bp, synthetic construct
  misc_feature 1..20: note = CRISPR gRNA sequence
  source 1..20: mol_type = other DNA
tccacggcgcccgcggctcc

SEQ ID NO: 2923 - DNA, 20 bp, synthetic construct
  misc_feature 1..20: note = CRISPR gRNA sequence
  source 1..20: mol_type = other DNA
ctctctcggactcgcggcgt

SEQ ID NO: 2924 - DNA, 20 bp, synthetic construct
  misc_feature 1..20: note = CRISPR gRNA sequence
  source 1..20: mol_type = other DNA
tctcggactcgcggcgtcgc

SEQ ID NO: 2925 - DNA, 20 bp, synthetic construct
  misc_feature 1..20: note = CRISPR gRNA sequence
  source 1..20: mol_type = other DNA
tcggactcgcggcgtcgctg

SEQ ID NO: 2926 - DNA, 20 bp, synthetic construct
  misc_feature 1..20: note = CRISPR gRNA sequence
  source 1..20: mol_type = other DNA
ggactcgcggcgtcgctgtc

SEQ ID NO: 2927 - DNA, 20 bp, synthetic construct
  misc_feature 1..20: note = CRISPR gRNA sequence
  source 1..20: mol_type = other DNA
gcggcgtcgctgtcgaacct

SEQ ID NO: 2928 - DNA, 20 bp, synthetic construct
  misc_feature 1..20: note = CRISPR gRNA sequence
  source 1..20: mol_type = other DNA
tcgaacctcacgaactgggt

SEQ ID NO: 2929 - DNA, 20 bp, synthetic construct
  misc_feature 1..20: note = CRISPR gRNA sequence
  source 1..20: mol_type = other DNA
acgaactgggtgtcgtccac

SEQ ID NO: 2930 - DNA, 20 bp, synthetic construct
  misc_feature 1..20: note = CRISPR gRNA sequence
  source 1..20: mol_type = other DNA
ggtgtcgtccacgtagccca

SEQ ID NO: 2931 - DNA, 20 bp, synthetic construct
  misc_feature 1..20: note = CRISPR gRNA sequence
  source 1..20: mol_type = other DNA
agatgaagcggggctccccg

SEQ ID NO: 2932 - DNA, 20 bp, synthetic construct
  misc_feature 1..20: note = CRISPR gRNA sequence
  source 1..20: mol_type = other DNA
cccgcggccgggccgggaca

SEQ ID NO: 2933 - DNA, 20 bp, synthetic construct
  misc_feature 1..20: note = CRISPR gRNA sequence
  source 1..20: mol_type = other DNA
atggagtgggagcctggggg

SEQ ID NO: 2934 - DNA, 20 bp, synthetic construct
  misc_feature 1..20: note = CRISPR gRNA sequence
  source 1..20: mol_type = other DNA
ggggtgaggaggggctgaga

SEQ ID NO: 2935 - DNA, 20 bp, synthetic construct
  misc_feature 1..20: note = CRISPR gRNA sequence
  source 1..20: mol_type = other DNA
agacccgcccgaccctcctc

SEQ ID NO: 2936 - DNA, 20 bp, synthetic construct
  misc_feature 1..20: note = CRISPR gRNA sequence
  source 1..20: mol_type = other DNA
ctcccggcgcggctcctcag

SEQ ID NO: 2937 - DNA, 20 bp, synthetic construct
  misc_feature 1..20: note = CRISPR gRNA sequence
  source 1..20: mol_type = other DNA
ccggcgcggctcctcaggtc

SEQ ID NO: 2938 - DNA, 20 bp, synthetic construct
  misc_feature 1..20: note = CRISPR gRNA sequence
  source 1..20: mol_type = other DNA
ctcaggtcctgcgcccccgc

SEQ ID NO: 2939 - DNA, 20 bp, synthetic construct
  misc_feature 1..20: note = CRISPR gRNA sequence
  source 1..20: mol_type = other DNA
aggtcctgcgcccccgcctg

SEQ ID NO: 2940 - DNA, 20 bp, synthetic construct
  misc_feature 1..20: note = CRISPR gRNA sequence
  source 1..20: mol_type = other DNA
cgcccccgcctgcggtcccc

SEQ ID NO: 2941 - DNA, 20 bp, synthetic construct
  misc_feature 1..20: note = CRISPR gRNA sequence
  source 1..20: mol_type = other DNA
cggtcccctcgctcctcccg

SEQ ID NO: 2942 - DNA, 20 bp, synthetic construct
  misc_feature 1..20: note = CRISPR gRNA sequence
  source 1..20: mol_type = other DNA
gctcctcccggcagaggcca

SEQ ID NO: 2943 - DNA, 20 bp, synthetic construct
  misc_feature 1..20: note = CRISPR gRNA sequence
  source 1..20: mol_type = other DNA
ctcccggcagaggccatttc

SEQ ID NO: 2944 - DNA, 20 bp, synthetic construct
  misc_feature 1..20: note = CRISPR gRNA sequence
  source 1..20: mol_type = other DNA
ccggcagaggccatttccct

SEQ ID NO: 2945 - DNA, 20 bp, synthetic construct
  misc_feature 1..20: note = CRISPR gRNA sequence
  source 1..20: mol_type = other DNA
ccctcccgacccgcactcac

SEQ ID NO: 2946 - DNA, 20 bp, synthetic construct
  misc_feature 1..20: note = CRISPR gRNA sequence
  source 1..20: mol_type = other DNA
cctcccgacccgcactcacc

SEQ ID NO: 2947 - DNA, 20 bp, synthetic construct
  misc_feature 1..20: note = CRISPR gRNA sequence
  source 1..20: mol_type = other DNA
ccgacccgcactcaccggcc

SEQ ID NO: 2948 - DNA, 20 bp, synthetic construct
  misc_feature 1..20: note = CRISPR gRNA sequence
  source 1..20: mol_type = other DNA
accggcccaggtctcggtca

SEQ ID NO: 2949 - DNA, 20 bp, synthetic construct
  misc_feature 1..20: note = CRISPR gRNA sequence
  source 1..20: mol_type = other DNA
ggtcagggccagggccgccg

SEQ ID NO: 2950 - DNA, 20 bp, synthetic construct
  misc_feature 1..20: note = CRISPR gRNA sequence
  source 1..20: mol_type = other DNA
ggggcgccatgaccagcatc

SEQ ID NO: 2951 - DNA, 20 bp, synthetic construct
  misc_feature 1..20: note = CRISPR gRNA sequence
  source 1..20: mol_type = other DNA
ggcgtctgaggagactctga

SEQ ID NO: 2952 - DNA, 20 bp, synthetic construct
  misc_feature 1..20: note = CRISPR gRNA sequence
  source 1..20: mol_type = other DNA
aggagactctgagtccgggt

SEQ ID NO: 2953 - DNA, 20 bp, synthetic construct
  misc_feature 1..20: note = CRISPR gRNA sequence
  source 1..20: mol_type = other DNA
tgagtccgggtgggtgcgtg

SEQ ID NO: 2954 - DNA, 20 bp, synthetic construct
  misc_feature 1..20: note = CRISPR gRNA sequence
  source 1..20: mol_type = other DNA
agtccgggtgggtgcgtggg

SEQ ID NO: 2955 - DNA, 20 bp, synthetic construct
  misc_feature 1..20: note = CRISPR gRNA sequence
  source 1..20: mol_type = other DNA
tagaactgggaccgcggcga

SEQ ID NO: 2956 - DNA, 20 bp, synthetic construct
  misc_feature 1..20: note = CRISPR gRNA sequence
  source 1..20: mol_type = other DNA
agaactgggaccgcggcgac

SEQ ID NO: 2957 - DNA, 20 bp, synthetic construct
  misc_feature 1..20: note = CRISPR gRNA sequence
  source 1..20: mol_type = other DNA
gaactgggaccgcggcgacg

SEQ ID NO: 2958 - DNA, 20 bp, synthetic construct
  misc_feature 1..20: note = CRISPR gRNA sequence
  source 1..20: mol_type = other DNA
ggaccgcggcgacgctgatt

SEQ ID NO: 2959 - DNA, 20 bp, synthetic construct
  misc_feature 1..20: note = CRISPR gRNA sequence
  source 1..20: mol_type = other DNA
attggcttctctagatatcc

SEQ ID NO: 2960 - DNA, 20 bp, synthetic construct
  misc_feature 1..20: note = CRISPR gRNA sequence
  source 1..20: mol_type = other DNA
gcttctctagatatccaata

SEQ ID NO: 2961 - DNA, 20 bp, synthetic construct
  misc_feature 1..20: note = CRISPR gRNA sequence
  source 1..20: mol_type = other DNA
ctctagatatccaataccca

SEQ ID NO: 2962 - DNA, 20 bp, synthetic construct
  misc_feature 1..20: note = CRISPR gRNA sequence
  source 1..20: mol_type = other DNA
gatatctagagaagccaatc

SEQ ID NO: 2963 - DNA, 20 bp, synthetic construct
  misc_feature 1..20: note = CRISPR gRNA sequence
  source 1..20: mol_type = other DNA
gagaagccaatcagcgtcgc

SEQ ID NO: 2964 - DNA, 20 bp, synthetic construct
  misc_feature 1..20: note = CRISPR gRNA sequence
  source 1..20: mol_type = other DNA
taaagtccccacgcacccac

SEQ ID NO: 2965 - DNA, 20 bp, synthetic construct
  misc_feature 1..20: note = CRISPR gRNA sequence
  source 1..20: mol_type = other DNA
aagtccccacgcacccaccc

SEQ ID NO: 2966 - DNA, 20 bp, synthetic construct
  misc_feature 1..20: note = CRISPR gRNA sequence
  source 1..20: mol_type = other DNA
agagtctcctcagacgccga

SEQ ID NO: 2967 - DNA, 20 bp, synthetic construct
  misc_feature 1..20: note = CRISPR gRNA sequence
  source 1..20: mol_type = other DNA
ctcagacgccgagatgctgg

SEQ ID NO: 2968 - DNA, 20 bp, synthetic construct
  misc_feature 1..20: note = CRISPR gRNA sequence
  source 1..20: mol_type = other DNA
agacgccgagatgctggtca

SEQ ID NO: 2969 - DNA, 20 bp, synthetic construct
  misc_feature 1..20: note = CRISPR gRNA sequence
  source 1..20: mol_type = other DNA
gtcatggcgccccgaaccgt

SEQ ID NO: 2970 - DNA, 20 bp, synthetic construct
  misc_feature 1..20: note = CRISPR gRNA sequence
  source 1..20: mol_type = other DNA
ctgctgctctcggcggccct

SEQ ID NO: 2971 - DNA, 20 bp, synthetic construct
  misc_feature 1..20: note = CRISPR gRNA sequence
  source 1..20: mol_type = other DNA
ctgctctcggcggccctggc

SEQ ID NO: 2972 - DNA, 20 bp, synthetic construct
  misc_feature 1..20: note = CRISPR gRNA sequence
  source 1..20: mol_type = other DNA
ctctcggcggccctggccct

SEQ ID NO: 2973 - DNA, 20 bp, synthetic construct
  misc_feature 1..20: note = CRISPR gRNA sequence
  source 1..20: mol_type = other DNA
tcggcggccctggccctgac

SEQ ID NO: 2974 - DNA, 20 bp, synthetic construct
  misc_feature 1..20: note = CRISPR gRNA sequence
  source 1..20: mol_type = other DNA
ggcggccctggccctgaccg

SEQ ID NO: 2975 - DNA, 20 bp, synthetic construct
  misc_feature 1..20: note = CRISPR gRNA sequence
  source 1..20: mol_type = other DNA
gccctgaccgagacctgggc

SEQ ID NO: 2976 - DNA, 20 bp, synthetic construct
  misc_feature 1..20: note = CRISPR gRNA sequence
  source 1..20: mol_type = other DNA
accgagacctgggccggtga

SEQ ID NO: 2977 - DNA, 20 bp, synthetic construct
  misc_feature 1..20: note = CRISPR gRNA sequence
  source 1..20: mol_type = other DNA
ggccggtgagtgcgggtcgg

SEQ ID NO: 2978 - DNA, 20 bp, synthetic construct
  misc_feature 1..20: note = CRISPR gRNA sequence
  source 1..20: mol_type = other DNA
tgccgggaggagcgagggga

SEQ ID NO: 2979 - DNA, 20 bp, synthetic construct
  misc_feature 1..20: note = CRISPR gRNA sequence
  source 1..20: mol_type = other DNA
ccgggaggagcgaggggacc

SEQ ID NO: 2980 - DNA, 20 bp, synthetic construct
  misc_feature 1..20: note = CRISPR gRNA sequence
  source 1..20: mol_type = other DNA
aggagccgcgccgggaggag

SEQ ID NO: 2981 - DNA, 20 bp, synthetic construct
  misc_feature 1..20: note = CRISPR gRNA sequence
  source 1..20: mol_type = other DNA
agcccctcctcacccccagg

SEQ ID NO: 2982 - DNA, 20 bp, synthetic construct
  misc_feature 1..20: note = CRISPR gRNA sequence
  source 1..20: mol_type = other DNA
ctcacccccaggctcccact

SEQ ID NO: 2983 - DNA, 20 bp, synthetic construct
  misc_feature 1..20: note = CRISPR gRNA sequence
  source 1..20: mol_type = other DNA
acccccaggctcccactcca

SEQ ID NO: 2984 - DNA, 20 bp, synthetic construct
  misc_feature 1..20: note = CRISPR gRNA sequence
  source 1..20: mol_type = other DNA
ccactccatgaggtatttct

SEQ ID NO: 2985 - DNA, 20 bp, synthetic construct
  misc_feature 1..20: note = CRISPR gRNA sequence
  source 1..20: mol_type = other DNA
catgaggtatttctacacct

SEQ ID NO: 2986 - DNA, 20 bp, synthetic construct
  misc_feature 1..20: note = CRISPR gRNA sequence
  source 1..20: mol_type = other DNA
ctacacctccgtgtcccggc

SEQ ID NO: 2987 - DNA, 20 bp, synthetic construct
  misc_feature 1..20: note = CRISPR gRNA sequence
  source 1..20: mol_type = other DNA
tacacctccgtgtcccggcc

SEQ ID NO: 2988 - DNA, 20 bp, synthetic construct
  misc_feature 1..20: note = CRISPR gRNA sequence
  source 1..20: mol_type = other DNA
cacctccgtgtcccggcccg

SEQ ID NO: 2989 - DNA, 20 bp, synthetic construct
  misc_feature 1..20: note = CRISPR gRNA sequence
  source 1..20: mol_type = other DNA
cgtgtcccggcccggccgcg

SEQ ID NO: 2990 - DNA, 20 bp, synthetic construct
  misc_feature 1..20: note = CRISPR gRNA sequence
  source 1..20: mol_type = other DNA
catctcagtgggctacgtgg

SEQ ID NO: 2991 - DNA, 20 bp, synthetic construct
  misc_feature 1..20: note = CRISPR gRNA sequence
  source 1..20: mol_type = other DNA
atctcagtgggctacgtgga

SEQ ID NO: 2992 - DNA, 20 bp, synthetic construct
  misc_feature 1..20: note = CRISPR gRNA sequence
  source 1..20: mol_type = other DNA
agtgggctacgtggacgaca

SEQ ID NO: 2993 - DNA, 20 bp, synthetic construct
  misc_feature 1..20: note = CRISPR gRNA sequence
  source 1..20: mol_type = other DNA
cgtggacgacacccagttcg

SEQ ID NO: 2994 - DNA, 20 bp, synthetic construct
  misc_feature 1..20: note = CRISPR gRNA sequence
  source 1..20: mol_type = other DNA
gtgaggttcgacagcgacgc

SEQ ID NO: 2995 - DNA, 20 bp, synthetic construct
  misc_feature 1..20: note = CRISPR gRNA sequence
  source 1..20: mol_type = other DNA
gacagcgacgccgcgagtcc

SEQ ID NO: 2996 - DNA, 20 bp, synthetic construct
  misc_feature 1..20: note = CRISPR gRNA sequence
  source 1..20: mol_type = other DNA
ggaccggaacacacagatct

SEQ ID NO: 2997 - DNA, 20 bp, synthetic construct
  misc_feature 1..20: note = CRISPR gRNA sequence
  source 1..20: mol_type = other DNA
caaggcccaggcacagactg

SEQ ID NO: 2998 - DNA, 20 bp, synthetic construct
  misc_feature 1..20: note = CRISPR gRNA sequence
  source 1..20: mol_type = other DNA
accgagagagcctgcggaac

SEQ ID NO: 2999 - DNA, 20 bp, synthetic construct
  misc_feature 1..20: note = CRISPR gRNA sequence
  source 1..20: mol_type = other DNA
cggaacctgcgcggctacta

SEQ ID NO: 3000 - DNA, 20 bp, synthetic construct
  misc_feature 1..20: note = CRISPR gRNA sequence
  source 1..20: mol_type = other DNA
cgcggctactacaaccagag

SEQ ID NO: 3001 - DNA, 20 bp, synthetic construct
  misc_feature 1..20: note = CRISPR gRNA sequence
  source 1..20: mol_type = other DNA
ctacaaccagagcgaggccg

SEQ ID NO: 3002 - DNA, 20 bp, synthetic construct
  misc_feature 1..20: note = CRISPR gRNA sequence
  source 1..20: mol_type = other DNA
caaccagagcgaggccggtg

SEQ ID NO: 3003 - DNA, 20 bp, synthetic construct
  misc_feature 1..20: note = CRISPR gRNA sequence
  source 1..20: mol_type = other DNA
cccatcccccacgtacggcc

SEQ ID NO: 3004 - DNA, 20 bp, synthetic construct
  misc_feature 1..20: note = CRISPR gRNA sequence
  source 1..20: mol_type = other DNA
cgggtccgagatccgcctcc

SEQ ID NO: 3005 - DNA, 20 bp, synthetic construct
  misc_feature 1..20: note = CRISPR gRNA sequence
  source 1..20: mol_type = other DNA
cctgaggccgcgggacccgc

SEQ ID NO: 3006 - DNA, 20 bp, synthetic construct
  misc_feature 1..20: note = CRISPR gRNA sequence
  source 1..20: mol_type = other DNA
aggccgcgggacccgcccag

SEQ ID NO: 3007 - DNA, 20 bp, synthetic construct
  misc_feature 1..20: note = CRISPR gRNA sequence
  source 1..20: mol_type = other DNA
gaccggcgagagccccaggc

SEQ ID NO: 3008 - DNA, 20 bp, synthetic construct
  misc_feature 1..20: note = CRISPR gRNA sequence
  source 1..20: mol_type = other DNA
acccggtttcattttcagtt

SEQ ID NO: 3009 - DNA, 20 bp, synthetic construct
  misc_feature 1..20: note = CRISPR gRNA sequence
  source 1..20: mol_type = other DNA
cccggtttcattttcagttg

SEQ ID NO: 3010 - DNA, 20 bp, synthetic construct
  misc_feature 1..20: note = CRISPR gRNA sequence
  source 1..20: mol_type = other DNA
cattttcagttgaggccaaa

SEQ ID NO: 3011 - DNA, 20 bp, synthetic construct
  misc_feature 1..20: note = CRISPR gRNA sequence
  source 1..20: mol_type = other DNA
attttcagttgaggccaaaa

SEQ ID NO: 3012 - DNA, 20 bp, synthetic construct
  misc_feature 1..20: note = CRISPR gRNA sequence
  source 1..20: mol_type = other DNA
tcagttgaggccaaaatccc

SEQ ID NO: 3013 - DNA, 20 bp, synthetic construct
  misc_feature 1..20: note = CRISPR gRNA sequence
  source 1..20: mol_type = other DNA
cagttgaggccaaaatcccc

SEQ ID NO: 3014 - DNA, 20 bp, synthetic construct
  misc_feature 1..20: note = CRISPR gRNA sequence
  source 1..20: mol_type = other DNA
agttgaggccaaaatccccg

SEQ ID NO: 3015 - DNA, 20 bp, synthetic construct
  misc_feature 1..20: note = CRISPR gRNA sequence
  source 1..20: mol_type = other DNA
aggccaaaatccccgcgggt

SEQ ID NO: 3016 - DNA, 20 bp, synthetic construct
  misc_feature 1..20: note = CRISPR gRNA sequence
  source 1..20: mol_type = other DNA
gtcggggcggggcggggctc

SEQ ID NO: 3017 - DNA, 20 bp, synthetic construct
  misc_feature 1..20: note = CRISPR gRNA sequence
  source 1..20: mol_type = other DNA
gggggactgggctgaccgcg

SEQ ID NO: 3018 - DNA, 20 bp, synthetic construct
  misc_feature 1..20: note = CRISPR gRNA sequence
  source 1..20: mol_type = other DNA
ggctgaccgcggggccgggg

SEQ ID NO: 3019 - DNA, 20 bp, synthetic construct
  misc_feature 1..20: note = CRISPR gRNA sequence
  source 1..20: mol_type = other DNA
accgcggggccggggccagg

SEQ ID NO: 3020 - DNA, 20 bp, synthetic construct
  misc_feature 1..20: note = CRISPR gRNA sequence
  source 1..20: mol_type = other DNA
acaccctccagagcatgtac

SEQ ID NO: 3021 - DNA, 20 bp, synthetic construct
  misc_feature 1..20: note = CRISPR gRNA sequence
  source 1..20: mol_type = other DNA
cagagcatgtacggctgcga

SEQ ID NO: 3022 - DNA, 20 bp, synthetic construct
  misc_feature 1..20: note = CRISPR gRNA sequence
  source 1..20: mol_type = other DNA
cgacgtggggccggacgggc

SEQ ID NO: 3023 - DNA, 20 bp, synthetic construct
  misc_feature 1..20: note = CRISPR gRNA sequence
  source 1..20: mol_type = other DNA
ctccgcgggcatgaccagta

SEQ ID NO: 3024 - DNA, 20 bp, synthetic construct
  misc_feature 1..20: note = CRISPR gRNA sequence
  source 1..20: mol_type = other DNA
cgcgggcatgaccagtacgc

SEQ ID NO: 3025 - DNA, 20 bp, synthetic construct
  misc_feature 1..20: note = CRISPR gRNA sequence
  source 1..20: mol_type = other DNA
cgacggcaaggattacatcg

SEQ ID NO: 3026 - DNA, 20 bp, synthetic construct
  misc_feature 1..20: note = CRISPR gRNA sequence
  source 1..20: mol_type = other DNA
catcgccctgaacgaggacc

SEQ ID NO: 3027 - DNA, 20 bp, synthetic construct
  misc_feature 1..20: note = CRISPR gRNA sequence
  source 1..20: mol_type = other DNA
aacgaggacctgcgctcctg

SEQ ID NO: 3028 - DNA, 20 bp, synthetic construct
  misc_feature 1..20: note = CRISPR gRNA sequence
  source 1..20: mol_type = other DNA
cgctcctggaccgccgcgga

SEQ ID NO: 3029 - DNA, 20 bp, synthetic construct
  misc_feature 1..20: note = CRISPR gRNA sequence
  source 1..20: mol_type = other DNA
ctggaccgccgcggacacgg

SEQ ID NO: 3030 - DNA, 20 bp, synthetic construct
  misc_feature 1..20: note = CRISPR gRNA sequence
  source 1..20: mol_type = other DNA
gaccgccgcggacacggcgg

SEQ ID NO: 3031 - DNA, 20 bp, synthetic construct
  misc_feature 1..20: note = CRISPR gRNA sequence
  source 1..20: mol_type = other DNA
agatcacccagcgcaagtgg

SEQ ID NO: 3032 - DNA, 20 bp, synthetic construct
  misc_feature 1..20: note = CRISPR gRNA sequence
  source 1..20: mol_type = other DNA
cctggagggcgagtgcgtgg

SEQ ID NO: 3033 - DNA, 20 bp, synthetic construct
  misc_feature 1..20: note = CRISPR gRNA sequence
  source 1..20: mol_type = other DNA
gagggcgagtgcgtggagtg

SEQ ID NO: 3034 - DNA, 20 bp, synthetic construct
  misc_feature 1..20: note = CRISPR gRNA sequence
  source 1..20: mol_type = other DNA
cgcagatacctggagaacgg

SEQ ID NO: 3035 - DNA, 20 bp, synthetic construct
  misc_feature 1..20: note = CRISPR gRNA sequence
  source 1..20: mol_type = other DNA
gagaacgggaaggacaagct

SEQ ID NO: 3036 - DNA, 20 bp, synthetic construct
  misc_feature 1..20: note = CRISPR gRNA sequence
  source 1..20: mol_type = other DNA
gagcgcgctggtaccagggg

SEQ ID NO: 3037 - DNA, 20 bp, synthetic construct
  misc_feature 1..20: note = CRISPR gRNA sequence
  source 1..20: mol_type = other DNA
gtaccaggggcagtggggag

SEQ ID NO: 3038 - DNA, 20 bp, synthetic construct
  misc_feature 1..20: note = CRISPR gRNA sequence
  source 1..20: mol_type = other DNA
ccccatctcctataggtcgc

SEQ ID NO: 3039 - DNA, 20 bp, synthetic construct
  misc_feature 1..20: note = CRISPR gRNA sequence
  source 1..20: mol_type = other DNA
cccatctcctataggtcgcc

SEQ ID NO: 3040 - DNA, 20 bp, synthetic construct
  misc_feature 1..20: note = CRISPR gRNA sequence
  source 1..20: mol_type = other DNA
ctataggtcgccggggatgg

SEQ ID NO: 3041 - DNA, 20 bp, synthetic construct
  misc_feature 1..20: note = CRISPR gRNA sequence
  source 1..20: mol_type = other DNA
taggtcgccggggatggcct

SEQ ID NO: 3042 - DNA, 20 bp, synthetic construct
  misc_feature 1..20: note = CRISPR gRNA sequence
  source 1..20: mol_type = other DNA
ccacgagaagaggaggaaaa

SEQ ID NO: 3043 - DNA, 20 bp, synthetic construct
  misc_feature 1..20: note = CRISPR gRNA sequence
  source 1..20: mol_type = other DNA
gaatgtcgccctccgttgaa

SEQ ID NO: 3044 - DNA, 20 bp, synthetic construct
  misc_feature 1..20: note = CRISPR gRNA sequence
  source 1..20: mol_type = other DNA
cgttgaatggagaatggcat

SEQ ID NO: 3045 - DNA, 20 bp, synthetic construct
  misc_feature 1..20: note = CRISPR gRNA sequence
  source 1..20: mol_type = other DNA
aatggagaatggcatgagtt

SEQ ID NO: 3046 - DNA, 20 bp, synthetic construct
  misc_feature 1..20: note = CRISPR gRNA sequence
  source 1..20: mol_type = other DNA
tcctgagtttcctctgaggg

SEQ ID NO: 3047 - DNA, 20 bp, synthetic construct
  misc_feature 1..20: note = CRISPR gRNA sequence
  source 1..20: mol_type = other DNA
cctgagtttcctctgagggc

SEQ ID NO: 3048 - DNA, 20 bp, synthetic construct
  misc_feature 1..20: note = CRISPR gRNA sequence
  source 1..20: mol_type = other DNA
ctgagtttcctctgagggcc

SEQ ID NO: 3049 - DNA, 20 bp, synthetic construct
  misc_feature 1..20: note = CRISPR gRNA sequence
  source 1..20: mol_type = other DNA
agtttcctctgagggccccc

SEQ ID NO: 3050 - DNA, 20 bp, synthetic construct
  misc_feature 1..20: note = CRISPR gRNA sequence
  source 1..20: mol_type = other DNA
cctctgagggccccctcttc

SEQ ID NO: 3051 - DNA, 20 bp, synthetic construct
  misc_feature 1..20: note = CRISPR gRNA sequence
  source 1..20: mol_type = other DNA
ctctgagggccccctcttct

SEQ ID NO: 3052 - DNA, 20 bp, synthetic construct
  misc_feature 1..20: note = CRISPR gRNA sequence
  source 1..20: mol_type = other DNA
tgagggccccctcttctctc

SEQ ID NO: 3053 - DNA, 20 bp, synthetic construct
  misc_feature 1..20: note = CRISPR gRNA sequence
  source 1..20: mol_type = other DNA
agggccccctcttctctcta

SEQ ID NO: 3054 - DNA, 20 bp, synthetic construct
  misc_feature 1..20: note = CRISPR gRNA sequence
  source 1..20: mol_type = other DNA
ttctctctagacaattaagg

SEQ ID NO: 3055 - DNA, 20 bp, synthetic construct
  misc_feature 1..20: note = CRISPR gRNA sequence
  source 1..20: mol_type = other DNA
ctctctagacaattaaggaa

SEQ ID NO: 3056 - DNA, 20 bp, synthetic construct
  misc_feature 1..20: note = CRISPR gRNA sequence
  source 1..20: mol_type = other DNA
tctctagacaattaaggaat

SEQ ID NO: 3057 - DNA, 20 bp, synthetic construct
  misc_feature 1..20: note = CRISPR gRNA sequence
  source 1..20: mol_type = other DNA
tctagacaattaaggaatga

SEQ ID NO: 3058 - DNA, 20 bp, synthetic construct
  misc_feature 1..20: note = CRISPR gRNA sequence
  source 1..20: mol_type = other DNA
tagacaattaaggaatgacg

SEQ ID NO: 3059 - DNA, 20 bp, synthetic construct
  misc_feature 1..20: note = CRISPR gRNA sequence
  source 1..20: mol_type = other DNA
gacaattaaggaatgacgtc

SEQ ID NO: 3060 - DNA, 20 bp, synthetic construct
  misc_feature 1..20: note = CRISPR gRNA sequence
  source 1..20: mol_type = other DNA
aggaatgacgtctctgagga

SEQ ID NO: 3061 - DNA, 20 bp, synthetic construct
  misc_feature 1..20: note = CRISPR gRNA sequence
  source 1..20: mol_type = other DNA
tgaggaaatggaggggaaga

SEQ ID NO: 3062 - DNA, 20 bp, synthetic construct
  misc_feature 1..20: note = CRISPR gRNA sequence
  source 1..20: mol_type = other DNA
aggaaatggaggggaagaca

SEQ ID NO: 3063 - DNA, 20 bp, synthetic construct
  misc_feature 1..20: note = CRISPR gRNA sequence
  source 1..20: mol_type = other DNA
gaatactgatcaggggtccc

SEQ ID NO: 3064 - DNA, 20 bp, synthetic construct
  misc_feature 1..20: note = CRISPR gRNA sequence
  source 1..20: mol_type = other DNA
atcaggggtcccctttgacc

SEQ ID NO: 3065 - DNA, 20 bp, synthetic construct
  misc_feature 1..20: note = CRISPR gRNA sequence
  source 1..20: mol_type = other DNA
tgacccctgcagcagccttg

SEQ ID NO: 3066 - DNA, 20 bp, synthetic construct
  misc_feature 1..20: note = CRISPR gRNA sequence
  source 1..20: mol_type = other DNA
gacccctgcagcagccttgg

SEQ ID NO: 3067 - DNA, 20 bp, synthetic construct
  misc_feature 1..20: note = CRISPR gRNA sequence
  source 1..20: mol_type = other DNA
acccctgcagcagccttggg

SEQ ID NO: 3068 - DNA, 20 bp, synthetic construct
  misc_feature 1..20: note = CRISPR gRNA sequence
  source 1..20: mol_type = other DNA
cagcagccttgggaaccgtg

SEQ ID NO: 3069 - DNA, 20 bp, synthetic construct
  misc_feature 1..20: note = CRISPR gRNA sequence
  source 1..20: mol_type = other DNA
gggaaccgtgacttttcctc

SEQ ID NO: 3070 - DNA, 20 bp, synthetic construct
  misc_feature 1..20: note = CRISPR gRNA sequence
  source 1..20: mol_type = other DNA
ggaaccgtgacttttcctct

SEQ ID NO: 3071 - DNA, 20 bp, synthetic construct
  misc_feature 1..20: note = CRISPR gRNA sequence
  source 1..20: mol_type = other DNA
ttcctctcaggccttgttct

SEQ ID NO: 3072 - DNA, 20 bp, synthetic construct
  misc_feature 1..20: note = CRISPR gRNA sequence
  source 1..20: mol_type = other DNA
tcctctcaggccttgttctc

SEQ ID NO: 3073 - DNA, 20 bp, synthetic construct
  misc_feature 1..20: note = CRISPR gRNA sequence
  source 1..20: mol_type = other DNA
cctctcaggccttgttctct

SEQ ID NO: 3074 - DNA, 20 bp, synthetic construct
  misc_feature 1..20: note = CRISPR gRNA sequence
  source 1..20: mol_type = other DNA
ctctcaggccttgttctctg

SEQ ID NO: 3075 - DNA, 20 bp, synthetic construct
  misc_feature 1..20: note = CRISPR gRNA sequence
  source 1..20: mol_type = other DNA
tcaggccttgttctctgcct

SEQ ID NO: 3076 - DNA, 20 bp, synthetic construct
  misc_feature 1..20: note = CRISPR gRNA sequence
  source 1..20: mol_type = other DNA
aggccttgttctctgcctca

SEQ ID NO: 3077 - DNA, 20 bp, synthetic construct
  misc_feature 1..20: note = CRISPR gRNA sequence
  source 1..20: mol_type = other DNA
gttctctgcctcacactcag

SEQ ID NO: 3078 - DNA, 20 bp, synthetic construct
  misc_feature 1..20: note = CRISPR gRNA sequence
  source 1..20: mol_type = other DNA
ttctctgcctcacactcagt

SEQ ID NO: 3079 - DNA, 20 bp, synthetic construct
  misc_feature 1..20: note = CRISPR gRNA sequence
  source 1..20: mol_type = other DNA
tctgcctcacactcagtgtg

SEQ ID NO: 3080 - DNA, 20 bp, synthetic construct
  misc_feature 1..20: note = CRISPR gRNA sequence
  source 1..20: mol_type = other DNA
tgcctcacactcagtgtgtt

SEQ ID NO: 3081 - DNA, 20 bp, synthetic construct
  misc_feature 1..20: note = CRISPR gRNA sequence
  source 1..20: mol_type = other DNA
cctcacactcagtgtgtttg

SEQ ID NO: 3082 - DNA, 20 bp, synthetic construct
  misc_feature 1..20: note = CRISPR gRNA sequence
  source 1..20: mol_type = other DNA
acactcagtgtgtttggggc

SEQ ID NO: 3083 - DNA, 20 bp, synthetic construct
  misc_feature 1..20: note = CRISPR gRNA sequence
  source 1..20: mol_type = other DNA
agtgtgtttggggctctgat

SEQ ID NO: 3084 - DNA, 20 bp, synthetic construct
  misc_feature 1..20: note = CRISPR gRNA sequence
  source 1..20: mol_type = other DNA
ggggctctgattccagcact

SEQ ID NO: 3085 - DNA, 20 bp, synthetic construct
  misc_feature 1..20: note = CRISPR gRNA sequence
  source 1..20: mol_type = other DNA
gggctctgattccagcactt

SEQ ID NO: 3086 - DNA, 20 bp, synthetic construct
  misc_feature 1..20: note = CRISPR gRNA sequence
  source 1..20: mol_type = other DNA
tgattccagcacttctgagt

SEQ ID NO: 3087 - DNA, 20 bp, synthetic construct
  misc_feature 1..20: note = CRISPR gRNA sequence
  source 1..20: mol_type = other DNA
attccagcacttctgagtca

SEQ ID NO: 3088 - DNA, 20 bp, synthetic construct
  misc_feature 1..20: note = CRISPR gRNA sequence
  source 1..20: mol_type = other DNA
cagcacttctgagtcacttt

SEQ ID NO: 3089 - DNA, 20 bp, synthetic construct
  misc_feature 1..20: note = CRISPR gRNA sequence
  source 1..20: mol_type = other DNA
ctgagtcactttacctccac

SEQ ID NO: 3090 - DNA, 20 bp, synthetic construct
  misc_feature 1..20: note = CRISPR gRNA sequence
  source 1..20: mol_type = other DNA
tgagtcactttacctccact

SEQ ID NO: 3091 - DNA, 20 bp, synthetic construct
  misc_feature 1..20: note = CRISPR gRNA sequence
  source 1..20: mol_type = other DNA
agtcactttacctccactca

SEQ ID NO: 3092 - DNA, 20 bp, synthetic construct
  misc_feature 1..20: note = CRISPR gRNA sequence
  source 1..20: mol_type = other DNA
tacctccactcagatcagga

SEQ ID NO: 3093 - DNA, 20 bp, synthetic construct
  misc_feature 1..20: note = CRISPR gRNA sequence
  source 1..20: mol_type = other DNA
acctccactcagatcaggag

SEQ ID NO: 3094 - DNA, 20 bp, synthetic construct
  misc_feature 1..20: note = CRISPR gRNA sequence
  source 1..20: mol_type = other DNA
cctccactcagatcaggagc

SEQ ID NO: 3095 - DNA, 20 bp, synthetic construct
  misc_feature 1..20: note = CRISPR gRNA sequence
  source 1..20: mol_type = other DNA
cactcagatcaggagcagaa

SEQ ID NO: 3096 - DNA, 20 bp, synthetic construct
  misc_feature 1..20: note = CRISPR gRNA sequence
  source 1..20: mol_type = other DNA
agatcaggagcagaagtccc

SEQ ID NO: 3097 - DNA, 20 bp, synthetic construct
  misc_feature 1..20: note = CRISPR gRNA sequence
  source 1..20: mol_type = other DNA
ttccccgctcagagactcga

SEQ ID NO: 3098 - DNA, 20 bp, synthetic construct
  misc_feature 1..20: note = CRISPR gRNA sequence
  source 1..20: mol_type = other DNA
cccgctcagagactcgaact

SEQ ID NO: 3099 - DNA, 20 bp, synthetic construct
  misc_feature 1..20: note = CRISPR gRNA sequence
  source 1..20: mol_type = other DNA
agagactcgaactttccaat

SEQ ID NO: 3100 - DNA, 20 bp, synthetic construct
  misc_feature 1..20: note = CRISPR gRNA sequence
  source 1..20: mol_type = other DNA
gaactttccaatgaatagga

SEQ ID NO: 3101 - DNA, 20 bp, synthetic construct
  misc_feature 1..20: note = CRISPR gRNA sequence
  source 1..20: mol_type = other DNA
tccaatgaataggagattat

SEQ ID NO: 3102 - DNA, 20 bp, synthetic construct
  misc_feature 1..20: note = CRISPR gRNA sequence
  source 1..20: mol_type = other DNA
ccaatgaataggagattatc

SEQ ID NO: 3103 - DNA, 20 bp, synthetic construct
  misc_feature 1..20: note = CRISPR gRNA sequence
  source 1..20: mol_type = other DNA
caatgaataggagattatcc

SEQ ID NO: 3104 - DNA, 20 bp, synthetic construct
  misc_feature 1..20: note = CRISPR gRNA sequence
  source 1..20: mol_type = other DNA
tcccaggtgcctgcgtccag

SEQ ID NO: 3105 - DNA, 20 bp, synthetic construct
  misc_feature 1..20: note = CRISPR gRNA sequence
  source 1..20: mol_type = other DNA
cgtccaggctggtgtctggg

SEQ ID NO: 3106 - DNA, 20 bp, synthetic construct
  misc_feature 1..20: note = CRISPR gRNA sequence
  source 1..20: mol_type = other DNA
gtgtctgggttctgtgcccc

SEQ ID NO: 3107 - DNA, 20 bp, synthetic construct
  misc_feature 1..20: note = CRISPR gRNA sequence
  source 1..20: mol_type = other DNA
ggttctgtgccccttcccca

SEQ ID NO: 3108 - DNA, 20 bp, synthetic construct
  misc_feature 1..20: note = CRISPR gRNA sequence
  source 1..20: mol_type = other DNA
tgtgccccttccccacccca

SEQ ID NO: 3109 - DNA, 20 bp, synthetic construct
  misc_feature 1..20: note = CRISPR gRNA sequence
  source 1..20: mol_type = other DNA
tgccccttccccaccccagg

SEQ ID NO: 3110 - DNA, 20 bp, synthetic construct
  misc_feature 1..20: note = CRISPR gRNA sequence
  source 1..20: mol_type = other DNA
ccccaccccaggtgtcctgt

SEQ ID NO: 3111 - DNA, 20 bp, synthetic construct
  misc_feature 1..20: note = CRISPR gRNA sequence
  source 1..20: mol_type = other DNA
cccaccccaggtgtcctgtc

SEQ ID NO: 3112 - DNA, 20 bp, synthetic construct
  misc_feature 1..20: note = CRISPR gRNA sequence
  source 1..20: mol_type = other DNA
tccattctcaggctggtcac

SEQ ID NO: 3113 - DNA, 20 bp, synthetic construct
  misc_feature 1..20: note = CRISPR gRNA sequence
  source 1..20: mol_type = other DNA
tcaggctggtcacatgggtg

SEQ ID NO: 3114 - DNA, 20 bp, synthetic construct
  misc_feature 1..20: note = CRISPR gRNA sequence
  source 1..20: mol_type = other DNA
aggctggtcacatgggtggt

SEQ ID NO: 3115 - DNA, 20 bp, synthetic construct
  misc_feature 1..20: note = CRISPR gRNA sequence
  source 1..20: mol_type = other DNA
gtcacatgggtggtcctagg

SEQ ID NO: 3116 - DNA, 20 bp, synthetic construct
  misc_feature 1..20: note = CRISPR gRNA sequence
  source 1..20: mol_type = other DNA
gggtgtcccatgaaagatgc

SEQ ID NO: 3117 - DNA, 20 bp, synthetic construct
  misc_feature 1..20: note = CRISPR gRNA sequence
  source 1..20: mol_type = other DNA
aattttctgactcttcccat

SEQ ID NO: 3118 - DNA, 20 bp, synthetic construct
  misc_feature 1..20: note = CRISPR gRNA sequence
  source 1..20: mol_type = other DNA
tctgactcttcccatcagac

SEQ ID NO: 3119 - DNA, 20 bp, synthetic construct
  misc_feature 1..20: note = CRISPR gRNA sequence
  source 1..20: mol_type = other DNA
ctgactcttcccatcagacc

SEQ ID NO: 3120 - DNA, 20 bp, synthetic construct
  misc_feature 1..20: note = CRISPR gRNA sequence
  source 1..20: mol_type = other DNA
tgactcttcccatcagaccc

SEQ ID NO: 3121 - DNA, 20 bp, synthetic construct
  misc_feature 1..20: note = CRISPR gRNA sequence
  source 1..20: mol_type = other DNA
actcttcccatcagaccccc

SEQ ID NO: 3122 - DNA, 20 bp, synthetic construct
  misc_feature 1..20: note = CRISPR gRNA sequence
  source 1..20: mol_type = other DNA
ttcccatcagaccccccaaa

SEQ ID NO: 3123 - DNA, 20 bp, synthetic construct
  misc_feature 1..20: note = CRISPR gRNA sequence
  source 1..20: mol_type = other DNA
cccatcagaccccccaaaga

SEQ ID NO: 3124 - DNA, 20 bp, synthetic construct
  misc_feature 1..20: note = CRISPR gRNA sequence
  source 1..20: mol_type = other DNA
ccatcagaccccccaaagac

SEQ ID NO: 3125 - DNA, 20 bp, synthetic construct
  misc_feature 1..20: note = CRISPR gRNA sequence
  source 1..20: mol_type = other DNA
tgaccatgaggccaccctga

SEQ ID NO: 3126 - DNA, 20 bp, synthetic construct
  misc_feature 1..20: note = CRISPR gRNA sequence
  source 1..20: mol_type = other DNA
accatgaggccaccctgagg

SEQ ID NO: 3127 - DNA, 20 bp, synthetic construct
  misc_feature 1..20: note = CRISPR gRNA sequence
  source 1..20: mol_type = other DNA
aggtgctgggccctgggttt

SEQ ID NO: 3128 - DNA, 20 bp, synthetic construct
  misc_feature 1..20: note = CRISPR gRNA sequence
  source 1..20: mol_type = other DNA
ggccctgggtttctaccctg

SEQ ID NO: 3129 - DNA, 20 bp, synthetic construct
  misc_feature 1..20: note = CRISPR gRNA sequence
  source 1..20: mol_type = other DNA
ggtttctaccctgcggagat

SEQ ID NO: 3130 - DNA, 20 bp, synthetic construct
  misc_feature 1..20: note = CRISPR gRNA sequence
  source 1..20: mol_type = other DNA
ctaccctgcggagatcacac

SEQ ID NO: 3131 - DNA, 20 bp, synthetic construct
  misc_feature 1..20: note = CRISPR gRNA sequence
  source 1..20: mol_type = other DNA
taccctgcggagatcacact

SEQ ID NO: 3132 - DNA, 20 bp, synthetic construct
  misc_feature 1..20: note = CRISPR gRNA sequence
  source 1..20: mol_type = other DNA
ccctgcggagatcacactga

SEQ ID NO: 3133 - DNA, 20 bp, synthetic construct
  misc_feature 1..20: note = CRISPR gRNA sequence
  source 1..20: mol_type = other DNA
cggagatcacactgacctgg

SEQ ID NO: 3134 - DNA, 20 bp, synthetic construct
  misc_feature 1..20: note = CRISPR gRNA sequence
  source 1..20: mol_type = other DNA
acctggcagcgggatggcga

SEQ ID NO: 3135 - DNA, 20 bp, synthetic construct
  misc_feature 1..20: note = CRISPR gRNA sequence
  source 1..20: mol_type = other DNA
gcagcgggatggcgaggacc

SEQ ID NO: 3136 - DNA, 20 bp, synthetic construct
  misc_feature 1..20: note = CRISPR gRNA sequence
  source 1..20: mol_type = other DNA
aggacactgagcttgtggag

SEQ ID NO: 3137 - DNA, 20 bp, synthetic construct
  misc_feature 1..20: note = CRISPR gRNA sequence
  source 1..20: mol_type = other DNA
agcttgtggagaccagacca

SEQ ID NO: 3138 - DNA, 20 bp, synthetic construct
  misc_feature 1..20: note = CRISPR gRNA sequence
  source 1..20: mol_type = other DNA
gtggagaccagaccagcagg

SEQ ID NO: 3139 - DNA, 20 bp, synthetic construct
  misc_feature 1..20: note = CRISPR gRNA sequence
  source 1..20: mol_type = other DNA
tggagaccagaccagcagga

SEQ ID NO: 3140 - DNA, 20 bp, synthetic construct
  misc_feature 1..20: note = CRISPR gRNA sequence
  source 1..20: mol_type = other DNA
ccagaagtgggcagctgtgg

SEQ ID NO: 3141 - DNA, 20 bp, synthetic construct
  misc_feature 1..20: note = CRISPR gRNA sequence
  source 1..20: mol_type = other DNA
cagaagtgggcagctgtggt

SEQ ID NO: 3142 - DNA, 20 bp, synthetic construct
  misc_feature 1..20: note = CRISPR gRNA sequence
  source 1..20: mol_type = other DNA
tggtggtgccttctggagaa

SEQ ID NO: 3143 - DNA, 20 bp, synthetic construct
  misc_feature 1..20: note = CRISPR gRNA sequence
  source 1..20: mol_type = other DNA
ctggagaagagcagagatac

SEQ ID NO: 3144 - DNA, 20 bp, synthetic construct
  misc_feature 1..20: note = CRISPR gRNA sequence
  source 1..20: mol_type = other DNA
tggagaagagcagagataca

SEQ ID NO: 3145 - DNA, 20 bp, synthetic construct
  misc_feature 1..20: note = CRISPR gRNA sequence
  source 1..20: mol_type = other DNA
gagaagagcagagatacaca

SEQ ID NO: 3146 - DNA, 20 bp, synthetic construct
  misc_feature 1..20: note = CRISPR gRNA sequence
  source 1..20: mol_type = other DNA
ccgaagcccctcaccctgag

SEQ ID NO: 3147 - DNA, 20 bp, synthetic construct
  misc_feature 1..20: note = CRISPR gRNA sequence
  source 1..20: mol_type = other DNA
accctgagatggggtaagga

SEQ ID NO: 3148 - DNA, 20 bp, synthetic construct
  misc_feature 1..20: note = CRISPR gRNA sequence
  source 1..20: mol_type = other DNA
agatggggtaaggaggggga

SEQ ID NO: 3149 - DNA, 20 bp, synthetic construct
  misc_feature 1..20: note = CRISPR gRNA sequence
  source 1..20: mol_type = other DNA
ttctcagggaaagcaggagc

SEQ ID NO: 3150 - DNA, 20 bp, synthetic construct
  misc_feature 1..20: note = CRISPR gRNA sequence
  source 1..20: mol_type = other DNA
ctcagggaaagcaggagccc

SEQ ID NO: 3151 - DNA, 20 bp, synthetic construct
  misc_feature 1..20: note = CRISPR gRNA sequence
  source 1..20: mol_type = other DNA
tcagggaaagcaggagccct

SEQ ID NO: 3152 - DNA, 20 bp, synthetic construct
  misc_feature 1..20: note = CRISPR gRNA sequence
  source 1..20: mol_type = other DNA
agggaaagcaggagcccttc

SEQ ID NO: 3153 - DNA, 20 bp, synthetic construct
  misc_feature 1..20: note = CRISPR gRNA sequence
  source 1..20: mol_type = other DNA
cagcagggtcagggcccctc

SEQ ID NO: 3154 - DNA, 20 bp, synthetic construct
  misc_feature 1..20: note = CRISPR gRNA sequence
  source 1..20: mol_type = other DNA
agcagggtcagggcccctca

SEQ ID NO: 3155 - DNA, 20 bp, synthetic construct
  misc_feature 1..20: note = CRISPR gRNA sequence
  source 1..20: mol_type = other DNA
atcttcccctcctttcccag

SEQ ID NO: 3156 - DNA, 20 bp, synthetic construct
  misc_feature 1..20: note = CRISPR gRNA sequence
  source 1..20: mol_type = other DNA
cccctcctttcccagagccg

SEQ ID NO: 3157 - DNA, 20 bp, synthetic construct
  misc_feature 1..20: note = CRISPR gRNA sequence
  source 1..20: mol_type = other DNA
ccctcctttcccagagccgt

SEQ ID NO: 3158 - DNA, 20 bp, synthetic construct
  misc_feature 1..20: note = CRISPR gRNA sequence
  source 1..20: mol_type = other DNA
ctttcccagagccgtcttcc

SEQ ID NO: 3159 - DNA, 20 bp, synthetic construct
  misc_feature 1..20: note = CRISPR gRNA sequence
  source 1..20: mol_type = other DNA
tcccagagccgtcttcccag

SEQ ID NO: 3160 - DNA, 20 bp, synthetic construct
  misc_feature 1..20: note = CRISPR gRNA sequence
  source 1..20: mol_type = other DNA
cccagagccgtcttcccagt

SEQ ID NO: 3161 - DNA, 20 bp, synthetic construct
  misc_feature 1..20: note = CRISPR gRNA sequence
  source 1..20: mol_type = other DNA
ccagagccgtcttcccagtc

SEQ ID NO: 3162 - DNA, 20 bp, synthetic construct
  misc_feature 1..20: note = CRISPR gRNA sequence
  source 1..20: mol_type = other DNA
cccagtccaccgtccccatc

SEQ ID NO: 3163 - DNA, 20 bp, synthetic construct
  misc_feature 1..20: note = CRISPR gRNA sequence
  source 1..20: mol_type = other DNA
ccagtccaccgtccccatcg

SEQ ID NO: 3164 - DNA, 20 bp, synthetic construct
  misc_feature 1..20: note = CRISPR gRNA sequence
  source 1..20: mol_type = other DNA
ttgctggcctggctgtccta

SEQ ID NO: 3165 - DNA, 20 bp, synthetic construct
  misc_feature 1..20: note = CRISPR gRNA sequence
  source 1..20: mol_type = other DNA
ctggcctggctgtcctagca

SEQ ID NO: 3166 - DNA, 20 bp, synthetic construct
  misc_feature 1..20: note = CRISPR gRNA sequence
  source 1..20: mol_type = other DNA
gcctggctgtcctagcagtt

SEQ ID NO: 3167 - DNA, 20 bp, synthetic construct
  misc_feature 1..20: note = CRISPR gRNA sequence
  source 1..20: mol_type = other DNA
gctgtcctagcagttgtggt

SEQ ID NO: 3168 - DNA, 20 bp, synthetic construct
  misc_feature 1..20: note = CRISPR gRNA sequence
  source 1..20: mol_type = other DNA
tcctagcagttgtggtcatc

SEQ ID NO: 3169 - DNA, 20 bp, synthetic construct
  misc_feature 1..20: note = CRISPR gRNA sequence
  source 1..20: mol_type = other DNA
gcagttgtggtcatcggagc

SEQ ID NO: 3170 - DNA, 20 bp, synthetic construct
  misc_feature 1..20: note = CRISPR gRNA sequence
  source 1..20: mol_type = other DNA
tggtcatcggagctgtggtc

SEQ ID NO: 3171 - DNA, 20 bp, synthetic construct
  misc_feature 1..20: note = CRISPR gRNA sequence
  source 1..20: mol_type = other DNA
tggtcgctgctgtgatgtgt

SEQ ID NO: 3172 - DNA, 20 bp, synthetic construct
  misc_feature 1..20: note = CRISPR gRNA sequence
  source 1..20: mol_type = other DNA
ctgtgatgtgtaggaggaag

SEQ ID NO: 3173 - DNA, 20 bp, synthetic construct
  misc_feature 1..20: note = CRISPR gRNA sequence
  source 1..20: mol_type = other DNA
tgatgtgtaggaggaagagt

SEQ ID NO: 3174 - DNA, 20 bp, synthetic construct
  misc_feature 1..20: note = CRISPR gRNA sequence
  source 1..20: mol_type = other DNA
aggtagggaaggggtgaggg

SEQ ID NO: 3175 - DNA, 20 bp, synthetic construct
  misc_feature 1..20: note = CRISPR gRNA sequence
  source 1..20: mol_type = other DNA
ggttttcttgtcccactggg

SEQ ID NO: 3176 - DNA, 20 bp, synthetic construct
  misc_feature 1..20: note = CRISPR gRNA sequence
  source 1..20: mol_type = other DNA
tcttgtcccactgggggttt

SEQ ID NO: 3177 - DNA, 20 bp, synthetic construct
  misc_feature 1..20: note = CRISPR gRNA sequence
  source 1..20: mol_type = other DNA
cttgtcccactgggggtttc

SEQ ID NO: 3178 - DNA, 20 bp, synthetic construct
  misc_feature 1..20: note = CRISPR gRNA sequence
  source 1..20: mol_type = other DNA
ttgtcccactgggggtttca

SEQ ID NO: 3179 - DNA, 20 bp, synthetic construct
  misc_feature 1..20: note = CRISPR gRNA sequence
  source 1..20: mol_type = other DNA
gtcccactgggggtttcaag

SEQ ID NO: 3180 - DNA, 20 bp, synthetic construct
  misc_feature 1..20: note = CRISPR gRNA sequence
  source 1..20: mol_type = other DNA
tcccactgggggtttcaagc

SEQ ID NO: 3181 - DNA, 20 bp, synthetic construct
  misc_feature 1..20: note = CRISPR gRNA sequence
  source 1..20: mol_type = other DNA
ggggtttcaagccccaggta

SEQ ID NO: 3182 - DNA, 20 bp, synthetic construct
  misc_feature 1..20: note = CRISPR gRNA sequence
  source 1..20: mol_type = other DNA
caagccccaggtagaagtgt

SEQ ID NO: 3183 - DNA, 20 bp, synthetic construct
  misc_feature 1..20: note = CRISPR gRNA sequence
  source 1..20: mol_type = other DNA
aagccccaggtagaagtgtt

SEQ ID NO: 3184 - DNA, 20 bp, synthetic construct
  misc_feature 1..20: note = CRISPR gRNA sequence
  source 1..20: mol_type = other DNA
cctgcctcattactgggaag

SEQ ID NO: 3185 - DNA, 20 bp, synthetic construct
  misc_feature 1..20: note = CRISPR gRNA sequence
  source 1..20: mol_type = other DNA
cctcattactgggaagcagc

SEQ ID NO: 3186 - DNA, 20 bp, synthetic construct
  misc_feature 1..20: note = CRISPR gRNA sequence
  source 1..20: mol_type = other DNA
attactgggaagcagcatgc

SEQ ID NO: 3187 - DNA, 20 bp, synthetic construct
  misc_feature 1..20: note = CRISPR gRNA sequence
  source 1..20: mol_type = other DNA
ctgggaagcagcatgcacac

SEQ ID NO: 3188 - DNA, 20 bp, synthetic construct
  misc_feature 1..20: note = CRISPR gRNA sequence
  source 1..20: mol_type = other DNA
ggaagcagcatgcacacagg

SEQ ID NO: 3189 - DNA, 20 bp, synthetic construct
  misc_feature 1..20: note = CRISPR gRNA sequence
  source 1..20: mol_type = other DNA
acgcagcctgggaccctgtg

SEQ ID NO: 3190 - DNA, 20 bp, synthetic construct
  misc_feature 1..20: note = CRISPR gRNA sequence
  source 1..20: mol_type = other DNA
ggaccctgtgtgccagcact

SEQ ID NO: 3191 - DNA, 20 bp, synthetic construct
  misc_feature 1..20: note = CRISPR gRNA sequence
  source 1..20: mol_type = other DNA
tgtgccagcacttactcttt

SEQ ID NO: 3192 - DNA, 20 bp, synthetic construct
  misc_feature 1..20: note = CRISPR gRNA sequence
  source 1..20: mol_type = other DNA
actcttttgtgcagcacatg

SEQ ID NO: 3193 - DNA, 20 bp, synthetic construct
  misc_feature 1..20: note = CRISPR gRNA sequence
  source 1..20: mol_type = other DNA
ctcttttgtgcagcacatgt

SEQ ID NO: 3194 - DNA, 20 bp, synthetic construct
  misc_feature 1..20: note = CRISPR gRNA sequence
  source 1..20: mol_type = other DNA
ttttgtgcagcacatgtgac

SEQ ID NO: 3195 - DNA, 20 bp, synthetic construct
  misc_feature 1..20: note = CRISPR gRNA sequence
  source 1..20: mol_type = other DNA
ttgtgcagcacatgtgacaa

SEQ ID NO: 3196 - DNA, 20 bp, synthetic construct
  misc_feature 1..20: note = CRISPR gRNA sequence
  source 1..20: mol_type = other DNA
tgtgcagcacatgtgacaat

SEQ ID NO: 3197 - DNA, 20 bp, synthetic construct
  misc_feature 1..20: note = CRISPR gRNA sequence
  source 1..20: mol_type = other DNA
gtgcagcacatgtgacaatg

SEQ ID NO: 3198 - DNA, 20 bp, synthetic construct
  misc_feature 1..20: note = CRISPR gRNA sequence
  source 1..20: mol_type = other DNA
tgcagcacatgtgacaatga

SEQ ID NO: 3199 - DNA, 20 bp, synthetic construct
  misc_feature 1..20: note = CRISPR gRNA sequence
  source 1..20: mol_type = other DNA
gatggttgtggtgttggggt

SEQ ID NO: 3200 - DNA, 20 bp, synthetic construct
  misc_feature 1..20: note = CRISPR gRNA sequence
  source 1..20: mol_type = other DNA
atggttgtggtgttggggtc

SEQ ID NO: 3201 - DNA, 20 bp, synthetic construct
  misc_feature 1..20: note = CRISPR gRNA sequence
  source 1..20: mol_type = other DNA
tggtgttggggtcctgattc

SEQ ID NO: 3202 - DNA, 20 bp, synthetic construct
  misc_feature 1..20: note = CRISPR gRNA sequence
  source 1..20: mol_type = other DNA
gggtcctgattccagcattc

SEQ ID NO: 3203 - DNA, 20 bp, synthetic construct
  misc_feature 1..20: note = CRISPR gRNA sequence
  source 1..20: mol_type = other DNA
attccagcattcatgagtca

SEQ ID NO: 3204 - DNA, 20 bp, synthetic construct
  misc_feature 1..20: note = CRISPR gRNA sequence
  source 1..20: mol_type = other DNA
cagcattcatgagtcagggg

SEQ ID NO: 3205 - DNA, 20 bp, synthetic construct
  misc_feature 1..20: note = CRISPR gRNA sequence
  source 1..20: mol_type = other DNA
atgagtcaggggaaggtccc

SEQ ID NO: 3206 - DNA, 20 bp, synthetic construct
  misc_feature 1..20: note = CRISPR gRNA sequence
  source 1..20: mol_type = other DNA
ctaaggacagaccttaggag

SEQ ID NO: 3207 - DNA, 20 bp, synthetic construct
  misc_feature 1..20: note = CRISPR gRNA sequence
  source 1..20: mol_type = other DNA
aggacagaccttaggagggc

SEQ ID NO: 3208 - DNA, 20 bp, synthetic construct
  misc_feature 1..20: note = CRISPR gRNA sequence
  source 1..20: mol_type = other DNA
aggagggcagttggtccagg

SEQ ID NO: 3209 - DNA, 20 bp, synthetic construct
  misc_feature 1..20: note = CRISPR gRNA sequence
  source 1..20: mol_type = other DNA
ggagggcagttggtccagga

SEQ ID NO: 3210 - DNA, 20 bp, synthetic construct
  misc_feature 1..20: note = CRISPR gRNA sequence
  source 1..20: mol_type = other DNA
gtccaggacccacacttgct

SEQ ID NO: 3211 - DNA, 20 bp, synthetic construct
  misc_feature 1..20: note = CRISPR gRNA sequence
  source 1..20: mol_type = other DNA
gctttcctcgtgtttcctga

SEQ ID NO: 3212 - DNA, 20 bp, synthetic construct
  misc_feature 1..20: note = CRISPR gRNA sequence
  source 1..20: mol_type = other DNA
ctttcctcgtgtttcctgat

SEQ ID NO: 3213 - DNA, 20 bp, synthetic construct
  misc_feature 1..20: note = CRISPR gRNA sequence
  source 1..20: mol_type = other DNA
tcctcgtgtttcctgatcct

SEQ ID NO: 3214 - DNA, 20 bp, synthetic construct
  misc_feature 1..20: note = CRISPR gRNA sequence
  source 1..20: mol_type = other DNA
cctcgtgtttcctgatcctg

SEQ ID NO: 3215 - DNA, 20 bp, synthetic construct
  misc_feature 1..20: note = CRISPR gRNA sequence
  source 1..20: mol_type = other DNA
ctcgtgtttcctgatcctgc

SEQ ID NO: 3216 - DNA, 20 bp, synthetic construct
  misc_feature 1..20: note = CRISPR gRNA sequence
  source 1..20: mol_type = other DNA
gtgtttcctgatcctgccct

SEQ ID NO: 3217 - DNA, 20 bp, synthetic construct
  misc_feature 1..20: note = CRISPR gRNA sequence
  source 1..20: mol_type = other DNA
cctgatcctgccctgggtct

SEQ ID NO: 3218 - DNA, 20 bp, synthetic construct
  misc_feature 1..20: note = CRISPR gRNA sequence
  source 1..20: mol_type = other DNA
ctgatcctgccctgggtctg

SEQ ID NO: 3219 - DNA, 20 bp, synthetic construct
  misc_feature 1..20: note = CRISPR gRNA sequence
  source 1..20: mol_type = other DNA
atcctgccctgggtctgtag

SEQ ID NO: 3220 - DNA, 20 bp, synthetic construct
  misc_feature 1..20: note = CRISPR gRNA sequence
  source 1..20: mol_type = other DNA
ccctgggtctgtagtcatac

SEQ ID NO: 3221 - DNA, 20 bp, synthetic construct
  misc_feature 1..20: note = CRISPR gRNA sequence
  source 1..20: mol_type = other DNA
ggtctgtagtcatacttctg

SEQ ID NO: 3222 - DNA, 20 bp, synthetic construct
  misc_feature 1..20: note = CRISPR gRNA sequence
  source 1..20: mol_type = other DNA
tagtcatacttctggaaatt

SEQ ID NO: 3223 - DNA, 20 bp, synthetic construct
  misc_feature 1..20: note = CRISPR gRNA sequence
  source 1..20: mol_type = other DNA
ctggaaattccttttgggtc

SEQ ID NO: 3224 - DNA, 20 bp, synthetic construct
  misc_feature 1..20: note = CRISPR gRNA sequence
  source 1..20: mol_type = other DNA
tggaaattccttttgggtcc

SEQ ID NO: 3225 - DNA, 20 bp, synthetic construct
  misc_feature 1..20: note = CRISPR gRNA sequence
  source 1..20: mol_type = other DNA
gaaattccttttgggtccaa

SEQ ID NO: 3226 - DNA, 20 bp, synthetic construct
  misc_feature 1..20: note = CRISPR gRNA sequence
  source 1..20: mol_type = other DNA
cttttgggtccaagactagg

SEQ ID NO: 3227 - DNA, 20 bp, synthetic construct
  misc_feature 1..20: note = CRISPR gRNA sequence
  source 1..20: mol_type = other DNA
ttgggtccaagactaggagg

SEQ ID NO: 3228 - DNA, 20 bp, synthetic construct
  misc_feature 1..20: note = CRISPR gRNA sequence
  source 1..20: mol_type = other DNA
tgggtccaagactaggaggt

SEQ ID NO: 3229 - DNA, 20 bp, synthetic construct
  misc_feature 1..20: note = CRISPR gRNA sequence
  source 1..20: mol_type = other DNA
gggtccaagactaggaggtt

SEQ ID NO: 3230 - DNA, 20 bp, synthetic construct
  misc_feature 1..20: note = CRISPR gRNA sequence
  source 1..20: mol_type = other DNA
ggtccaagactaggaggttc

SEQ ID NO: 3231 - DNA, 20 bp, synthetic construct
  misc_feature 1..20: note = CRISPR gRNA sequence
  source 1..20: mol_type = other DNA
ggaggttcctctaagatctc

SEQ ID NO: 3232 - DNA, 20 bp, synthetic construct
  misc_feature 1..20: note = CRISPR gRNA sequence
  source 1..20: mol_type = other DNA
ctctaagatctcatggccct

SEQ ID NO: 3233 - DNA, 20 bp, synthetic construct
  misc_feature 1..20: note = CRISPR gRNA sequence
  source 1..20: mol_type = other DNA
taagatctcatggccctgct

SEQ ID NO: 3234 - DNA, 20 bp, synthetic construct
  misc_feature 1..20: note = CRISPR gRNA sequence
  source 1..20: mol_type = other DNA
agatctcatggccctgcttc

SEQ ID NO: 3235 - DNA, 20 bp, synthetic construct
  misc_feature 1..20: note = CRISPR gRNA sequence
  source 1..20: mol_type = other DNA
atggccctgcttcctcccag

SEQ ID NO: 3236 - DNA, 20 bp, synthetic construct
  misc_feature 1..20: note = CRISPR gRNA sequence
  source 1..20: mol_type = other DNA
cttcctcccagtgccctcac

SEQ ID NO: 3237 - DNA, 20 bp, synthetic construct
  misc_feature 1..20: note = CRISPR gRNA sequence
  source 1..20: mol_type = other DNA
cctcccagtgccctcacagg

SEQ ID NO: 3238 - DNA, 20 bp, synthetic construct
  misc_feature 1..20: note = CRISPR gRNA sequence
  source 1..20: mol_type = other DNA
ctcccagtgccctcacagga

SEQ ID NO: 3239 - DNA, 20 bp, synthetic construct
  misc_feature 1..20: note = CRISPR gRNA sequence
  source 1..20: mol_type = other DNA
ccagtgccctcacaggacat

SEQ ID NO: 3240 - DNA, 20 bp, synthetic construct
  misc_feature 1..20: note = CRISPR gRNA sequence
  source 1..20: mol_type = other DNA
acaggacattttcttcccac

SEQ ID NO: 3241 - DNA, 20 bp, synthetic construct
  misc_feature 1..20: note = CRISPR gRNA sequence
  source 1..20: mol_type = other DNA
tcttcccacaggtggaaaag

SEQ ID NO: 3242 - DNA, 20 bp, synthetic construct
  misc_feature 1..20: note = CRISPR gRNA sequence
  source 1..20: mol_type = other DNA
cttcccacaggtggaaaagg

SEQ ID NO: 3243 - DNA, 20 bp, synthetic construct
  misc_feature 1..20: note = CRISPR gRNA sequence
  source 1..20: mol_type = other DNA
ttcccacaggtggaaaagga

SEQ ID NO: 3244 - DNA, 20 bp, synthetic construct
  misc_feature 1..20: note = CRISPR gRNA sequence
  source 1..20: mol_type = other DNA
cccacaggtggaaaaggagg

SEQ ID NO: 3245 - DNA, 20 bp, synthetic construct
  misc_feature 1..20: note = CRISPR gRNA sequence
  source 1..20: mol_type = other DNA
ccacaggtggaaaaggaggg

SEQ ID NO: 3246 - DNA, 20 bp, synthetic construct
  misc_feature 1..20: note = CRISPR gRNA sequence
  source 1..20: mol_type = other DNA
ctctcaggctgcgtgtaagt

SEQ ID NO: 3247 - DNA, 20 bp, synthetic construct
  misc_feature 1..20: note = CRISPR gRNA sequence
  source 1..20: mol_type = other DNA
tcaggctgcgtgtaagtggt

SEQ ID NO: 3248 - DNA, 20 bp, synthetic construct
  misc_feature 1..20: note = CRISPR gRNA sequence
  source 1..20: mol_type = other DNA
aggctgcgtgtaagtggtgg

SEQ ID NO: 3249 - DNA, 20 bp, synthetic construct
  misc_feature 1..20: note = CRISPR gRNA sequence
  source 1..20: mol_type = other DNA
cgtgtaagtggtgggggtgg

SEQ ID NO: 3250 - DNA, 20 bp, synthetic construct
  misc_feature 1..20: note = CRISPR gRNA sequence
  source 1..20: mol_type = other DNA
acccaccccataattcctcc

SEQ ID NO: 3251 - DNA, 20 bp, synthetic construct
  misc_feature 1..20: note = CRISPR gRNA sequence
  source 1..20: mol_type = other DNA
ctcctgtcccacgtctcctg

SEQ ID NO: 3252 - DNA, 20 bp, synthetic construct
  misc_feature 1..20: note = CRISPR gRNA sequence
  source 1..20: mol_type = other DNA
ctgtcccacgtctcctgcgg

SEQ ID NO: 3253 - DNA, 20 bp, synthetic construct
  misc_feature 1..20: note = CRISPR gRNA sequence
  source 1..20: mol_type = other DNA
tcccacgtctcctgcgggct

SEQ ID NO: 3254 - DNA, 20 bp, synthetic construct
  misc_feature 1..20: note = CRISPR gRNA sequence
  source 1..20: mol_type = other DNA
ctgcgggctctgaccaggtc

SEQ ID NO: 3255 - DNA, 20 bp, synthetic construct
  misc_feature 1..20: note = CRISPR gRNA sequence
  source 1..20: mol_type = other DNA
cgggctctgaccaggtcctg

SEQ ID NO: 3256 - DNA, 20 bp, synthetic construct
  misc_feature 1..20: note = CRISPR gRNA sequence
  source 1..20: mol_type = other DNA
tgaccaggtcctgtttttgt

SEQ ID NO: 3257 - DNA, 20 bp, synthetic construct
  misc_feature 1..20: note = CRISPR gRNA sequence
  source 1..20: mol_type = other DNA
accaggtcctgtttttgttc

SEQ ID NO: 3258 - DNA, 20 bp, synthetic construct
  misc_feature 1..20: note = CRISPR gRNA sequence
  source 1..20: mol_type = other DNA
tttttgttctactccaggca

SEQ ID NO: 3259 - DNA, 20 bp, synthetic construct
  misc_feature 1..20: note = CRISPR gRNA sequence
  source 1..20: mol_type = other DNA
ttgttctactccaggcagcg

SEQ ID NO: 3260 - DNA, 20 bp, synthetic construct
  misc_feature 1..20: note = CRISPR gRNA sequence
  source 1..20: mol_type = other DNA
tgttctactccaggcagcga

SEQ ID NO: 3261 - DNA, 20 bp, synthetic construct
  misc_feature 1..20: note = CRISPR gRNA sequence
  source 1..20: mol_type = other DNA
gttctactccaggcagcgac

SEQ ID NO: 3262 - DNA, 20 bp, synthetic construct
  misc_feature 1..20: note = CRISPR gRNA sequence
  source 1..20: mol_type = other DNA
ttctactccaggcagcgaca

SEQ ID NO: 3263 - DNA, 20 bp, synthetic construct
  misc_feature 1..20: note = CRISPR gRNA sequence
  source 1..20: mol_type = other DNA
tactccaggcagcgacagtg

SEQ ID NO: 3264 - DNA, 20 bp, synthetic construct
  misc_feature 1..20: note = CRISPR gRNA sequence
  source 1..20: mol_type = other DNA
ctccaggcagcgacagtgcc

SEQ ID NO: 3265 - DNA, 20 bp, synthetic construct
  misc_feature 1..20: note = CRISPR gRNA sequence
  source 1..20: mol_type = other DNA
caggcagcgacagtgcccag

SEQ ID NO: 3266 - DNA, 20 bp, synthetic construct
  misc_feature 1..20: note = CRISPR gRNA sequence
  source 1..20: mol_type = other DNA
tgatgtgtctctcacagctt

SEQ ID NO: 3267 - DNA, 20 bp, synthetic construct
  misc_feature 1..20: note = CRISPR gRNA sequence
  source 1..20: mol_type = other DNA
atgtgtctctcacagcttga

SEQ ID NO: 3268 - DNA, 20 bp, synthetic construct
  misc_feature 1..20: note = CRISPR gRNA sequence
  source 1..20: mol_type = other DNA
tcacagcttgaaaaggtgag

SEQ ID NO: 3269 - DNA, 20 bp, synthetic construct
  misc_feature 1..20: note = CRISPR gRNA sequence
  source 1..20: mol_type = other DNA
acagcttgaaaaggtgagat

SEQ ID NO: 3270 - DNA, 20 bp, synthetic construct
  misc_feature 1..20: note = CRISPR gRNA sequence
  source 1..20: mol_type = other DNA
gaaaaggtgagattcttggg

SEQ ID NO: 3271 - DNA, 20 bp, synthetic construct
  misc_feature 1..20: note = CRISPR gRNA sequence
  source 1..20: mol_type = other DNA
aaaaggtgagattcttgggg

SEQ ID NO: 3272 - DNA, 20 bp, synthetic construct
  misc_feature 1..20: note = CRISPR gRNA sequence
  source 1..20: mol_type = other DNA
ttggggtctagagtgggtgg

SEQ ID NO: 3273 - DNA, 20 bp, synthetic construct
  misc_feature 1..20: note = CRISPR gRNA sequence
  source 1..20: mol_type = other DNA
ggggtctagagtgggtgggg

SEQ ID NO: 3274 - DNA, 20 bp, synthetic construct
  misc_feature 1..20: note = CRISPR gRNA sequence
  source 1..20: mol_type = other DNA
gggtctagagtgggtggggt

SEQ ID NO: 3275 - DNA, 20 bp, synthetic construct
  misc_feature 1..20: note = CRISPR gRNA sequence
  source 1..20: mol_type = other DNA
gagtgggtggggtggcgggt

SEQ ID NO: 3276 - DNA, 20 bp, synthetic construct
  misc_feature 1..20: note = CRISPR gRNA sequence
  source 1..20: mol_type = other DNA
ggggtgggtggggcagaggg

SEQ ID NO: 3277 - DNA, 20 bp, synthetic construct
  misc_feature 1..20: note = CRISPR gRNA sequence
  source 1..20: mol_type = other DNA
ggtaatggggattctttgat

SEQ ID NO: 3278 - DNA, 20 bp, synthetic construct
  misc_feature 1..20: note = CRISPR gRNA sequence
  source 1..20: mol_type = other DNA
cactcgaaacgtcccaatca

SEQ ID NO: 3279 - DNA, 20 bp, synthetic construct
  misc_feature 1..20: note = CRISPR gRNA sequence
  source 1..20: mol_type = other DNA
atcaaagaatccccattacc

SEQ ID NO: 3280 - DNA, 20 bp, synthetic construct
  misc_feature 1..20: note = CRISPR gRNA sequence
  source 1..20: mol_type = other DNA
tcaaagaatccccattaccc

SEQ ID NO: 3281 - DNA, 20 bp, synthetic construct
  misc_feature 1..20: note = CRISPR gRNA sequence
  source 1..20: mol_type = other DNA
tgccccacccccgaccactt

SEQ ID NO: 3282 - DNA, 20 bp, synthetic construct
  misc_feature 1..20: note = CRISPR gRNA sequence
  source 1..20: mol_type = other DNA
ccccgaccacttcagctccc

SEQ ID NO: 3283 - DNA, 20 bp, synthetic construct
  misc_feature 1..20: note = CRISPR gRNA sequence
  source 1..20: mol_type = other DNA
ccccagaatctcacctttac

SEQ ID NO: 3284 - DNA, 20 bp, synthetic construct
  misc_feature 1..20: note = CRISPR gRNA sequence
  source 1..20: mol_type = other DNA
atctcacctttacaagtgat

SEQ ID NO: 3285 - DNA, 20 bp, synthetic construct
  misc_feature 1..20: note = CRISPR gRNA sequence
  source 1..20: mol_type = other DNA
ctcacctttacaagtgatga

SEQ ID NO: 3286 - DNA, 20 bp, synthetic construct
  misc_feature 1..20: note = CRISPR gRNA sequence
  source 1..20: mol_type = other DNA
acaagtgatgagagactcat

SEQ ID NO: 3287 - DNA, 20 bp, synthetic construct
  misc_feature 1..20: note = CRISPR gRNA sequence
  source 1..20: mol_type = other DNA
aagtgatgagagactcatca

SEQ ID NO: 3288 - DNA, 20 bp, synthetic construct
  misc_feature 1..20: note = CRISPR gRNA sequence
  source 1..20: mol_type = other DNA
tgagagactcatcagagccc

SEQ ID NO: 3289 - DNA, 20 bp, synthetic construct
  misc_feature 1..20: note = CRISPR gRNA sequence
  source 1..20: mol_type = other DNA
gagagactcatcagagccct

SEQ ID NO: 3290 - DNA, 20 bp, synthetic construct
  misc_feature 1..20: note = CRISPR gRNA sequence
  source 1..20: mol_type = other DNA
ccctgggcactgttgctgcc

SEQ ID NO: 3291 - DNA, 20 bp, synthetic construct
  misc_feature 1..20: note = CRISPR gRNA sequence
  source 1..20: mol_type = other DNA
cctgggcactgttgctgcct

SEQ ID NO: 3292 - DNA, 20 bp, synthetic construct
  misc_feature 1..20: note = CRISPR gRNA sequence
  source 1..20: mol_type = other DNA
ctgggcactgttgctgcctg

SEQ ID NO: 3293 - DNA, 20 bp, synthetic construct
  misc_feature 1..20: note = CRISPR gRNA sequence
  source 1..20: mol_type = other DNA
ggcactgttgctgcctgggg

SEQ ID NO: 3294 - DNA, 20 bp, synthetic construct
  misc_feature 1..20: note = CRISPR gRNA sequence
  source 1..20: mol_type = other DNA
cctggggtagaacaaaaaaa

SEQ ID NO: 3295 - DNA, 20 bp, synthetic construct
  misc_feature 1..20: note = CRISPR gRNA sequence
  source 1..20: mol_type = other DNA
gtagaacaaaaaaaaagacc

SEQ ID NO: 3296 - DNA, 20 bp, synthetic construct
  misc_feature 1..20: note = CRISPR gRNA sequence
  source 1..20: mol_type = other DNA
aacaaaaaaaaagacctggt

SEQ ID NO: 3297 - DNA, 20 bp, synthetic construct
  misc_feature 1..20: note = CRISPR gRNA sequence
  source 1..20: mol_type = other DNA
caaaaaaaaagacctggtca

SEQ ID NO: 3298 - DNA, 20 bp, synthetic construct
  misc_feature 1..20: note = CRISPR gRNA sequence
  source 1..20: mol_type = other DNA
aaagacctggtcagagcccg

SEQ ID NO: 3299 - DNA, 20 bp, synthetic construct
  misc_feature 1..20: note = CRISPR gRNA sequence
  source 1..20: mol_type = other DNA
aagacctggtcagagcccgc

SEQ ID NO: 3300 - DNA, 20 bp, synthetic construct
  misc_feature 1..20: note = CRISPR gRNA sequence
  source 1..20: mol_type = other DNA
gacctggtcagagcccgcag

SEQ ID NO: 3301 - DNA, 20 bp, synthetic construct
  misc_feature 1..20: note = CRISPR gRNA sequence
  source 1..20: mol_type = other DNA
gtcagagcccgcaggagatg

SEQ ID NO: 3302 - DNA, 20 bp, synthetic construct
  misc_feature 1..20: note = CRISPR gRNA sequence
  source 1..20: mol_type = other DNA
tcagagcccgcaggagatgt

SEQ ID NO: 3303 - DNA, 20 bp, synthetic construct
  misc_feature 1..20: note = CRISPR gRNA sequence
  source 1..20: mol_type = other DNA
gcccgcaggagatgtgggac

SEQ ID NO: 3304 - DNA, 20 bp, synthetic construct
  misc_feature 1..20: note = CRISPR gRNA sequence
  source 1..20: mol_type = other DNA
ccgcaggagatgtgggacaa

SEQ ID NO: 3305 - DNA, 20 bp, synthetic construct
  misc_feature 1..20: note = CRISPR gRNA sequence
  source 1..20: mol_type = other DNA
cgcaggagatgtgggacaag

SEQ ID NO: 3306 - DNA, 20 bp, synthetic construct
  misc_feature 1..20: note = CRISPR gRNA sequence
  source 1..20: mol_type = other DNA
atgtgggacaagaggaatta

SEQ ID NO: 3307 - DNA, 20 bp, synthetic construct
  misc_feature 1..20: note = CRISPR gRNA sequence
  source 1..20: mol_type = other DNA
gtgggacaagaggaattatg

SEQ ID NO: 3308 - DNA, 20 bp, synthetic construct
  misc_feature 1..20: note = CRISPR gRNA sequence
  source 1..20: mol_type = other DNA
ggacaagaggaattatggag

SEQ ID NO: 3309 - DNA, 20 bp, synthetic construct
  misc_feature 1..20: note = CRISPR gRNA sequence
  source 1..20: mol_type = other DNA
gacaagaggaattatggagt

SEQ ID NO: 3310 - DNA, 20 bp, synthetic construct
  misc_feature 1..20: note = CRISPR gRNA sequence
  source 1..20: mol_type = other DNA
agaggaattatggagtaggt

SEQ ID NO: 3311 - DNA, 20 bp, synthetic construct
  misc_feature 1..20: note = CRISPR gRNA sequence
  source 1..20: mol_type = other DNA
ccgccgccatcacttacacg

SEQ ID NO: 3312 - DNA, 20 bp, synthetic construct
  misc_feature 1..20: note = CRISPR gRNA sequence
  source 1..20: mol_type = other DNA
ccatcacttacacgcagcct

SEQ ID NO: 3313 - DNA, 20 bp, synthetic construct
  misc_feature 1..20: note = CRISPR gRNA sequence
  source 1..20: mol_type = other DNA
atcacttacacgcagcctga

SEQ ID NO: 3314 - DNA, 20 bp, synthetic construct
  misc_feature 1..20: note = CRISPR gRNA sequence
  source 1..20: mol_type = other DNA
acttacacgcagcctgagag

SEQ ID NO: 3315 - DNA, 20 bp, synthetic construct
  misc_feature 1..20: note = CRISPR gRNA sequence
  source 1..20: mol_type = other DNA
gctccctccttttccacctg

SEQ ID NO: 3316 - DNA, 20 bp, synthetic construct
  misc_feature 1..20: note = CRISPR gRNA sequence
  source 1..20: mol_type = other DNA
ctccctccttttccacctgt

SEQ ID NO: 3317 - DNA, 20 bp, synthetic construct
  misc_feature 1..20: note = CRISPR gRNA sequence
  source 1..20: mol_type = other DNA
cctccttttccacctgtggg

SEQ ID NO: 3318 - DNA, 20 bp, synthetic construct
  misc_feature 1..20: note = CRISPR gRNA sequence
  source 1..20: mol_type = other DNA
gtgggaagaaaatgccctat

SEQ ID NO: 3319 - DNA, 20 bp, synthetic construct
  misc_feature 1..20: note = CRISPR gRNA sequence
  source 1..20: mol_type = other DNA
tgggaagaaaatgccctatg

SEQ ID NO: 3320 - DNA, 20 bp, synthetic construct
  misc_feature 1..20: note = CRISPR gRNA sequence
  source 1..20: mol_type = other DNA
gggaagaaaatgccctatga

SEQ ID NO: 3321 - DNA, 20 bp, synthetic construct
  misc_feature 1..20: note = CRISPR gRNA sequence
  source 1..20: mol_type = other DNA
ggaagaaaatgccctatgag

SEQ ID NO: 3322 - DNA, 20 bp, synthetic construct
  misc_feature 1..20: note = CRISPR gRNA sequence
  source 1..20: mol_type = other DNA
aaaatgccctatgaggggac

SEQ ID NO: 3323 - DNA, 20 bp, synthetic construct
  misc_feature 1..20: note = CRISPR gRNA sequence
  source 1..20: mol_type = other DNA
aaatgccctatgaggggact

SEQ ID NO: 3324 - DNA, 20 bp, synthetic construct
  misc_feature 1..20: note = CRISPR gRNA sequence
  source 1..20: mol_type = other DNA
atgccctatgaggggactgg

SEQ ID NO: 3325 - DNA, 20 bp, synthetic construct
  misc_feature 1..20: note = CRISPR gRNA sequence
  source 1..20: mol_type = other DNA
tgccctatgaggggactggg

SEQ ID NO: 3326 - DNA, 20 bp, synthetic construct
  misc_feature 1..20: note = CRISPR gRNA sequence
  source 1..20: mol_type = other DNA
ccctatgaggggactgggag

SEQ ID NO: 3327 - DNA, 20 bp, synthetic construct
  misc_feature 1..20: note = CRISPR gRNA sequence
  source 1..20: mol_type = other DNA
cctatgaggggactgggagg

SEQ ID NO: 3328 - DNA, 20 bp, synthetic construct
  misc_feature 1..20: note = CRISPR gRNA sequence
  source 1..20: mol_type = other DNA
atgaggggactgggaggagg

SEQ ID NO: 3329 - DNA, 20 bp, synthetic construct
  misc_feature 1..20: note = CRISPR gRNA sequence
  source 1..20: mol_type = other DNA
tgaggggactgggaggaggc

SEQ ID NO: 3330 - DNA, 20 bp, synthetic construct
  misc_feature 1..20: note = CRISPR gRNA sequence
  source 1..20: mol_type = other DNA
gaggggactgggaggaggca

SEQ ID NO: 3331 - DNA, 20 bp, synthetic construct
  misc_feature 1..20: note = CRISPR gRNA sequence
  source 1..20: mol_type = other DNA
gaggcagggccatgtgatct

SEQ ID NO: 3332 - DNA, 20 bp, synthetic construct
  misc_feature 1..20: note = CRISPR gRNA sequence
  source 1..20: mol_type = other DNA
aggcagggccatgtgatctt

SEQ ID NO: 3333 - DNA, 20 bp, synthetic construct
  misc_feature 1..20: note = CRISPR gRNA sequence
  source 1..20: mol_type = other DNA
ggcagggccatgtgatctta

SEQ ID NO: 3334 - DNA, 20 bp, synthetic construct
  misc_feature 1..20: note = CRISPR gRNA sequence
  source 1..20: mol_type = other DNA
gcagggccatgtgatcttag

SEQ ID NO: 3335 - DNA, 20 bp, synthetic construct
  misc_feature 1..20: note = CRISPR gRNA sequence
  source 1..20: mol_type = other DNA
gtgatcttaggggaacctcc

SEQ ID NO: 3336 - DNA, 20 bp, synthetic construct
  misc_feature 1..20: note = CRISPR gRNA sequence
  source 1..20: mol_type = other DNA
ttaggggaacctcctagtct

SEQ ID NO: 3337 - DNA, 20 bp, synthetic construct
  misc_feature 1..20: note = CRISPR gRNA sequence
  source 1..20: mol_type = other DNA
aacctcctagtcttggaccc

SEQ ID NO: 3338 - DNA, 20 bp, synthetic construct
  misc_feature 1..20: note = CRISPR gRNA sequence
  source 1..20: mol_type = other DNA
cctcctagtcttggacccaa

SEQ ID NO: 3339 - DNA, 20 bp, synthetic construct
  misc_feature 1..20: note = CRISPR gRNA sequence
  source 1..20: mol_type = other DNA
cctagtcttggacccaagag

SEQ ID NO: 3340 - DNA, 20 bp, synthetic construct
  misc_feature 1..20: note = CRISPR gRNA sequence
  source 1..20: mol_type = other DNA
ttggacccaagagaagtttc

SEQ ID NO: 3341 - DNA, 20 bp, synthetic construct
  misc_feature 1..20: note = CRISPR gRNA sequence
  source 1..20: mol_type = other DNA
agtttccagaactacgactg

SEQ ID NO: 3342 - DNA, 20 bp, synthetic construct
  misc_feature 1..20: note = CRISPR gRNA sequence
  source 1..20: mol_type = other DNA
cagaactacgactgcagacc

SEQ ID NO: 3343 - DNA, 20 bp, synthetic construct
  misc_feature 1..20: note = CRISPR gRNA sequence
  source 1..20: mol_type = other DNA
agaactacgactgcagaccc

SEQ ID NO: 3344 - DNA, 20 bp, synthetic construct
  misc_feature 1..20: note = CRISPR gRNA sequence
  source 1..20: mol_type = other DNA
gaactacgactgcagaccca

SEQ ID NO: 3345 - DNA, 20 bp, synthetic construct
  misc_feature 1..20: note = CRISPR gRNA sequence
  source 1..20: mol_type = other DNA
ctacgactgcagacccaggg

SEQ ID NO: 3346 - DNA, 20 bp, synthetic construct
  misc_feature 1..20: note = CRISPR gRNA sequence
  source 1..20: mol_type = other DNA
tacgactgcagacccagggc

SEQ ID NO: 3347 - DNA, 20 bp, synthetic construct
  misc_feature 1..20: note = CRISPR gRNA sequence
  source 1..20: mol_type = other DNA
ctgcagacccagggcaggat

SEQ ID NO: 3348 - DNA, 20 bp, synthetic construct
  misc_feature 1..20: note = CRISPR gRNA sequence
  source 1..20: mol_type = other DNA
tgcagacccagggcaggatc

SEQ ID NO: 3349 - DNA, 20 bp, synthetic construct
  misc_feature 1..20: note = CRISPR gRNA sequence
  source 1..20: mol_type = other DNA
cagggcaggatcaggaaaca

SEQ ID NO: 3350 - DNA, 20 bp, synthetic construct
  misc_feature 1..20: note = CRISPR gRNA sequence
  source 1..20: mol_type = other DNA
agggcaggatcaggaaacat

SEQ ID NO: 3351 - DNA, 20 bp, synthetic construct
  misc_feature 1..20: note = CRISPR gRNA sequence
  source 1..20: mol_type = other DNA
gggcaggatcaggaaacatg

SEQ ID NO: 3352 - DNA, 20 bp, synthetic construct
  misc_feature 1..20: note = CRISPR gRNA sequence
  source 1..20: mol_type = other DNA
aggatcaggaaacatgggga

SEQ ID NO: 3353 - DNA, 20 bp, synthetic construct
  misc_feature 1..20: note = CRISPR gRNA sequence
  source 1..20: mol_type = other DNA
atcaggaaacatggggaaag

SEQ ID NO: 3354 - DNA, 20 bp, synthetic construct
  misc_feature 1..20: note = CRISPR gRNA sequence
  source 1..20: mol_type = other DNA
aaacatggggaaagcagttg

SEQ ID NO: 3355 - DNA, 20 bp, synthetic construct
  misc_feature 1..20: note = CRISPR gRNA sequence
  source 1..20: mol_type = other DNA
aacatggggaaagcagttgt

SEQ ID NO: 3356 - DNA, 20 bp, synthetic construct
  misc_feature 1..20: note = CRISPR gRNA sequence
  source 1..20: mol_type = other DNA
gggaaagcagttgtgggttc

SEQ ID NO: 3357 - DNA, 20 bp, synthetic construct
  misc_feature 1..20: note = CRISPR gRNA sequence
  source 1..20: mol_type = other DNA
tctggaccaactgccctcct

SEQ ID NO: 3358 - DNA, 20 bp, synthetic construct
  misc_feature 1..20: note = CRISPR gRNA sequence
  source 1..20: mol_type = other DNA
ctggaccaactgccctccta

SEQ ID NO: 3359 - DNA, 20 bp, synthetic construct
  misc_feature 1..20: note = CRISPR gRNA sequence
  source 1..20: mol_type = other DNA
gccctcctaaggtctgtcct

SEQ ID NO: 3360 - DNA, 20 bp, synthetic construct
  misc_feature 1..20: note = CRISPR gRNA sequence
  source 1..20: mol_type = other DNA
ctcctaaggtctgtccttag

SEQ ID NO: 3361 - DNA, 20 bp, synthetic construct
  misc_feature 1..20: note = CRISPR gRNA sequence
  source 1..20: mol_type = other DNA
tcctaaggtctgtccttagc

SEQ ID NO: 3362 - DNA, 20 bp, synthetic construct
  misc_feature 1..20: note = CRISPR gRNA sequence
  source 1..20: mol_type = other DNA
cctaaggtctgtccttagca

SEQ ID NO: 3363 - DNA, 20 bp, synthetic construct
  misc_feature 1..20: note = CRISPR gRNA sequence
  source 1..20: mol_type = other DNA
ttcccctgactcatgaatgc

SEQ ID NO: 3364 - DNA, 20 bp, synthetic construct
  misc_feature 1..20: note = CRISPR gRNA sequence
  source 1..20: mol_type = other DNA
tgactcatgaatgctggaat

SEQ ID NO: 3365 - DNA, 20 bp, synthetic construct
  misc_feature 1..20: note = CRISPR gRNA sequence
  source 1..20: mol_type = other DNA
gactcatgaatgctggaatc

SEQ ID NO: 3366 - DNA, 20 bp, synthetic construct
  misc_feature 1..20: note = CRISPR gRNA sequence
  source 1..20: mol_type = other DNA
accccaacaccataatcatc

SEQ ID NO: 3367 - DNA, 20 bp, synthetic construct
  misc_feature 1..20: note = CRISPR gRNA sequence
  source 1..20: mol_type = other DNA
ccccaacaccataatcatca

SEQ ID NO: 3368 - DNA, 20 bp, synthetic construct
  misc_feature 1..20: note = CRISPR gRNA sequence
  source 1..20: mol_type = other DNA
ttgtcacatgtgcttcacaa

SEQ ID NO: 3369 - DNA, 20 bp, synthetic construct
  misc_feature 1..20: note = CRISPR gRNA sequence
  source 1..20: mol_type = other DNA
gtcacatgtgcttcacaaaa

SEQ ID NO: 3370 - DNA, 20 bp, synthetic construct
  misc_feature 1..20: note = CRISPR gRNA sequence
  source 1..20: mol_type = other DNA
catgtgcttcacaaaagagt

SEQ ID NO: 3371 - DNA, 20 bp, synthetic construct
  misc_feature 1..20: note = CRISPR gRNA sequence
  source 1..20: mol_type = other DNA
cttcacaaaagagtaagtgc

SEQ ID NO: 3372 - DNA, 20 bp, synthetic construct
  misc_feature 1..20: note = CRISPR gRNA sequence
  source 1..20: mol_type = other DNA
aaagagtaagtgctggcaca

SEQ ID NO: 3373 - DNA, 20 bp, synthetic construct
  misc_feature 1..20: note = CRISPR gRNA sequence
  source 1..20: mol_type = other DNA
aagagtaagtgctggcacac

SEQ ID NO: 3374 - DNA, 20 bp, synthetic construct
  misc_feature 1..20: note = CRISPR gRNA sequence
  source 1..20: mol_type = other DNA
agagtaagtgctggcacaca

SEQ ID NO: 3375 - DNA, 20 bp, synthetic construct
  misc_feature 1..20: note = CRISPR gRNA sequence
  source 1..20: mol_type = other DNA
agtgctggcacacagggtcc

SEQ ID NO: 3376 - DNA, 20 bp, synthetic construct
  misc_feature 1..20: note = CRISPR gRNA sequence
  source 1..20: mol_type = other DNA
gtgctggcacacagggtccc

SEQ ID NO: 3377 - DNA, 20 bp, synthetic construct
  misc_feature 1..20: note = CRISPR gRNA sequence
  source 1..20: mol_type = other DNA
tggcacacagggtcccaggc

SEQ ID NO: 3378 - DNA, 20 bp, synthetic construct
  misc_feature 1..20: note = CRISPR gRNA sequence
  source 1..20: mol_type = other DNA
ggcacacagggtcccaggct

SEQ ID NO: 3379 - DNA, 20 bp, synthetic construct
  misc_feature 1..20: note = CRISPR gRNA sequence
  source 1..20: mol_type = other DNA
cacagggtcccaggctggga

SEQ ID NO: 3380 - DNA, 20 bp, synthetic construct
  misc_feature 1..20: note = CRISPR gRNA sequence
  source 1..20: mol_type = other DNA
aggctgggatggcccatgtg

SEQ ID NO: 3381 - DNA, 20 bp, synthetic construct
  misc_feature 1..20: note = CRISPR gRNA sequence
  source 1..20: mol_type = other DNA
tgggatggcccatgtgtgga

SEQ ID NO: 3382 - DNA, 20 bp, synthetic construct
  misc_feature 1..20: note = CRISPR gRNA sequence
  source 1..20: mol_type = other DNA
ccatgtgtggatggtgcttc

SEQ ID NO: 3383 - DNA, 20 bp, synthetic construct
  misc_feature 1..20: note = CRISPR gRNA sequence
  source 1..20: mol_type = other DNA
tggatggtgcttccagtaac

SEQ ID NO: 3384 - DNA, 20 bp, synthetic construct
  misc_feature 1..20: note = CRISPR gRNA sequence
  source 1..20: mol_type = other DNA
ggatggtgcttccagtaaca

SEQ ID NO: 3385 - DNA, 20 bp, synthetic construct
  misc_feature 1..20: note = CRISPR gRNA sequence
  source 1..20: mol_type = other DNA
tggtgcttccagtaacaagg

SEQ ID NO: 3386 - DNA, 20 bp, synthetic construct
  misc_feature 1..20: note = CRISPR gRNA sequence
  source 1..20: mol_type = other DNA
ggtgcttccagtaacaaggc

SEQ ID NO: 3387 - DNA, 20 bp, synthetic construct
  misc_feature 1..20: note = CRISPR gRNA sequence
  source 1..20: mol_type = other DNA
gtgcttccagtaacaaggcg

SEQ ID NO: 3388 - DNA, 20 bp, synthetic construct
  misc_feature 1..20: note = CRISPR gRNA sequence
  source 1..20: mol_type = other DNA
aggcggggcacacttctacc

SEQ ID NO: 3389 - DNA, 20 bp, synthetic construct
  misc_feature 1..20: note = CRISPR gRNA sequence
  source 1..20: mol_type = other DNA
ggcggggcacacttctacct

SEQ ID NO: 3390 - DNA, 20 bp, synthetic construct
  misc_feature 1..20: note = CRISPR gRNA sequence
  source 1..20: mol_type = other DNA
gcggggcacacttctacctg

SEQ ID NO: 3391 - DNA, 20 bp, synthetic construct
  misc_feature 1..20: note = CRISPR gRNA sequence
  source 1..20: mol_type = other DNA
tacctggggcttgaaactcc

SEQ ID NO: 3392 - DNA, 20 bp, synthetic construct
  misc_feature 1..20: note = CRISPR gRNA sequence
  source 1..20: mol_type = other DNA
ctggggcttgaaactcccag

SEQ ID NO: 3393 - DNA, 20 bp, synthetic construct
  misc_feature 1..20: note = CRISPR gRNA sequence
  source 1..20: mol_type = other DNA
tggggcttgaaactcccagt

SEQ ID NO: 3394 - DNA, 20 bp, synthetic construct
  misc_feature 1..20: note = CRISPR gRNA sequence
  source 1..20: mol_type = other DNA
cttgaaactcccagtgggac

SEQ ID NO: 3395 - DNA, 20 bp, synthetic construct
  misc_feature 1..20: note = CRISPR gRNA sequence
  source 1..20: mol_type = other DNA
cccagtgggacaagaaaacc

SEQ ID NO: 3396 - DNA, 20 bp, synthetic construct
  misc_feature 1..20: note = CRISPR gRNA sequence
  source 1..20: mol_type = other DNA
tcttcaccccttccctacct

SEQ ID NO: 3397 - DNA, 20 bp, synthetic construct
  misc_feature 1..20: note = CRISPR gRNA sequence
  source 1..20: mol_type = other DNA
gctcttcctcctacacatca

SEQ ID NO: 3398 - DNA, 20 bp, synthetic construct
  misc_feature 1..20: note = CRISPR gRNA sequence
  source 1..20: mol_type = other DNA
cttcctcctacacatcatag

SEQ ID NO: 3399 - DNA, 20 bp, synthetic construct
  misc_feature 1..20: note = CRISPR gRNA sequence
  source 1..20: mol_type = other DNA
acacatcatagcggtgacca

SEQ ID NO: 3400 - DNA, 20 bp, synthetic construct
  misc_feature 1..20: note = CRISPR gRNA sequence
  source 1..20: mol_type = other DNA
atagcggtgaccacagctcc

SEQ ID NO: 3401 - DNA, 20 bp, synthetic construct
  misc_feature 1..20: note = CRISPR gRNA sequence
  source 1..20: mol_type = other DNA
tagcggtgaccacagctcca

SEQ ID NO: 3402 - DNA, 20 bp, synthetic construct
  misc_feature 1..20: note = CRISPR gRNA sequence
  source 1..20: mol_type = other DNA
ggtgaccacagctccaagga

SEQ ID NO: 3403 - DNA, 20 bp, synthetic construct
  misc_feature 1..20: note = CRISPR gRNA sequence
  source 1..20: mol_type = other DNA
accacagctccaaggacagc

SEQ ID NO: 3404 - DNA, 20 bp, synthetic construct
  misc_feature 1..20: note = CRISPR gRNA sequence
  source 1..20: mol_type = other DNA
ccacagctccaaggacagct

SEQ ID NO: 3405 - DNA, 20 bp, synthetic construct
  misc_feature 1..20: note = CRISPR gRNA sequence
  source 1..20: mol_type = other DNA
ccaaggacagctaggacaac

SEQ ID NO: 3406 - DNA, 20 bp, synthetic construct
  misc_feature 1..20: note = CRISPR gRNA sequence
  source 1..20: mol_type = other DNA
caaggacagctaggacaacc

SEQ ID NO: 3407 - DNA, 20 bp, synthetic construct
  misc_feature 1..20: note = CRISPR gRNA sequence
  source 1..20: mol_type = other DNA
gacagctaggacaaccagga

SEQ ID NO: 3408 - DNA, 20 bp, synthetic construct
  misc_feature 1..20: note = CRISPR gRNA sequence
  source 1..20: mol_type = other DNA
gctaggacaaccaggacagc

SEQ ID NO: 3409 - DNA, 20 bp, synthetic construct
  misc_feature 1..20: note = CRISPR gRNA sequence
  source 1..20: mol_type = other DNA
ctaggacaaccaggacagcc

SEQ ID NO: 3410 - DNA, 20 bp, synthetic construct
  misc_feature 1..20: note = CRISPR gRNA sequence
  source 1..20: mol_type = other DNA
gacaaccaggacagccaggc

SEQ ID NO: 3411 - DNA, 20 bp, synthetic construct
  misc_feature 1..20: note = CRISPR gRNA sequence
  source 1..20: mol_type = other DNA
gccagcaacgatgcccatga

SEQ ID NO: 3412 - DNA, 20 bp, synthetic construct
  misc_feature 1..20: note = CRISPR gRNA sequence
  source 1..20: mol_type = other DNA
ccagcaacgatgcccatgat

SEQ ID NO: 3413 - DNA, 20 bp, synthetic construct
  misc_feature 1..20: note = CRISPR gRNA sequence
  source 1..20: mol_type = other DNA
cagcaacgatgcccatgatg

SEQ ID NO: 3414 - DNA, 20 bp, synthetic construct
  misc_feature 1..20: note = CRISPR gRNA sequence
  source 1..20: mol_type = other DNA
aacgatgcccatgatgggga

SEQ ID NO: 3415 - DNA, 20 bp, synthetic construct
  misc_feature 1..20: note = CRISPR gRNA sequence
  source 1..20: mol_type = other DNA
gatgcccatgatggggatgg

SEQ ID NO: 3416 - DNA, 20 bp, synthetic construct
  misc_feature 1..20: note = CRISPR gRNA sequence
  source 1..20: mol_type = other DNA
atgcccatgatggggatggt

SEQ ID NO: 3417 - DNA, 20 bp, synthetic construct
  misc_feature 1..20: note = CRISPR gRNA sequence
  source 1..20: mol_type = other DNA
ccatgatggggatggtgggc

SEQ ID NO: 3418 - DNA, 20 bp, synthetic construct
  misc_feature 1..20: note = CRISPR gRNA sequence
  source 1..20: mol_type = other DNA
catgatggggatggtgggct

SEQ ID NO: 3419 - DNA, 20 bp, synthetic construct
  misc_feature 1..20: note = CRISPR gRNA sequence
  source 1..20: mol_type = other DNA
gatggggatggtgggctggg

SEQ ID NO: 3420 - DNA, 20 bp, synthetic construct
  misc_feature 1..20: note = CRISPR gRNA sequence
  source 1..20: mol_type = other DNA
gggatggtgggctgggaaga

SEQ ID NO: 3421 - DNA, 20 bp, synthetic construct
  misc_feature 1..20: note = CRISPR gRNA sequence
  source 1..20: mol_type = other DNA
gtgggctgggaagatggctc

SEQ ID NO: 3422 - DNA, 20 bp, synthetic construct
  misc_feature 1..20: note = CRISPR gRNA sequence
  source 1..20: mol_type = other DNA
tgggctgggaagatggctct

SEQ ID NO: 3423 - DNA, 20 bp, synthetic construct
  misc_feature 1..20: note = CRISPR gRNA sequence
  source 1..20: mol_type = other DNA
ctgggaagatggctctggga

SEQ ID NO: 3424 - DNA, 20 bp, synthetic construct
  misc_feature 1..20: note = CRISPR gRNA sequence
  source 1..20: mol_type = other DNA
tgggaagatggctctgggaa

SEQ ID NO: 3425 - DNA, 20 bp, synthetic construct
  misc_feature 1..20: note = CRISPR gRNA sequence
  source 1..20: mol_type = other DNA
ggaagatggctctgggaaag

SEQ ID NO: 3426 - DNA, 20 bp, synthetic construct
  misc_feature 1..20: note = CRISPR gRNA sequence
  source 1..20: mol_type = other DNA
gaagatggctctgggaaagg

SEQ ID NO: 3427 - DNA, 20 bp, synthetic construct
  misc_feature 1..20: note = CRISPR gRNA sequence
  source 1..20: mol_type = other DNA
agatggctctgggaaaggag

SEQ ID NO: 3428 - DNA, 20 bp, synthetic construct
  misc_feature 1..20: note = CRISPR gRNA sequence
  source 1..20: mol_type = other DNA
tggctctgggaaaggaggag

SEQ ID NO: 3429 - DNA, 20 bp, synthetic construct
  misc_feature 1..20: note = CRISPR gRNA sequence
  source 1..20: mol_type = other DNA
ggctctgggaaaggaggaga

SEQ ID NO: 3430 - DNA, 20 bp, synthetic construct
  misc_feature 1..20: note = CRISPR gRNA sequence
  source 1..20: mol_type = other DNA
ctgggaaaggaggagaaggt

SEQ ID NO: 3431 - DNA, 20 bp, synthetic construct
  misc_feature 1..20: note = CRISPR gRNA sequence
  source 1..20: mol_type = other DNA
tgggaaaggaggagaaggtg

SEQ ID NO: 3432 - DNA, 20 bp, synthetic construct
  misc_feature 1..20: note = CRISPR gRNA sequence
  source 1..20: mol_type = other DNA
gggaaaggaggagaaggtga

SEQ ID NO: 3433 - DNA, 20 bp, synthetic construct
  misc_feature 1..20: note = CRISPR gRNA sequence
  source 1..20: mol_type = other DNA
ggaaaggaggagaaggtgag

SEQ ID NO: 3434 - DNA, 20 bp, synthetic construct
  misc_feature 1..20: note = CRISPR gRNA sequence
  source 1..20: mol_type = other DNA
ggtgaggggccctgaccccc

SEQ ID NO: 3435 - DNA, 20 bp, synthetic construct
  misc_feature 1..20: note = CRISPR gRNA sequence
  source 1..20: mol_type = other DNA
gggccctgacccccaagcct

SEQ ID NO: 3436 - DNA, 20 bp, synthetic construct
  misc_feature 1..20: note = CRISPR gRNA sequence
  source 1..20: mol_type = other DNA
cccaagcctcagccctgacc

SEQ ID NO: 3437 - DNA, 20 bp, synthetic construct
  misc_feature 1..20: note = CRISPR gRNA sequence
  source 1..20: mol_type = other DNA
cctcagccctgacccggctg

SEQ ID NO: 3438 - DNA, 20 bp, synthetic construct
  misc_feature 1..20: note = CRISPR gRNA sequence
  source 1..20: mol_type = other DNA
ctcagccctgacccggctga

SEQ ID NO: 3439 - DNA, 20 bp, synthetic construct
  misc_feature 1..20: note = CRISPR gRNA sequence
  source 1..20: mol_type = other DNA
tcagccctgacccggctgaa

SEQ ID NO: 3440 - DNA, 20 bp, synthetic construct
  misc_feature 1..20: note = CRISPR gRNA sequence
  source 1..20: mol_type = other DNA
ctgacccggctgaagggctc

SEQ ID NO: 3441 - DNA, 20 bp, synthetic construct
  misc_feature 1..20: note = CRISPR gRNA sequence
  source 1..20: mol_type = other DNA
acccggctgaagggctccag

SEQ ID NO: 3442 - DNA, 20 bp, synthetic construct
  misc_feature 1..20: note = CRISPR gRNA sequence
  source 1..20: mol_type = other DNA
cccggctgaagggctccaga

SEQ ID NO: 3443 - DNA, 20 bp, synthetic construct
  misc_feature 1..20: note = CRISPR gRNA sequence
  source 1..20: mol_type = other DNA
ggacttctgctttctctgat

SEQ ID NO: 3444 - DNA, 20 bp, synthetic construct
  misc_feature 1..20: note = CRISPR gRNA sequence
  source 1..20: mol_type = other DNA
acttctgctttctctgataa

SEQ ID NO: 3445 - DNA, 20 bp, synthetic construct
  misc_feature 1..20: note = CRISPR gRNA sequence
  source 1..20: mol_type = other DNA
ccccattcccctccttaccc

SEQ ID NO: 3446 - DNA, 20 bp, synthetic construct
  misc_feature 1..20: note = CRISPR gRNA sequence
  source 1..20: mol_type = other DNA
ttcccctccttaccccagct

SEQ ID NO: 3447 - DNA, 20 bp, synthetic construct
  misc_feature 1..20: note = CRISPR gRNA sequence
  source 1..20: mol_type = other DNA
tcccctccttaccccagctc

SEQ ID NO: 3448 - DNA, 20 bp, synthetic construct
  misc_feature 1..20: note = CRISPR gRNA sequence
  source 1..20: mol_type = other DNA
cccctccttaccccagctca

SEQ ID NO: 3449 - DNA, 20 bp, synthetic construct
  misc_feature 1..20: note = CRISPR gRNA sequence
  source 1..20: mol_type = other DNA
tccttaccccagctcagggt

SEQ ID NO: 3450 - DNA, 20 bp, synthetic construct
  misc_feature 1..20: note = CRISPR gRNA sequence
  source 1..20: mol_type = other DNA
ccttaccccagctcagggtg

SEQ ID NO: 3451 - DNA, 20 bp, synthetic construct
  misc_feature 1..20: note = CRISPR gRNA sequence
  source 1..20: mol_type = other DNA
cttaccccagctcagggtga

SEQ ID NO: 3452 - DNA, 20 bp, synthetic construct
  misc_feature 1..20: note = CRISPR gRNA sequence
  source 1..20: mol_type = other DNA
ttaccccagctcagggtgag

SEQ ID NO: 3453 - DNA, 20 bp, synthetic construct
  misc_feature 1..20: note = CRISPR gRNA sequence
  source 1..20: mol_type = other DNA
ctcagggtgaggggctcttg

SEQ ID NO: 3454 - DNA, 20 bp, synthetic construct
  misc_feature 1..20: note = CRISPR gRNA sequence
  source 1..20: mol_type = other DNA
gcagcccctcgtgctgcata

SEQ ID NO: 3455 - DNA, 20 bp, synthetic construct
  misc_feature 1..20: note = CRISPR gRNA sequence
  source 1..20: mol_type = other DNA
cgtgtatctctgctcttgtc

SEQ ID NO: 3456 - DNA, 20 bp, synthetic construct
  misc_feature 1..20: note = CRISPR gRNA sequence
  source 1..20: mol_type = other DNA
gtatctctgctcttgtccag

SEQ ID NO: 3457 - DNA, 20 bp, synthetic construct
  misc_feature 1..20: note = CRISPR gRNA sequence
  source 1..20: mol_type = other DNA
tatctctgctcttgtccaga

SEQ ID NO: 3458 - DNA, 20 bp, synthetic construct
  misc_feature 1..20: note = CRISPR gRNA sequence
  source 1..20: mol_type = other DNA
ttgtccagaaggcaccacca

SEQ ID NO: 3459 - DNA, 20 bp, synthetic construct
  misc_feature 1..20: note = CRISPR gRNA sequence
  source 1..20: mol_type = other DNA
ccaccacagctgcccacttc

SEQ ID NO: 3460 - DNA, 20 bp, synthetic construct
  misc_feature 1..20: note = CRISPR gRNA sequence
  source 1..20: mol_type = other DNA
ccacagctgcccacttctgg

SEQ ID NO: 3461 - DNA, 20 bp, synthetic construct
  misc_feature 1..20: note = CRISPR gRNA sequence
  source 1..20: mol_type = other DNA
cacagctgcccacttctgga

SEQ ID NO: 3462 - DNA, 20 bp, synthetic construct
  misc_feature 1..20: note = CRISPR gRNA sequence
  source 1..20: mol_type = other DNA
tggaaggttccatctcctgc

SEQ ID NO: 3463 - DNA, 20 bp, synthetic construct
  misc_feature 1..20: note = CRISPR gRNA sequence
  source 1..20: mol_type = other DNA
ggttccatctcctgctggcc

SEQ ID NO: 3464 - DNA, 20 bp, synthetic construct
  misc_feature 1..20: note = CRISPR gRNA sequence
  source 1..20: mol_type = other DNA
cctgctggcctggtctccac

SEQ ID NO: 3465 - DNA, 20 bp, synthetic construct
  misc_feature 1..20: note = CRISPR gRNA sequence
  source 1..20: mol_type = other DNA
tggcctggtctccacaagct

SEQ ID NO: 3466 - DNA, 20 bp, synthetic construct
  misc_feature 1..20: note = CRISPR gRNA sequence
  source 1..20: mol_type = other DNA
tctccacaagctcggtgtcc

SEQ ID NO: 3467 - DNA, 20 bp, synthetic construct
  misc_feature 1..20: note = CRISPR gRNA sequence
  source 1..20: mol_type = other DNA
ctccacaagctcggtgtcct

SEQ ID NO: 3468 - DNA, 20 bp, synthetic construct
  misc_feature 1..20: note = CRISPR gRNA sequence
  source 1..20: mol_type = other DNA
caagctcggtgtcctgggtc

SEQ ID NO: 3469 - DNA, 20 bp, synthetic construct
  misc_feature 1..20: note = CRISPR gRNA sequence
  source 1..20: mol_type = other DNA
ggtcctccccatcccgctgc

SEQ ID NO: 3470 - DNA, 20 bp, synthetic construct
  misc_feature 1..20: note = CRISPR gRNA sequence
  source 1..20: mol_type = other DNA
gtcctccccatcccgctgcc

SEQ ID NO: 3471 - DNA, 20 bp, synthetic construct
  misc_feature 1..20: note = CRISPR gRNA sequence
  source 1..20: mol_type = other DNA
tccccatcccgctgccaggt

SEQ ID NO: 3472 - DNA, 20 bp, synthetic construct
  misc_feature 1..20: note = CRISPR gRNA sequence
  source 1..20: mol_type = other DNA
ccaggtcagtgtgatctccg

SEQ ID NO: 3473 - DNA, 20 bp, synthetic construct
  misc_feature 1..20: note = CRISPR gRNA sequence
  source 1..20: mol_type = other DNA
caggtcagtgtgatctccgc

SEQ ID NO: 3474 - DNA, 20 bp, synthetic construct
  misc_feature 1..20: note = CRISPR gRNA sequence
  source 1..20: mol_type = other DNA
aggtcagtgtgatctccgca

SEQ ID NO: 3475 - DNA, 20 bp, synthetic construct
  misc_feature 1..20: note = CRISPR gRNA sequence
  source 1..20: mol_type = other DNA
tcagtgtgatctccgcaggg

SEQ ID NO: 3476 - DNA, 20 bp, synthetic construct
  misc_feature 1..20: note = CRISPR gRNA sequence
  source 1..20: mol_type = other DNA
gtgtgatctccgcagggtag

SEQ ID NO: 3477 - DNA, 20 bp, synthetic construct
  misc_feature 1..20: note = CRISPR gRNA sequence
  source 1..20: mol_type = other DNA
atctccgcagggtagaagcc

SEQ ID NO: 3478 - DNA, 20 bp, synthetic construct
  misc_feature 1..20: note = CRISPR gRNA sequence
  source 1..20: mol_type = other DNA
tctccgcagggtagaagccc

SEQ ID NO: 3479 - DNA, 20 bp, synthetic construct
  misc_feature 1..20: note = CRISPR gRNA sequence
  source 1..20: mol_type = other DNA
ctccgcagggtagaagccca

SEQ ID NO: 3480 - DNA, 20 bp, synthetic construct
  misc_feature 1..20: note = CRISPR gRNA sequence
  source 1..20: mol_type = other DNA
cagggtagaagcccagggcc

SEQ ID NO: 3481 - DNA, 20 bp, synthetic construct
  misc_feature 1..20: note = CRISPR gRNA sequence
  source 1..20: mol_type = other DNA
aagcccagggcccagcacct

SEQ ID NO: 3482 - DNA, 20 bp, synthetic construct
  misc_feature 1..20: note = CRISPR gRNA sequence
  source 1..20: mol_type = other DNA
agcccagggcccagcacctc

SEQ ID NO: 3483 - DNA, 20 bp, synthetic construct
  misc_feature 1..20: note = CRISPR gRNA sequence
  source 1..20: mol_type = other DNA
gcccagggcccagcacctca

SEQ ID NO: 3484 - DNA, 20 bp, synthetic construct
  misc_feature 1..20: note = CRISPR gRNA sequence
  source 1..20: mol_type = other DNA
cagggcccagcacctcaggg

SEQ ID NO: 3485 - DNA, 20 bp, synthetic construct
  misc_feature 1..20: note = CRISPR gRNA sequence
  source 1..20: mol_type = other DNA
agcacctcagggtggcctca

SEQ ID NO: 3486 - DNA, 20 bp, synthetic construct
  misc_feature 1..20: note = CRISPR gRNA sequence
  source 1..20: mol_type = other DNA
cctcagggtggcctcatggt

SEQ ID NO: 3487 - DNA, 20 bp, synthetic construct
  misc_feature 1..20: note = CRISPR gRNA sequence
  source 1..20: mol_type = other DNA
tcagggtggcctcatggtca

SEQ ID NO: 3488 - DNA, 20 bp, synthetic construct
  misc_feature 1..20: note = CRISPR gRNA sequence
  source 1..20: mol_type = other DNA
agggtggcctcatggtcaga

SEQ ID NO: 3489 - DNA, 20 bp, synthetic construct
  misc_feature 1..20: note = CRISPR gRNA sequence
  source 1..20: mol_type = other DNA
gggtggcctcatggtcagag

SEQ ID NO: 3490 - DNA, 20 bp, synthetic construct
  misc_feature 1..20: note = CRISPR gRNA sequence
  source 1..20: mol_type = other DNA
ggtggcctcatggtcagaga

SEQ ID NO: 3491 - DNA, 20 bp, synthetic construct
  misc_feature 1..20: note = CRISPR gRNA sequence
  source 1..20: mol_type = other DNA
gtggcctcatggtcagagag

SEQ ID NO: 3492 - DNA, 20 bp, synthetic construct
  misc_feature 1..20: note = CRISPR gRNA sequence
  source 1..20: mol_type = other DNA
tggcctcatggtcagagagg

SEQ ID NO: 3493 - DNA, 20 bp, synthetic construct
  misc_feature 1..20: note = CRISPR gRNA sequence
  source 1..20: mol_type = other DNA
cctcatggtcagagaggggg

SEQ ID NO: 3494 - DNA, 20 bp, synthetic construct
  misc_feature 1..20: note = CRISPR gRNA sequence
  source 1..20: mol_type = other DNA
catggtcagagagggggtgg

SEQ ID NO: 3495 - DNA, 20 bp, synthetic construct
  misc_feature 1..20: note = CRISPR gRNA sequence
  source 1..20: mol_type = other DNA
atggtcagagagggggtggt

SEQ ID NO: 3496 - DNA, 20 bp, synthetic construct
  misc_feature 1..20: note = CRISPR gRNA sequence
  source 1..20: mol_type = other DNA
tggtgggtcacgtgtgtctt

SEQ ID NO: 3497 - DNA, 20 bp, synthetic construct
  misc_feature 1..20: note = CRISPR gRNA sequence
  source 1..20: mol_type = other DNA
ggtgggtcacgtgtgtcttt

SEQ ID NO: 3498 - DNA, 20 bp, synthetic construct
  misc_feature 1..20: note = CRISPR gRNA sequence
  source 1..20: mol_type = other DNA
gtgggtcacgtgtgtctttg

SEQ ID NO: 3499 - DNA, 20 bp, synthetic construct
  misc_feature 1..20: note = CRISPR gRNA sequence
  source 1..20: mol_type = other DNA
tgggtcacgtgtgtctttgg

SEQ ID NO: 3500 - DNA, 20 bp, synthetic construct
  misc_feature 1..20: note = CRISPR gRNA sequence
  source 1..20: mol_type = other DNA
tgtgtctttgggggttctga

SEQ ID NO: 3501 - DNA, 20 bp, synthetic construct
  misc_feature 1..20: note = CRISPR gRNA sequence
  source 1..20: mol_type = other DNA
gtgtctttgggggttctgac

SEQ ID NO: 3502 - DNA, 20 bp, synthetic construct
  misc_feature 1..20: note = CRISPR gRNA sequence
  source 1..20: mol_type = other DNA
tctttgggggttctgacggg

SEQ ID NO: 3503 - DNA, 20 bp, synthetic construct
  misc_feature 1..20: note = CRISPR gRNA sequence
  source 1..20: mol_type = other DNA
tttgggggttctgacgggaa

SEQ ID NO: 3504 - DNA, 20 bp, synthetic construct
  misc_feature 1..20: note = CRISPR gRNA sequence
  source 1..20: mol_type = other DNA
ggggttctgacgggaagagt

SEQ ID NO: 3505 - DNA, 20 bp, synthetic construct
  misc_feature 1..20: note = CRISPR gRNA sequence
  source 1..20: mol_type = other DNA
acgggaagagtcagaaaatt

SEQ ID NO: 3506 - DNA, 20 bp, synthetic construct
  misc_feature 1..20: note = CRISPR gRNA sequence
  source 1..20: mol_type = other DNA
cagacactttgcatctctct

SEQ ID NO: 3507 - DNA, 20 bp, synthetic construct
  misc_feature 1..20: note = CRISPR gRNA sequence
  source 1..20: mol_type = other DNA
agacactttgcatctctctt

SEQ ID NO: 3508 - DNA, 20 bp, synthetic construct
  misc_feature 1..20: note = CRISPR gRNA sequence
  source 1..20: mol_type = other DNA
gcatctctcttgggacactc

SEQ ID NO: 3509 - DNA, 20 bp, synthetic construct
  misc_feature 1..20: note = CRISPR gRNA sequence
  source 1..20: mol_type = other DNA
tctctcttgggacactccag

SEQ ID NO: 3510 - DNA, 20 bp, synthetic construct
  misc_feature 1..20: note = CRISPR gRNA sequence
  source 1..20: mol_type = other DNA
agcgcccatgtgaccatcct

SEQ ID NO: 3511 - DNA, 20 bp, synthetic construct
  misc_feature 1..20: note = CRISPR gRNA sequence
  source 1..20: mol_type = other DNA
ccatgtgaccatcctgagaa

SEQ ID NO: 3512 - DNA, 20 bp, synthetic construct
  misc_feature 1..20: note = CRISPR gRNA sequence
  source 1..20: mol_type = other DNA
gtgaccatcctgagaatgga

SEQ ID NO: 3513 - DNA, 20 bp, synthetic construct
  misc_feature 1..20: note = CRISPR gRNA sequence
  source 1..20: mol_type = other DNA
tgaccatcctgagaatggac

SEQ ID NO: 3514 - DNA, 20 bp, synthetic construct
  misc_feature 1..20: note = CRISPR gRNA sequence
  source 1..20: mol_type = other DNA
ctgagaatggacaggacacc

SEQ ID NO: 3515 - DNA, 20 bp, synthetic construct
  misc_feature 1..20: note = CRISPR gRNA sequence
  source 1..20: mol_type = other DNA
tgagaatggacaggacacct

SEQ ID NO: 3516 - DNA, 20 bp, synthetic construct
  misc_feature 1..20: note = CRISPR gRNA sequence
  source 1..20: mol_type = other DNA
gagaatggacaggacacctg

SEQ ID NO: 3517 - DNA, 20 bp, synthetic construct
  misc_feature 1..20: note = CRISPR gRNA sequence
  source 1..20: mol_type = other DNA
aatggacaggacacctgggg

SEQ ID NO: 3518 - DNA, 20 bp, synthetic construct
  misc_feature 1..20: note = CRISPR gRNA sequence
  source 1..20: mol_type = other DNA
atggacaggacacctggggt

SEQ ID NO: 3519 - DNA, 20 bp, synthetic construct
  misc_feature 1..20: note = CRISPR gRNA sequence
  source 1..20: mol_type = other DNA
tggacaggacacctggggtg

SEQ ID NO: 3520 - DNA, 20 bp, synthetic construct
  misc_feature 1..20: note = CRISPR gRNA sequence
  source 1..20: mol_type = other DNA
acaggacacctggggtgggg

SEQ ID NO: 3521 - DNA, 20 bp, synthetic construct
  misc_feature 1..20: note = CRISPR gRNA sequence
  source 1..20: mol_type = other DNA
caggacacctggggtgggga

SEQ ID NO: 3522 - DNA, 20 bp, synthetic construct
  misc_feature 1..20: note = CRISPR gRNA sequence
  source 1..20: mol_type = other DNA
gacacctggggtggggaagg

SEQ ID NO: 3523 - DNA, 20 bp, synthetic construct
  misc_feature 1..20: note = CRISPR gRNA sequence
  source 1..20: mol_type = other DNA
ctggggtggggaaggcggca

SEQ ID NO: 3524 - DNA, 20 bp, synthetic construct
  misc_feature 1..20: note = CRISPR gRNA sequence
  source 1..20: mol_type = other DNA
ggggaaggcggcacagaacc

SEQ ID NO: 3525 - DNA, 20 bp, synthetic construct
  misc_feature 1..20: note = CRISPR gRNA sequence
  source 1..20: mol_type = other DNA
gcggcacagaacccagacgc

SEQ ID NO: 3526 - DNA, 20 bp, synthetic construct
  misc_feature 1..20: note = CRISPR gRNA sequence
  source 1..20: mol_type = other DNA
acagaacccagacgccagcc

SEQ ID NO: 3527 - DNA, 20 bp, synthetic construct
  misc_feature 1..20: note = CRISPR gRNA sequence
  source 1..20: mol_type = other DNA
cccagacgccagcctggaca

SEQ ID NO: 3528 - DNA, 20 bp, synthetic construct
  misc_feature 1..20: note = CRISPR gRNA sequence
  source 1..20: mol_type = other DNA
ccagacgccagcctggacac

SEQ ID NO: 3529 - DNA, 20 bp, synthetic construct
  misc_feature 1..20: note = CRISPR gRNA sequence
  source 1..20: mol_type = other DNA
ccagcctggacacaggcacc

SEQ ID NO: 3530 - DNA, 20 bp, synthetic construct
  misc_feature 1..20: note = CRISPR gRNA sequence
  source 1..20: mol_type = other DNA
cagcctggacacaggcacct

SEQ ID NO: 3531 - DNA, 20 bp, synthetic construct
  misc_feature 1..20: note = CRISPR gRNA sequence
  source 1..20: mol_type = other DNA
tgggataatctcctattcat

SEQ ID NO: 3532 - DNA, 20 bp, synthetic construct
  misc_feature 1..20: note = CRISPR gRNA sequence
  source 1..20: mol_type = other DNA
ataatctcctattcattgga

SEQ ID NO: 3533 - DNA, 20 bp, synthetic construct
  misc_feature 1..20: note = CRISPR gRNA sequence
  source 1..20: mol_type = other DNA
tcctattcattggaaagttc

SEQ ID NO: 3534 - DNA, 20 bp, synthetic construct
  misc_feature 1..20: note = CRISPR gRNA sequence
  source 1..20: mol_type = other DNA
attggaaagttctagtctct

SEQ ID NO: 3535 - DNA, 20 bp, synthetic construct
  misc_feature 1..20: note = CRISPR gRNA sequence
  source 1..20: mol_type = other DNA
ttggaaagttctagtctctg

SEQ ID NO: 3536 - DNA, 20 bp, synthetic construct
  misc_feature 1..20: note = CRISPR gRNA sequence
  source 1..20: mol_type = other DNA
tggaaagttctagtctctga

SEQ ID NO: 3537 - DNA, 20 bp, synthetic construct
  misc_feature 1..20: note = CRISPR gRNA sequence
  source 1..20: mol_type = other DNA
gaaagttctagtctctgagg

SEQ ID NO: 3538 - DNA, 20 bp, synthetic construct
  misc_feature 1..20: note = CRISPR gRNA sequence
  source 1..20: mol_type = other DNA
aaagttctagtctctgaggg

SEQ ID NO: 3539 - DNA, 20 bp, synthetic construct
  misc_feature 1..20: note = CRISPR gRNA sequence
  source 1..20: mol_type = other DNA
tctagtctctgagggaggaa

SEQ ID NO: 3540 - DNA, 20 bp, synthetic construct
  misc_feature 1..20: note = CRISPR gRNA sequence
  source 1..20: mol_type = other DNA
gagggaggaacagcgacttc

SEQ ID NO: 3541 - DNA, 20 bp, synthetic construct
  misc_feature 1..20: note = CRISPR gRNA sequence
  source 1..20: mol_type = other DNA
gcgacttctggtcctgacct

SEQ ID NO: 3542 - DNA, 20 bp, synthetic construct
  misc_feature 1..20: note = CRISPR gRNA sequence
  source 1..20: mol_type = other DNA
acttctggtcctgacctgag

SEQ ID NO: 3543 - DNA, 20 bp, synthetic construct
  misc_feature 1..20: note = CRISPR gRNA sequence
  source 1..20: mol_type = other DNA
ttctggtcctgacctgagtg

SEQ ID NO: 3544 - DNA, 20 bp, synthetic construct
  misc_feature 1..20: note = CRISPR gRNA sequence
  source 1..20: mol_type = other DNA
tctggtcctgacctgagtgg

SEQ ID NO: 3545 - DNA, 20 bp, synthetic construct
  misc_feature 1..20: note = CRISPR gRNA sequence
  source 1..20: mol_type = other DNA
cctgacctgagtggaggctg

SEQ ID NO: 3546 - DNA, 20 bp, synthetic construct
  misc_feature 1..20: note = CRISPR gRNA sequence
  source 1..20: mol_type = other DNA
ctgacctgagtggaggctgc

SEQ ID NO: 3547 - DNA, 20 bp, synthetic construct
  misc_feature 1..20: note = CRISPR gRNA sequence
  source 1..20: mol_type = other DNA
tgagtggaggctgcaggact

SEQ ID NO: 3548 - DNA, 20 bp, synthetic construct
  misc_feature 1..20: note = CRISPR gRNA sequence
  source 1..20: mol_type = other DNA
ggaggctgcaggactcagaa

SEQ ID NO: 3549 - DNA, 20 bp, synthetic construct
  misc_feature 1..20: note = CRISPR gRNA sequence
  source 1..20: mol_type = other DNA
gctgcaggactcagaaaagc

SEQ ID NO: 3550 - DNA, 20 bp, synthetic construct
  misc_feature 1..20: note = CRISPR gRNA sequence
  source 1..20: mol_type = other DNA
aaaagctggaatcaaacctt

SEQ ID NO: 3551 - DNA, 20 bp, synthetic construct
  misc_feature 1..20: note = CRISPR gRNA sequence
  source 1..20: mol_type = other DNA
atcaaaccttcagacacatt

SEQ ID NO: 3552 - DNA, 20 bp, synthetic construct
  misc_feature 1..20: note = CRISPR gRNA sequence
  source 1..20: mol_type = other DNA
ccttcagacacattgagtgt

SEQ ID NO: 3553 - DNA, 20 bp, synthetic construct
  misc_feature 1..20: note = CRISPR gRNA sequence
  source 1..20: mol_type = other DNA
cttcagacacattgagtgtg

SEQ ID NO: 3554 - DNA, 20 bp, synthetic construct
  misc_feature 1..20: note = CRISPR gRNA sequence
  source 1..20: mol_type = other DNA
cagacacattgagtgtgagg

SEQ ID NO: 3555 - DNA, 20 bp, synthetic construct
  misc_feature 1..20: note = CRISPR gRNA sequence
  source 1..20: mol_type = other DNA
gacacattgagtgtgaggca

SEQ ID NO: 3556 - DNA, 20 bp, synthetic construct
  misc_feature 1..20: note = CRISPR gRNA sequence
  source 1..20: mol_type = other DNA
ttgagtgtgaggcagagaac

SEQ ID NO: 3557 - DNA, 20 bp, synthetic construct
  misc_feature 1..20: note = CRISPR gRNA sequence
  source 1..20: mol_type = other DNA
tgagtgtgaggcagagaaca

SEQ ID NO: 3558 - DNA, 20 bp, synthetic construct
  misc_feature 1..20: note = CRISPR gRNA sequence
  source 1..20: mol_type = other DNA
tgaggcagagaacaaggcct

SEQ ID NO: 3559 - DNA, 20 bp, synthetic construct
  misc_feature 1..20: note = CRISPR gRNA sequence
  source 1..20: mol_type = other DNA
aggcagagaacaaggcctga

SEQ ID NO: 3560 - DNA, 20 bp, synthetic construct
  misc_feature 1..20: note = CRISPR gRNA sequence
  source 1..20: mol_type = other DNA
agagaacaaggcctgagaga

SEQ ID NO: 3561 - DNA, 20 bp, synthetic construct
  misc_feature 1..20: note = CRISPR gRNA sequence
  source 1..20: mol_type = other DNA
gagaacaaggcctgagagaa

SEQ ID NO: 3562 - DNA, 20 bp, synthetic construct
  misc_feature 1..20: note = CRISPR gRNA sequence
  source 1..20: mol_type = other DNA
acaaggcctgagagaaaggt

SEQ ID NO: 3563 - DNA, 20 bp, synthetic construct
  misc_feature 1..20: note = CRISPR gRNA sequence
  source 1..20: mol_type = other DNA
aggcctgagagaaaggtcag

SEQ ID NO: 3564 - DNA, 20 bp, synthetic construct
  misc_feature 1..20: note = CRISPR gRNA sequence
  source 1..20: mol_type = other DNA
aaaggtcagcagcctgacca

SEQ ID NO: 3565 - DNA, 20 bp, synthetic construct
  misc_feature 1..20: note = CRISPR gRNA sequence
  source 1..20: mol_type = other DNA
cagcctgaccacagctgctg

SEQ ID NO: 3566 - DNA, 20 bp, synthetic construct
  misc_feature 1..20: note = CRISPR gRNA sequence
  source 1..20: mol_type = other DNA
cctgaccacagctgctgcag

SEQ ID NO: 3567 - DNA, 20 bp, synthetic construct
  misc_feature 1..20: note = CRISPR gRNA sequence
  source 1..20: mol_type = other DNA
cacagctgctgcagtggtca

SEQ ID NO: 3568 - DNA, 20 bp, synthetic construct
  misc_feature 1..20: note = CRISPR gRNA sequence
  source 1..20: mol_type = other DNA
agctgctgcagtggtcaaag

SEQ ID NO: 3569 - DNA, 20 bp, synthetic construct
  misc_feature 1..20: note = CRISPR gRNA sequence
  source 1..20: mol_type = other DNA
tgcagtggtcaaagtggtca

SEQ ID NO: 3570 - DNA, 20 bp, synthetic construct
  misc_feature 1..20: note = CRISPR gRNA sequence
  source 1..20: mol_type = other DNA
gcagtggtcaaagtggtcaa

SEQ ID NO: 3571 - DNA, 20 bp, synthetic construct
  misc_feature 1..20: note = CRISPR gRNA sequence
  source 1..20: mol_type = other DNA
agtggtcaaagtggtcaaag

SEQ ID NO: 3572 - DNA, 20 bp, synthetic construct
  misc_feature 1..20: note = CRISPR gRNA sequence
  source 1..20: mol_type = other DNA
ggtcaaaggagacccctgat

SEQ ID NO: 3573 - DNA, 20 bp, synthetic construct
  misc_feature 1..20: note = CRISPR gRNA sequence
  source 1..20: mol_type = other DNA
gagacccctgatcagtattc

SEQ ID NO: 3574 - DNA, 20 bp, synthetic construct
  misc_feature 1..20: note = CRISPR gRNA sequence
  source 1..20: mol_type = other DNA
agacccctgatcagtattcc

SEQ ID NO: 3575 - DNA, 20 bp, synthetic construct
  misc_feature 1..20: note = CRISPR gRNA sequence
  source 1..20: mol_type = other DNA
gacccctgatcagtattcca

SEQ ID NO: 3576 - DNA, 20 bp, synthetic construct
  misc_feature 1..20: note = CRISPR gRNA sequence
  source 1..20: mol_type = other DNA
tgtcttcccctccatttcct

SEQ ID NO: 3577 - DNA, 20 bp, synthetic construct
  misc_feature 1..20: note = CRISPR gRNA sequence
  source 1..20: mol_type = other DNA
tcttcccctccatttcctca

SEQ ID NO: 3578 - DNA, 20 bp, synthetic construct
  misc_feature 1..20: note = CRISPR gRNA sequence
  source 1..20: mol_type = other DNA
acttcatcccttaattgtcc

SEQ ID NO: 3579 - DNA, 20 bp, synthetic construct
  misc_feature 1..20: note = CRISPR gRNA sequence
  source 1..20: mol_type = other DNA
ttcatcccttaattgtccta

SEQ ID NO: 3580 - DNA, 20 bp, synthetic construct
  misc_feature 1..20: note = CRISPR gRNA sequence
  source 1..20: mol_type = other DNA
catcccttaattgtcctaga

SEQ ID NO: 3581 - DNA, 20 bp, synthetic construct
  misc_feature 1..20: note = CRISPR gRNA sequence
  source 1..20: mol_type = other DNA
cccttaattgtcctagagag

SEQ ID NO: 3582 - DNA, 20 bp, synthetic construct
  misc_feature 1..20: note = CRISPR gRNA sequence
  source 1..20: mol_type = other DNA
cttaattgtcctagagagca

SEQ ID NO: 3583 - DNA, 20 bp, synthetic construct
  misc_feature 1..20: note = CRISPR gRNA sequence
  source 1..20: mol_type = other DNA
ttaattgtcctagagagcag

SEQ ID NO: 3584 - DNA, 20 bp, synthetic construct
  misc_feature 1..20: note = CRISPR gRNA sequence
  source 1..20: mol_type = other DNA
taattgtcctagagagcaga

SEQ ID NO: 3585 - DNA, 20 bp, synthetic construct
  misc_feature 1..20: note = CRISPR gRNA sequence
  source 1..20: mol_type = other DNA
aattgtcctagagagcagag

SEQ ID NO: 3586 - DNA, 20 bp, synthetic construct
  misc_feature 1..20: note = CRISPR gRNA sequence
  source 1..20: mol_type = other DNA
attgtcctagagagcagagg

SEQ ID NO: 3587 - DNA, 20 bp, synthetic construct
  misc_feature 1..20: note = CRISPR gRNA sequence
  source 1..20: mol_type = other DNA
tagagagcagagggggccct

SEQ ID NO: 3588 - DNA, 20 bp, synthetic construct
  misc_feature 1..20: note = CRISPR gRNA sequence
  source 1..20: mol_type = other DNA
gagagcagagggggccctca

SEQ ID NO: 3589 - DNA, 20 bp, synthetic construct
  misc_feature 1..20: note = CRISPR gRNA sequence
  source 1..20: mol_type = other DNA
agagcagagggggccctcag

SEQ ID NO: 3590 - DNA, 20 bp, synthetic construct
  misc_feature 1..20: note = CRISPR gRNA sequence
  source 1..20: mol_type = other DNA
gggggccctcagaggaaact

SEQ ID NO: 3591 - DNA, 20 bp, synthetic construct
  misc_feature 1..20: note = CRISPR gRNA sequence
  source 1..20: mol_type = other DNA
ggggccctcagaggaaactc

SEQ ID NO: 3592 - DNA, 20 bp, synthetic construct
  misc_feature 1..20: note = CRISPR gRNA sequence
  source 1..20: mol_type = other DNA
actcatgccattctccattc

SEQ ID NO: 3593 - DNA, 20 bp, synthetic construct
  misc_feature 1..20: note = CRISPR gRNA sequence
  source 1..20: mol_type = other DNA
ctcatgccattctccattca

SEQ ID NO: 3594 - DNA, 20 bp, synthetic construct
  misc_feature 1..20: note = CRISPR gRNA sequence
  source 1..20: mol_type = other DNA
tcatgccattctccattcaa

SEQ ID NO: 3595 - DNA, 20 bp, synthetic construct
  misc_feature 1..20: note = CRISPR gRNA sequence
  source 1..20: mol_type = other DNA
atgccattctccattcaagg

SEQ ID NO: 3596 - DNA, 20 bp, synthetic construct
  misc_feature 1..20: note = CRISPR gRNA sequence
  source 1..20: mol_type = other DNA
tgccattctccattcaaggg

SEQ ID NO: 3597 - DNA, 20 bp, synthetic construct
  misc_feature 1..20: note = CRISPR gRNA sequence
  source 1..20: mol_type = other DNA
gccattctccattcaaggga

SEQ ID NO: 3598 - DNA, 20 bp, synthetic construct
  misc_feature 1..20: note = CRISPR gRNA sequence
  source 1..20: mol_type = other DNA
ttcaagggagggcgatattc

SEQ ID NO: 3599 - DNA, 20 bp, synthetic construct
  misc_feature 1..20: note = CRISPR gRNA sequence
  source 1..20: mol_type = other DNA
ccattttcctcccctcctcg

SEQ ID NO: 3600 - DNA, 20 bp, synthetic construct
  misc_feature 1..20: note = CRISPR gRNA sequence
  source 1..20: mol_type = other DNA
cattttcctcccctcctcgt

SEQ ID NO: 3601 - DNA, 20 bp, synthetic construct
  misc_feature 1..20: note = CRISPR gRNA sequence
  source 1..20: mol_type = other DNA
ttttcctcccctcctcgtgg

SEQ ID NO: 3602 - DNA, 20 bp, synthetic construct
  misc_feature 1..20: note = CRISPR gRNA sequence
  source 1..20: mol_type = other DNA
tttcctcccctcctcgtggg

SEQ ID NO: 3603 - DNA, 20 bp, synthetic construct
  misc_feature 1..20: note = CRISPR gRNA sequence
  source 1..20: mol_type = other DNA
ctcctcgtgggaggccatcc

SEQ ID NO: 3604 - DNA, 20 bp, synthetic construct
  misc_feature 1..20: note = CRISPR gRNA sequence
  source 1..20: mol_type = other DNA
tcctcgtgggaggccatccc

SEQ ID NO: 3605 - DNA, 20 bp, synthetic construct
  misc_feature 1..20: note = CRISPR gRNA sequence
  source 1..20: mol_type = other DNA
ctcgtgggaggccatcccgg

SEQ ID NO: 3606 - DNA, 20 bp, synthetic construct
  misc_feature 1..20: note = CRISPR gRNA sequence
  source 1..20: mol_type = other DNA
aggccatcccgggagatcta

SEQ ID NO: 3607 - DNA, 20 bp, synthetic construct
  misc_feature 1..20: note = CRISPR gRNA sequence
  source 1..20: mol_type = other DNA
ggccatcccgggagatctat

SEQ ID NO: 3608 - DNA, 20 bp, synthetic construct
  misc_feature 1..20: note = CRISPR gRNA sequence
  source 1..20: mol_type = other DNA
ccatcccgggagatctatag

SEQ ID NO: 3609 - DNA, 20 bp, synthetic construct
  misc_feature 1..20: note = CRISPR gRNA sequence
  source 1..20: mol_type = other DNA
cccgggagatctataggaga

SEQ ID NO: 3610 - DNA, 20 bp, synthetic construct
  misc_feature 1..20: note = CRISPR gRNA sequence
  source 1..20: mol_type = other DNA
ccgggagatctataggagat

SEQ ID NO: 3611 - DNA, 20 bp, synthetic construct
  misc_feature 1..20: note = CRISPR gRNA sequence
  source 1..20: mol_type = other DNA
cgggagatctataggagatg

SEQ ID NO: 3612 - DNA, 20 bp, synthetic construct
  misc_feature 1..20: note = CRISPR gRNA sequence
  source 1..20: mol_type = other DNA
gagatctataggagatgggg

SEQ ID NO: 3613 - DNA, 20 bp, synthetic construct
  misc_feature 1..20: note = CRISPR gRNA sequence
  source 1..20: mol_type = other DNA
agatctataggagatgggga

SEQ ID NO: 3614 - DNA, 20 bp, synthetic construct
  misc_feature 1..20: note = CRISPR gRNA sequence
  source 1..20: mol_type = other DNA
ggaaggctccccactgcccc

SEQ ID NO: 3615 - DNA, 20 bp, synthetic construct
  misc_feature 1..20: note = CRISPR gRNA sequence
  source 1..20: mol_type = other DNA
cccctggtacctgcgcgctg

SEQ ID NO: 3616 - DNA, 20 bp, synthetic construct
  misc_feature 1..20: note = CRISPR gRNA sequence
  source 1..20: mol_type = other DNA
agcgtctccttcccgttctc

SEQ ID NO: 3617 - DNA, 20 bp, synthetic construct
  misc_feature 1..20: note = CRISPR gRNA sequence
  source 1..20: mol_type = other DNA
gcgtctccttcccgttctcc

SEQ ID NO: 3618 - DNA, 20 bp, synthetic construct
  misc_feature 1..20: note = CRISPR gRNA sequence
  source 1..20: mol_type = other DNA
tcccgttctccaggtatctg

SEQ ID NO: 3619 - DNA, 20 bp, synthetic construct
  misc_feature 1..20: note = CRISPR gRNA sequence
  source 1..20: mol_type = other DNA
ccgttctccaggtatctgcg

SEQ ID NO: 3620 - DNA, 20 bp, synthetic construct
  misc_feature 1..20: note = CRISPR gRNA sequence
  source 1..20: mol_type = other DNA
cactccacgcacgtgccctc

SEQ ID NO: 3621 - DNA, 20 bp, synthetic construct
  misc_feature 1..20: note = CRISPR gRNA sequence
  source 1..20: mol_type = other DNA
actccacgcacgtgccctcc

SEQ ID NO: 3622 - DNA, 20 bp, synthetic construct
  misc_feature 1..20: note = CRISPR gRNA sequence
  source 1..20: mol_type = other DNA
ccacgcacgtgccctccagg

SEQ ID NO: 3623 - DNA, 20 bp, synthetic construct
  misc_feature 1..20: note = CRISPR gRNA sequence
  source 1..20: mol_type = other DNA
cacgcacgtgccctccaggt

SEQ ID NO: 3624 - DNA, 20 bp, synthetic construct
  misc_feature 1..20: note = CRISPR gRNA sequence
  source 1..20: mol_type = other DNA
gtgccctccaggtaggctct

SEQ ID NO: 3625 - DNA, 20 bp, synthetic construct
  misc_feature 1..20: note = CRISPR gRNA sequence
  source 1..20: mol_type = other DNA
ctctcagctgctccgccgca

SEQ ID NO: 3626 - DNA, 20 bp, synthetic construct
  misc_feature 1..20: note = CRISPR gRNA sequence
  source 1..20: mol_type = other DNA
tctcagctgctccgccgcac

SEQ ID NO: 3627 - DNA, 20 bp, synthetic construct
  misc_feature 1..20: note = CRISPR gRNA sequence
  source 1..20: mol_type = other DNA
gggccgcctccaacttgcgc

SEQ ID NO: 3628 - DNA, 20 bp, synthetic construct
  misc_feature 1..20: note = CRISPR gRNA sequence
  source 1..20: mol_type = other DNA
ggccgcctccaacttgcgct

SEQ ID NO: 3629 - DNA, 20 bp, synthetic construct
  misc_feature 1..20: note = CRISPR gRNA sequence
  source 1..20: mol_type = other DNA
caacttgcgctgggtgatct

SEQ ID NO: 3630 - DNA, 20 bp, synthetic construct
  misc_feature 1..20: note = CRISPR gRNA sequence
  source 1..20: mol_type = other DNA
gcgctgggtgatctgagccg

SEQ ID NO: 3631 - DNA, 20 bp, synthetic construct
  misc_feature 1..20: note = CRISPR gRNA sequence
  source 1..20: mol_type = other DNA
gatctgagccgcggtgtccg

SEQ ID NO: 3632 - DNA, 20 bp, synthetic construct
  misc_feature 1..20: note = CRISPR gRNA sequence
  source 1..20: mol_type = other DNA
ctgagccgcggtgtccgcgg

SEQ ID NO: 3633 - DNA, 20 bp, synthetic construct
  misc_feature 1..20: note = CRISPR gRNA sequence
  source 1..20: mol_type = other DNA
ccgcggtgtccgcggcggtc

SEQ ID NO: 3634 - DNA, 20 bp, synthetic construct
  misc_feature 1..20: note = CRISPR gRNA sequence
  source 1..20: mol_type = other DNA
cgcggtgtccgcggcggtcc

SEQ ID NO: 3635 - DNA, 20 bp, synthetic construct
  misc_feature 1..20: note = CRISPR gRNA sequence
  source 1..20: mol_type = other DNA
cggtgtccgcggcggtccag

SEQ ID NO: 3636 - DNA, 20 bp, synthetic construct
  misc_feature 1..20: note = CRISPR gRNA sequence
  source 1..20: mol_type = other DNA
tccgcggcggtccaggagcg

SEQ ID NO: 3637 - DNA, 20 bp, synthetic construct
  misc_feature 1..20: note = CRISPR gRNA sequence
  source 1..20: mol_type = other DNA
ccgcggcggtccaggagcgc

SEQ ID NO: 3638 - DNA, 20 bp, synthetic construct
  misc_feature 1..20: note = CRISPR gRNA sequence
  source 1..20: mol_type = other DNA
caggagcgcaggtcctcgtt

SEQ ID NO: 3639 - DNA, 20 bp, synthetic construct
  misc_feature 1..20: note = CRISPR gRNA sequence
  source 1..20: mol_type = other DNA
aggagcgcaggtcctcgttc

SEQ ID NO: 3640 - DNA, 20 bp, synthetic construct
  misc_feature 1..20: note = CRISPR gRNA sequence
  source 1..20: mol_type = other DNA
ggagcgcaggtcctcgttca

SEQ ID NO: 3641 - DNA, 20 bp, synthetic construct
  misc_feature 1..20: note = CRISPR gRNA sequence
  source 1..20: mol_type = other DNA
cgatgtaatccttgccgtcg

SEQ ID NO: 3642 - DNA, 20 bp, synthetic construct
  misc_feature 1..20: note = CRISPR gRNA sequence
  source 1..20: mol_type = other DNA
gatgtaatccttgccgtcgt

SEQ ID NO: 3643 - DNA, 20 bp, synthetic construct
  misc_feature 1..20: note = CRISPR gRNA sequence
  source 1..20: mol_type = other DNA
gtaatccttgccgtcgtagg

SEQ ID NO: 3644 - DNA, 20 bp, synthetic construct
  misc_feature 1..20: note = CRISPR gRNA sequence
  source 1..20: mol_type = other DNA
ccttgccgtcgtaggcggac

SEQ ID NO: 3645 - DNA, 20 bp, synthetic construct
  misc_feature 1..20: note = CRISPR gRNA sequence
  source 1..20: mol_type = other DNA
aggcggactggtcatacccg

SEQ ID NO: 3646 - DNA, 20 bp, synthetic construct
  misc_feature 1..20: note = CRISPR gRNA sequence
  source 1..20: mol_type = other DNA
gcggactggtcatacccgcg

SEQ ID NO: 3647 - DNA, 20 bp, synthetic construct
  misc_feature 1..20: note = CRISPR gRNA sequence
  source 1..20: mol_type = other DNA
cggactggtcatacccgcgg

SEQ ID NO: 3648 - DNA, 20 bp, synthetic construct
  misc_feature 1..20: note = CRISPR gRNA sequence
  source 1..20: mol_type = other DNA
gactggtcatacccgcggag

SEQ ID NO: 3649 - DNA, 20 bp, synthetic construct
  misc_feature 1..20: note = CRISPR gRNA sequence
  source 1..20: mol_type = other DNA
actggtcatacccgcggagg

SEQ ID NO: 3650 - DNA, 20 bp, synthetic construct
  misc_feature 1..20: note = CRISPR gRNA sequence
  source 1..20: mol_type = other DNA
cccgcggaggaggcgcccgt

SEQ ID NO: 3651 - DNA, 20 bp, synthetic construct
  misc_feature 1..20: note = CRISPR gRNA sequence
  source 1..20: mol_type = other DNA
ccgcggaggaggcgcccgtc

SEQ ID NO: 3652 - DNA, 20 bp, synthetic construct
  misc_feature 1..20: note = CRISPR gRNA sequence
  source 1..20: mol_type = other DNA
aggaggcgcccgtcgggccc

SEQ ID NO: 3653 - DNA, 20 bp, synthetic construct
  misc_feature 1..20: note = CRISPR gRNA sequence
  source 1..20: mol_type = other DNA
ggaggcgcccgtcgggcccc

SEQ ID NO: 3654 - DNA, 20 bp, synthetic construct
  misc_feature 1..20: note = CRISPR gRNA sequence
  source 1..20: mol_type = other DNA
gcccgtcgggccccaggtcg

SEQ ID NO: 3655 - DNA, 20 bp, synthetic construct
  misc_feature 1..20: note = CRISPR gRNA sequence
  source 1..20: mol_type = other DNA
ggtcgcagccatacatcctc

SEQ ID NO: 3656 - DNA, 20 bp, synthetic construct
  misc_feature 1..20: note = CRISPR gRNA sequence
  source 1..20: mol_type = other DNA
tcgcagccatacatcctctg

SEQ ID NO: 3657 - DNA, 20 bp, synthetic construct
  misc_feature 1..20: note = CRISPR gRNA sequence
  source 1..20: mol_type = other DNA
cgcagccatacatcctctgg

SEQ ID NO: 3658 - DNA, 20 bp, synthetic construct
  misc_feature 1..20: note = CRISPR gRNA sequence
  source 1..20: mol_type = other DNA
gcagccatacatcctctgga

SEQ ID NO: 3659 - DNA, 20 bp, synthetic construct
  misc_feature 1..20: note = CRISPR gRNA sequence
  source 1..20: mol_type = other DNA
atacatcctctggagggtgt

SEQ ID NO: 3660 - DNA, 20 bp, synthetic construct
  misc_feature 1..20: note = CRISPR gRNA sequence
  source 1..20: mol_type = other DNA
ctctggagggtgtgagaccc

SEQ ID NO: 3661 - DNA, 20 bp, synthetic construct
  misc_feature 1..20: note = CRISPR gRNA sequence
  source 1..20: mol_type = other DNA
agaccctggccccgcccccg

SEQ ID NO: 3662 - DNA, 20 bp, synthetic construct
  misc_feature 1..20: note = CRISPR gRNA sequence
  source 1..20: mol_type = other DNA
cctggccccgcccccgcggt

SEQ ID NO: 3663 - DNA, 20 bp, synthetic construct
  misc_feature 1..20: note = CRISPR gRNA sequence
  source 1..20: mol_type = other DNA
ccccgcccccgcggtcagcc

SEQ ID NO: 3664 - DNA, 20 bp, synthetic construct
  misc_feature 1..20: note = CRISPR gRNA sequence
  source 1..20: mol_type = other DNA
cgcggtcagcccagtccccc

SEQ ID NO: 3665 - DNA, 20 bp, synthetic construct
  misc_feature 1..20: note = CRISPR gRNA sequence
  source 1..20: mol_type = other DNA
gccccgccccgaccaacccg

SEQ ID NO: 3666 - DNA, 20 bp, synthetic construct
  misc_feature 1..20: note = CRISPR gRNA sequence
  source 1..20: mol_type = other DNA
ccccgccccgaccaacccgc

SEQ ID NO: 3667 - DNA, 20 bp, synthetic construct
  misc_feature 1..20: note = CRISPR gRNA sequence
  source 1..20: mol_type = other DNA
cccgccccgaccaacccgcg

SEQ ID NO: 3668 - DNA, 20 bp, synthetic construct
  misc_feature 1..20: note = CRISPR gRNA sequence
  source 1..20: mol_type = other DNA
cgaccaacccgcggggattt

SEQ ID NO: 3669 - DNA, 20 bp, synthetic construct
  misc_feature 1..20: note = CRISPR gRNA sequence
  source 1..20: mol_type = other DNA
gcctaaaccgaaaatgaaac

SEQ ID NO: 3670 - DNA, 20 bp, synthetic construct
  misc_feature 1..20: note = CRISPR gRNA sequence
  source 1..20: mol_type = other DNA
cctaaaccgaaaatgaaacc

SEQ ID NO: 3671 - DNA, 20 bp, synthetic construct
  misc_feature 1..20: note = CRISPR gRNA sequence
  source 1..20: mol_type = other DNA
accgaaaatgaaaccgggta

SEQ ID NO: 3672 - DNA, 20 bp, synthetic construct
  misc_feature 1..20: note = CRISPR gRNA sequence
  source 1..20: mol_type = other DNA
ccgaaaatgaaaccgggtaa

SEQ ID NO: 3673 - DNA, 20 bp, synthetic construct
  misc_feature 1..20: note = CRISPR gRNA sequence
  source 1..20: mol_type = other DNA
tgaaaccgggtaaaggcgac

SEQ ID NO: 3674 - DNA, 20 bp, synthetic construct
  misc_feature 1..20: note = CRISPR gRNA sequence
  source 1..20: mol_type = other DNA
gaaaccgggtaaaggcgact

SEQ ID NO: 3675 - DNA, 20 bp, synthetic construct
  misc_feature 1..20: note = CRISPR gRNA sequence
  source 1..20: mol_type = other DNA
aaaccgggtaaaggcgactg

SEQ ID NO: 3676 - DNA, 20 bp, synthetic construct
  misc_feature 1..20: note = CRISPR gRNA sequence
  source 1..20: mol_type = other DNA
aaggcgactggggctctctc

SEQ ID NO: 3677 - DNA, 20 bp, synthetic construct
  misc_feature 1..20: note = CRISPR gRNA sequence
  source 1..20: mol_type = other DNA
gactggggctctctccggtc

SEQ ID NO: 3678 - DNA, 20 bp, synthetic construct
  misc_feature 1..20: note = CRISPR gRNA sequence
  source 1..20: mol_type = other DNA
actggggctctctccggtcg

SEQ ID NO: 3679 - DNA, 20 bp, synthetic construct
  misc_feature 1..20: note = CRISPR gRNA sequence
  source 1..20: mol_type = other DNA
ctggggctctctccggtcga

SEQ ID NO: 3680 - DNA, 20 bp, synthetic construct
  misc_feature 1..20: note = CRISPR gRNA sequence
  source 1..20: mol_type = other DNA
gctctctccggtcgagggtc

SEQ ID NO: 3681 - DNA, 20 bp, synthetic construct
  misc_feature 1..20: note = CRISPR gRNA sequence
  source 1..20: mol_type = other DNA
ctctctccggtcgagggtct

SEQ ID NO: 3682 - DNA, 20 bp, synthetic construct
  misc_feature 1..20: note = CRISPR gRNA sequence
  source 1..20: mol_type = other DNA
tctccggtcgagggtctggg

SEQ ID NO: 3683 - DNA, 20 bp, synthetic construct
  misc_feature 1..20: note = CRISPR gRNA sequence
  source 1..20: mol_type = other DNA
ctccggtcgagggtctgggc

SEQ ID NO: 3684 - DNA, 20 bp, synthetic construct
  misc_feature 1..20: note = CRISPR gRNA sequence
  source 1..20: mol_type = other DNA
gagggtctgggcgggttccg

SEQ ID NO: 3685 - DNA, 20 bp, synthetic construct
  misc_feature 1..20: note = CRISPR gRNA sequence
  source 1..20: mol_type = other DNA
cgggttccgcagatccacct

SEQ ID NO: 3686 - DNA, 20 bp, synthetic construct
  misc_feature 1..20: note = CRISPR gRNA sequence
  source 1..20: mol_type = other DNA
gggttccgcagatccacctt

SEQ ID NO: 3687 - DNA, 20 bp, synthetic construct
  misc_feature 1..20: note = CRISPR gRNA sequence
  source 1..20: mol_type = other DNA
ggttccgcagatccaccttg

SEQ ID NO: 3688 - DNA, 20 bp, synthetic construct
  misc_feature 1..20: note = CRISPR gRNA sequence
  source 1..20: mol_type = other DNA
tccgcagatccaccttgggg

SEQ ID NO: 3689 - DNA, 20 bp, synthetic construct
  misc_feature 1..20: note = CRISPR gRNA sequence
  source 1..20: mol_type = other DNA
atccaccttggggtggatct

SEQ ID NO: 3690 - DNA, 20 bp, synthetic construct
  misc_feature 1..20: note = CRISPR gRNA sequence
  source 1..20: mol_type = other DNA
accttggggtggatctcaga

SEQ ID NO: 3691 - DNA, 20 bp, synthetic construct
  misc_feature 1..20: note = CRISPR gRNA sequence
  source 1..20: mol_type = other DNA
ccttggggtggatctcagac

SEQ ID NO: 3692 - DNA, 20 bp, synthetic construct
  misc_feature 1..20: note = CRISPR gRNA sequence
  source 1..20: mol_type = other DNA
cttggggtggatctcagacg

SEQ ID NO: 3693 - DNA, 20 bp, synthetic construct
  misc_feature 1..20: note = CRISPR gRNA sequence
  source 1..20: mol_type = other DNA
tggggtggatctcagacggg

SEQ ID NO: 3694 - DNA, 20 bp, synthetic construct
  misc_feature 1..20: note = CRISPR gRNA sequence
  source 1..20: mol_type = other DNA
ggatctcagacggggagact

SEQ ID NO: 3695 - DNA, 20 bp, synthetic construct
  misc_feature 1..20: note = CRISPR gRNA sequence
  source 1..20: mol_type = other DNA
gatctcagacggggagactc

SEQ ID NO: 3696 - DNA, 20 bp, synthetic construct
  misc_feature 1..20: note = CRISPR gRNA sequence
  source 1..20: mol_type = other DNA
atctcagacggggagactcg

SEQ ID NO: 3697 - DNA, 20 bp, synthetic construct
  misc_feature 1..20: note = CRISPR gRNA sequence
  source 1..20: mol_type = other DNA
cggggagactcggggcgacc

SEQ ID NO: 3698 - DNA, 20 bp, synthetic construct
  misc_feature 1..20: note = CRISPR gRNA sequence
  source 1..20: mol_type = other DNA
ggggagactcggggcgaccc

SEQ ID NO: 3699 - DNA, 20 bp, synthetic construct
  misc_feature 1..20: note = CRISPR gRNA sequence
  source 1..20: mol_type = other DNA
ggggcgacccgggccgtccg

SEQ ID NO: 3700 - DNA, 20 bp, synthetic construct
  misc_feature 1..20: note = CRISPR gRNA sequence
  source 1..20: mol_type = other DNA
gggcgacccgggccgtccgt

SEQ ID NO: 3701 - DNA, 20 bp, synthetic construct
  misc_feature 1..20: note = CRISPR gRNA sequence
  source 1..20: mol_type = other DNA
ggcgacccgggccgtccgtg

SEQ ID NO: 3702 - DNA, 20 bp, synthetic construct
  misc_feature 1..20: note = CRISPR gRNA sequence
  source 1..20: mol_type = other DNA
gcgacccgggccgtccgtgg

SEQ ID NO: 3703 - DNA, 20 bp, synthetic construct
  misc_feature 1..20: note = CRISPR gRNA sequence
  source 1..20: mol_type = other DNA
cccgggccgtccgtggggga

SEQ ID NO: 3704 - DNA, 20 bp, synthetic construct
  misc_feature 1..20: note = CRISPR gRNA sequence
  source 1..20: mol_type = other DNA
ccgggccgtccgtgggggat

SEQ ID NO: 3705 - DNA, 20 bp, synthetic construct
  misc_feature 1..20: note = CRISPR gRNA sequence
  source 1..20: mol_type = other DNA
cgggccgtccgtgggggatg

SEQ ID NO: 3706 - DNA, 20 bp, synthetic construct
  misc_feature 1..20: note = CRISPR gRNA sequence
  source 1..20: mol_type = other DNA
ggccgtccgtgggggatggg

SEQ ID NO: 3707 - DNA, 20 bp, synthetic construct
  misc_feature 1..20: note = CRISPR gRNA sequence
  source 1..20: mol_type = other DNA
gccgtccgtgggggatgggg

SEQ ID NO: 3708 - DNA, 20 bp, synthetic construct
  misc_feature 1..20: note = CRISPR gRNA sequence
  source 1..20: mol_type = other DNA
ccgtccgtgggggatgggga

SEQ ID NO: 3709 - DNA, 20 bp, synthetic construct
  misc_feature 1..20: note = CRISPR gRNA sequence
  source 1..20: mol_type = other DNA
cgtccgtgggggatggggag

SEQ ID NO: 3710 - DNA, 20 bp, synthetic construct
  misc_feature 1..20: note = CRISPR gRNA sequence
  source 1..20: mol_type = other DNA
aggggtcgtgacctgcgccc

SEQ ID NO: 3711 - DNA, 20 bp, synthetic construct
  misc_feature 1..20: note = CRISPR gRNA sequence
  source 1..20: mol_type = other DNA
ggggtcgtgacctgcgcccc

SEQ ID NO: 3712 - DNA, 20 bp, synthetic construct
  misc_feature 1..20: note = CRISPR gRNA sequence
  source 1..20: mol_type = other DNA
tcgtgacctgcgccccgggc

SEQ ID NO: 3713 - DNA, 20 bp, synthetic construct
  misc_feature 1..20: note = CRISPR gRNA sequence
  source 1..20: mol_type = other DNA
cgtgacctgcgccccgggcc

SEQ ID NO: 3714 - DNA, 20 bp, synthetic construct
  misc_feature 1..20: note = CRISPR gRNA sequence
  source 1..20: mol_type = other DNA
gtgacctgcgccccgggccg

SEQ ID NO: 3715 - DNA, 20 bp, synthetic construct
  misc_feature 1..20: note = CRISPR gRNA sequence
  source 1..20: mol_type = other DNA
gtcactcaccgtcctcgctc

SEQ ID NO: 3716 - DNA, 20 bp, synthetic construct
  misc_feature 1..20: note = CRISPR gRNA sequence
  source 1..20: mol_type = other DNA
caccgtcctcgctctggttg

SEQ ID NO: 3717 - DNA, 20 bp, synthetic construct
  misc_feature 1..20: note = CRISPR gRNA sequence
  source 1..20: mol_type = other DNA
cgtcctcgctctggttgtag

SEQ ID NO: 3718 - DNA, 20 bp, synthetic construct
  misc_feature 1..20: note = CRISPR gRNA sequence
  source 1..20: mol_type = other DNA
ctctggttgtagtagccgcg

SEQ ID NO: 3719 - DNA, 20 bp, synthetic construct
  misc_feature 1..20: note = CRISPR gRNA sequence
  source 1..20: mol_type = other DNA
tctggttgtagtagccgcgc

SEQ ID NO: 3720 - DNA, 20 bp, synthetic construct
  misc_feature 1..20: note = CRISPR gRNA sequence
  source 1..20: mol_type = other DNA
tagtagccgcgcaggttccg

SEQ ID NO: 3721 - DNA, 20 bp, synthetic construct
  misc_feature 1..20: note = CRISPR gRNA sequence
  source 1..20: mol_type = other DNA
agtagccgcgcaggttccgc

SEQ ID NO: 3722 - DNA, 20 bp, synthetic construct
  misc_feature 1..20: note = CRISPR gRNA sequence
  source 1..20: mol_type = other DNA
gcaggttccgcaggctcact

SEQ ID NO: 3723 - DNA, 20 bp, synthetic construct
  misc_feature 1..20: note = CRISPR gRNA sequence
  source 1..20: mol_type = other DNA
gttccgcaggctcactcggt

SEQ ID NO: 3724 - DNA, 20 bp, synthetic construct
  misc_feature 1..20: note = CRISPR gRNA sequence
  source 1..20: mol_type = other DNA
tcactcggtcagcctgtgcc

SEQ ID NO: 3725 - DNA, 20 bp, synthetic construct
  misc_feature 1..20: note = CRISPR gRNA sequence
  source 1..20: mol_type = other DNA
cagcctgtgcctggcgcttg

SEQ ID NO: 3726 - DNA, 20 bp, synthetic construct
  misc_feature 1..20: note = CRISPR gRNA sequence
  source 1..20: mol_type = other DNA
gcttgtagttctgtgtctcc

SEQ ID NO: 3727 - DNA, 20 bp, synthetic construct
  misc_feature 1..20: note = CRISPR gRNA sequence
  source 1..20: mol_type = other DNA
gtctcccggtcccaatactc

SEQ ID NO: 3728 - DNA, 20 bp, synthetic construct
  misc_feature 1..20: note = CRISPR gRNA sequence
  source 1..20: mol_type = other DNA
ggcccctcctgctccaccca

SEQ ID NO: 3729 - DNA, 20 bp, synthetic construct
  misc_feature 1..20: note = CRISPR gRNA sequence
  source 1..20: mol_type = other DNA
tgctccacccacggcgcccg

SEQ ID NO: 3730 - DNA, 20 bp, synthetic construct
  misc_feature 1..20: note = CRISPR gRNA sequence
  source 1..20: mol_type = other DNA
ggcgcccgcggctcccctct

SEQ ID NO: 3731 - DNA, 20 bp, synthetic construct
  misc_feature 1..20: note = CRISPR gRNA sequence
  source 1..20: mol_type = other DNA
cggctcccctctcggactcg

SEQ ID NO: 3732 - DNA, 20 bp, synthetic construct
  misc_feature 1..20: note = CRISPR gRNA sequence
  source 1..20: mol_type = other DNA
cgaactgcgtgtcgtccacg

SEQ ID NO: 3733 - DNA, 20 bp, synthetic construct
  misc_feature 1..20: note = CRISPR gRNA sequence
  source 1..20: mol_type = other DNA
tgtcgtccacgtagcccact

SEQ ID NO: 3734 - DNA, 20 bp, synthetic construct
  misc_feature 1..20: note = CRISPR gRNA sequence
  source 1..20: mol_type = other DNA
ccacgtagcccactgagatg

SEQ ID NO: 3735 - DNA, 20 bp, synthetic construct
  misc_feature 1..20: note = CRISPR gRNA sequence
  source 1..20: mol_type = other DNA
cgtagcccactgagatgaag

SEQ ID NO: 3736 - DNA, 20 bp, synthetic construct
  misc_feature 1..20: note = CRISPR gRNA sequence
  source 1..20: mol_type = other DNA
gtagcccactgagatgaagc

SEQ ID NO: 3737 - DNA, 20 bp, synthetic construct
  misc_feature 1..20: note = CRISPR gRNA sequence
  source 1..20: mol_type = other DNA
tagcccactgagatgaagcg

SEQ ID NO: 3738 - DNA, 20 bp, synthetic construct
  misc_feature 1..20: note = CRISPR gRNA sequence
  source 1..20: mol_type = other DNA
agatgaagcggggctctccg

SEQ ID NO: 3739 - DNA, 20 bp, synthetic construct
  misc_feature 1..20: note = CRISPR gRNA sequence
  source 1..20: mol_type = other DNA
gaagcggggctctccgcggc

SEQ ID NO: 3740 - DNA, 20 bp, synthetic construct
  misc_feature 1..20: note = CRISPR gRNA sequence
  source 1..20: mol_type = other DNA
aagcggggctctccgcggcc

SEQ ID NO: 3741 - DNA, 20 bp, synthetic construct
  misc_feature 1..20: note = CRISPR gRNA sequence
  source 1..20: mol_type = other DNA
ggggctctccgcggccgggc

SEQ ID NO: 3742 - DNA, 20 bp, synthetic construct
  misc_feature 1..20: note = CRISPR gRNA sequence
  source 1..20: mol_type = other DNA
gggctctccgcggccgggcc

SEQ ID NO: 3743 - DNA, 20 bp, synthetic construct
  misc_feature 1..20: note = CRISPR gRNA sequence
  source 1..20: mol_type = other DNA
tccgcggccgggccgggaca

SEQ ID NO: 3744 - DNA, 20 bp, synthetic construct
  misc_feature 1..20: note = CRISPR gRNA sequence
  source 1..20: mol_type = other DNA
gcggccgggccgggacacgg

SEQ ID NO: 3745 - DNA, 20 bp, synthetic construct
  misc_feature 1..20: note = CRISPR gRNA sequence
  source 1..20: mol_type = other DNA
ggcggtgtcgaaatacctca

SEQ ID NO: 3746 - DNA, 20 bp, synthetic construct
  misc_feature 1..20: note = CRISPR gRNA sequence
  source 1..20: mol_type = other DNA
cggtgtcgaaatacctcatg

SEQ ID NO: 3747 - DNA, 20 bp, synthetic construct
  misc_feature 1..20: note = CRISPR gRNA sequence
  source 1..20: mol_type = other DNA
tgtcgaaatacctcatggag

SEQ ID NO: 3748 - DNA, 20 bp, synthetic construct
  misc_feature 1..20: note = CRISPR gRNA sequence
  source 1..20: mol_type = other DNA
gtcgaaatacctcatggagt

SEQ ID NO: 3749 - DNA, 20 bp, synthetic construct
  misc_feature 1..20: note = CRISPR gRNA sequence
  source 1..20: mol_type = other DNA
cgaaatacctcatggagtgg

SEQ ID NO: 3750 - DNA, 20 bp, synthetic construct
  misc_feature 1..20: note = CRISPR gRNA sequence
  source 1..20: mol_type = other DNA
tacctcatggagtgggagcc

SEQ ID NO: 3751 - DNA, 20 bp, synthetic construct
  misc_feature 1..20: note = CRISPR gRNA sequence
  source 1..20: mol_type = other DNA
acctcatggagtgggagcct

SEQ ID NO: 3752 - DNA, 20 bp, synthetic construct
  misc_feature 1..20: note = CRISPR gRNA sequence
  source 1..20: mol_type = other DNA
cctcatggagtgggagcctg

SEQ ID NO: 3753 - DNA, 20 bp, synthetic construct
  misc_feature 1..20: note = CRISPR gRNA sequence
  source 1..20: mol_type = other DNA
ctcatggagtgggagcctgg

SEQ ID NO: 3754 - DNA, 20 bp, synthetic construct
  misc_feature 1..20: note = CRISPR gRNA sequence
  source 1..20: mol_type = other DNA
tggagtgggagcctgggggc

SEQ ID NO: 3755 - DNA, 20 bp, synthetic construct
  misc_feature 1..20: note = CRISPR gRNA sequence
  source 1..20: mol_type = other DNA
ggagtgggagcctgggggcg

SEQ ID NO: 3756 - DNA, 20 bp, synthetic construct
  misc_feature 1..20: note = CRISPR gRNA sequence
  source 1..20: mol_type = other DNA
agtgggagcctgggggcgag

SEQ ID NO: 3757 - DNA, 20 bp, synthetic construct
  misc_feature 1..20: note = CRISPR gRNA sequence
  source 1..20: mol_type = other DNA
gtgggagcctgggggcgagg

SEQ ID NO: 3758 - DNA, 20 bp, synthetic construct
  misc_feature 1..20: note = CRISPR gRNA sequence
  source 1..20: mol_type = other DNA
tgggagcctgggggcgagga

SEQ ID NO: 3759 - DNA, 20 bp, synthetic construct
  misc_feature 1..20: note = CRISPR gRNA sequence
  source 1..20: mol_type = other DNA
gggagcctgggggcgaggag

SEQ ID NO: 3760 - DNA, 20 bp, synthetic construct
  misc_feature 1..20: note = CRISPR gRNA sequence
  source 1..20: mol_type = other DNA
cctgggggcgaggaggggct

SEQ ID NO: 3761 - DNA, 20 bp, synthetic construct
  misc_feature 1..20: note = CRISPR gRNA sequence
  source 1..20: mol_type = other DNA
gcccgacccacctccctgcg

SEQ ID NO: 3762 - DNA, 20 bp, synthetic construct
  misc_feature 1..20: note = CRISPR gRNA sequence
  source 1..20: mol_type = other DNA
cacctccctgcgcggctccc

SEQ ID NO: 3763 - DNA, 20 bp, synthetic construct
  misc_feature 1..20: note = CRISPR gRNA sequence
  source 1..20: mol_type = other DNA
acctccctgcgcggctcccc

SEQ ID NO: 3764 - DNA, 20 bp, synthetic construct
  misc_feature 1..20: note = CRISPR gRNA sequence
  source 1..20: mol_type = other DNA
cccgggtcctgcgccctcgc

SEQ ID NO: 3765 - DNA, 20 bp, synthetic construct
  misc_feature 1..20: note = CRISPR gRNA sequence
  source 1..20: mol_type = other DNA
ccgggtcctgcgccctcgcc

SEQ ID NO: 3766 - DNA, 20 bp, synthetic construct
  misc_feature 1..20: note = CRISPR gRNA sequence
  source 1..20: mol_type = other DNA
ggtcctgcgccctcgccggg

SEQ ID NO: 3767 - DNA, 20 bp, synthetic construct
  misc_feature 1..20: note = CRISPR gRNA sequence
  source 1..20: mol_type = other DNA
gtcctgcgccctcgccgggc

SEQ ID NO: 3768 - DNA, 20 bp, synthetic construct
  misc_feature 1..20: note = CRISPR gRNA sequence
  source 1..20: mol_type = other DNA
gggcccctcgctcctctccg

SEQ ID NO: 3769 - DNA, 20 bp, synthetic construct
  misc_feature 1..20: note = CRISPR gRNA sequence
  source 1..20: mol_type = other DNA
gcccctcgctcctctccgca

SEQ ID NO: 3770 - DNA, 20 bp, synthetic construct
  misc_feature 1..20: note = CRISPR gRNA sequence
  source 1..20: mol_type = other DNA
cccctcgctcctctccgcag

SEQ ID NO: 3771 - DNA, 20 bp, synthetic construct
  misc_feature 1..20: note = CRISPR gRNA sequence
  source 1..20: mol_type = other DNA
ccctcccaaccccgcactca

SEQ ID NO: 3772 - DNA, 20 bp, synthetic construct
  misc_feature 1..20: note = CRISPR gRNA sequence
  source 1..20: mol_type = other DNA
cctcccaaccccgcactcac

SEQ ID NO: 3773 - DNA, 20 bp, synthetic construct
  misc_feature 1..20: note = CRISPR gRNA sequence
  source 1..20: mol_type = other DNA
caaccccgcactcacaggcc

SEQ ID NO: 3774 - DNA, 20 bp, synthetic construct
  misc_feature 1..20: note = CRISPR gRNA sequence
  source 1..20: mol_type = other DNA
aaccccgcactcacaggccc

SEQ ID NO: 3775 - DNA, 20 bp, synthetic construct
  misc_feature 1..20: note = CRISPR gRNA sequence
  source 1..20: mol_type = other DNA
gcactcacaggcccaggtct

SEQ ID NO: 3776 - DNA, 20 bp, synthetic construct
  misc_feature 1..20: note = CRISPR gRNA sequence
  source 1..20: mol_type = other DNA
tcacaggcccaggtctcggt

SEQ ID NO: 3777 - DNA, 20 bp, synthetic construct
  misc_feature 1..20: note = CRISPR gRNA sequence
  source 1..20: mol_type = other DNA
cacaggcccaggtctcggtc

SEQ ID NO: 3778 - DNA, 20 bp, synthetic construct
  misc_feature 1..20: note = CRISPR gRNA sequence
  source 1..20: mol_type = other DNA
acaggcccaggtctcggtca

SEQ ID NO: 3779 - DNA, 20 bp, synthetic construct
  misc_feature 1..20: note = CRISPR gRNA sequence
  source 1..20: mol_type = other DNA
gcccaggtctcggtcagggc

SEQ ID NO: 3780 - DNA, 20 bp, synthetic construct
  misc_feature 1..20: note = CRISPR gRNA sequence
  source 1..20: mol_type = other DNA
cccaggtctcggtcagggcc

SEQ ID NO: 3781 - DNA, 20 bp, synthetic construct
  misc_feature 1..20: note = CRISPR gRNA sequence
  source 1..20: mol_type = other DNA
cggtcagggccaggcctccc

SEQ ID NO: 3782 - DNA, 20 bp, synthetic construct
  misc_feature 1..20: note = CRISPR gRNA sequence
  source 1..20: mol_type = other DNA
gtcagggccaggcctcccga

SEQ ID NO: 3783 - DNA, 20 bp, synthetic construct
  misc_feature 1..20: note = CRISPR gRNA sequence
  source 1..20: mol_type = other DNA
agggccaggcctcccgagag

SEQ ID NO: 3784 - DNA, 20 bp, synthetic construct
  misc_feature 1..20: note = CRISPR gRNA sequence
  source 1..20: mol_type = other DNA
gccaggcctcccgagagcag

SEQ ID NO: 3785 - DNA, 20 bp, synthetic construct
  misc_feature 1..20: note = CRISPR gRNA sequence
  source 1..20: mol_type = other DNA
ccaggcctcccgagagcagc

SEQ ID NO: 3786 - DNA, 20 bp, synthetic construct
  misc_feature 1..20: note = CRISPR gRNA sequence
  source 1..20: mol_type = other DNA
aggcctcccgagagcagcag

SEQ ID NO: 3787 - DNA, 20 bp, synthetic construct
  misc_feature 1..20: note = CRISPR gRNA sequence
  source 1..20: mol_type = other DNA
ggcctcccgagagcagcagg

SEQ ID NO: 3788 - DNA, 20 bp, synthetic construct
  misc_feature 1..20: note = CRISPR gRNA sequence
  source 1..20: mol_type = other DNA
cctcccgagagcagcaggag

SEQ ID NO: 3789 - DNA, 20 bp, synthetic construct
  misc_feature 1..20: note = CRISPR gRNA sequence
  source 1..20: mol_type = other DNA
ctcccgagagcagcaggagg

SEQ ID NO: 3790 - DNA, 20 bp, synthetic construct
  misc_feature 1..20: note = CRISPR gRNA sequence
  source 1..20: mol_type = other DNA
tcccgagagcagcaggagga

SEQ ID NO: 3791 - DNA, 20 bp, synthetic construct
  misc_feature 1..20: note = CRISPR gRNA sequence
  source 1..20: mol_type = other DNA
agagcagcaggaggagggct

SEQ ID NO: 3792 - DNA, 20 bp, synthetic construct
  misc_feature 1..20: note = CRISPR gRNA sequence
  source 1..20: mol_type = other DNA
gagcagcaggaggagggctc

SEQ ID NO: 3793 - DNA, 20 bp, synthetic construct
  misc_feature 1..20: note = CRISPR gRNA sequence
  source 1..20: mol_type = other DNA
agcagcaggaggagggctcg

SEQ ID NO: 3794 - DNA, 20 bp, synthetic construct
  misc_feature 1..20: note = CRISPR gRNA sequence
  source 1..20: mol_type = other DNA
gggcgccatgacccgcatct

SEQ ID NO: 3795 - DNA, 20 bp, synthetic construct
  misc_feature 1..20: note = CRISPR gRNA sequence
  source 1..20: mol_type = other DNA
atgacccgcatctcggcctc

SEQ ID NO: 3796 - DNA, 20 bp, synthetic construct
  misc_feature 1..20: note = CRISPR gRNA sequence
  source 1..20: mol_type = other DNA
tgacccgcatctcggcctct

SEQ ID NO: 3797 - DNA, 20 bp, synthetic construct
  misc_feature 1..20: note = CRISPR gRNA sequence
  source 1..20: mol_type = other DNA
gacccgcatctcggcctctg

SEQ ID NO: 3798 - DNA, 20 bp, synthetic construct
  misc_feature 1..20: note = CRISPR gRNA sequence
  source 1..20: mol_type = other DNA
cccgcatctcggcctctggg

SEQ ID NO: 3799 - DNA, 20 bp, synthetic construct
  misc_feature 1..20: note = CRISPR gRNA sequence
  source 1..20: mol_type = other DNA
tcggcctctggggagaatgt

SEQ ID NO: 3800 - DNA, 20 bp, synthetic construct
  misc_feature 1..20: note = CRISPR gRNA sequence
  source 1..20: mol_type = other DNA
ctctggggagaatgtgagtc

SEQ ID NO: 3801 - DNA, 20 bp, synthetic construct
  misc_feature 1..20: note = CRISPR gRNA sequence
  source 1..20: mol_type = other DNA
tctggggagaatgtgagtcc

SEQ ID NO: 3802 - DNA, 20 bp, synthetic construct
  misc_feature 1..20: note = CRISPR gRNA sequence
  source 1..20: mol_type = other DNA
ggggagaatgtgagtccggg

SEQ ID NO: 3803 - DNA, 20 bp, synthetic construct
  misc_feature 1..20: note = CRISPR gRNA sequence
  source 1..20: mol_type = other DNA
gggagaatgtgagtccgggt

SEQ ID NO: 3804 - DNA, 20 bp, synthetic construct
  misc_feature 1..20: note = CRISPR gRNA sequence
  source 1..20: mol_type = other DNA
tgtgagtccgggtgggtgac

SEQ ID NO: 3805 - DNA, 20 bp, synthetic construct
  misc_feature 1..20: note = CRISPR gRNA sequence
  source 1..20: mol_type = other DNA
gtgagtccgggtgggtgact

SEQ ID NO: 3806 - DNA, 20 bp, synthetic construct
  misc_feature 1..20: note = CRISPR gRNA sequence
  source 1..20: mol_type = other DNA
tgagtccgggtgggtgactg

SEQ ID NO: 3807 - DNA, 20 bp, synthetic construct
  misc_feature 1..20: note = CRISPR gRNA sequence
  source 1..20: mol_type = other DNA
gggtgggtgactggggactt

SEQ ID NO: 3808 - DNA, 20 bp, synthetic construct
  misc_feature 1..20: note = CRISPR gRNA sequence
  source 1..20: mol_type = other DNA
gtgactggggactttagaac

SEQ ID NO: 3809 - DNA, 20 bp, synthetic construct
  misc_feature 1..20: note = CRISPR gRNA sequence
  source 1..20: mol_type = other DNA
tgactggggactttagaacc

SEQ ID NO: 3810 - DNA, 20 bp, synthetic construct
  misc_feature 1..20: note = CRISPR gRNA sequence
  source 1..20: mol_type = other DNA
ggactttagaaccgggactg

SEQ ID NO: 3811 - DNA, 20 bp, synthetic construct
  misc_feature 1..20: note = CRISPR gRNA sequence
  source 1..20: mol_type = other DNA
actttagaaccgggactgcg

SEQ ID NO: 3812 - DNA, 20 bp, synthetic construct
  misc_feature 1..20: note = CRISPR gRNA sequence
  source 1..20: mol_type = other DNA
gggactgcggagacgctgat

SEQ ID NO: 3813 - DNA, 20 bp, synthetic construct
  misc_feature 1..20: note = CRISPR gRNA sequence
  source 1..20: mol_type = other DNA
gagacgctgattggcttctc

SEQ ID NO: 3814 - DNA, 20 bp, synthetic construct
  misc_feature 1..20: note = CRISPR gRNA sequence
  source 1..20: mol_type = other DNA
ttgggtgtcgggttctagag

SEQ ID NO: 3815 - DNA, 20 bp, synthetic construct
  misc_feature 1..20: note = CRISPR gRNA sequence
  source 1..20: mol_type = other DNA
cgggttctagagaagccaat

SEQ ID NO: 3816 - DNA, 20 bp, synthetic construct
  misc_feature 1..20: note = CRISPR gRNA sequence
  source 1..20: mol_type = other DNA
gaagccaatcagcgtctccg

SEQ ID NO: 3817 - DNA, 20 bp, synthetic construct
  misc_feature 1..20: note = CRISPR gRNA sequence
  source 1..20: mol_type = other DNA
aatcagcgtctccgcagtcc

SEQ ID NO: 3818 - DNA, 20 bp, synthetic construct
  misc_feature 1..20: note = CRISPR gRNA sequence
  source 1..20: mol_type = other DNA
tctccgcagtcccggttcta

SEQ ID NO: 3819 - DNA, 20 bp, synthetic construct
  misc_feature 1..20: note = CRISPR gRNA sequence
  source 1..20: mol_type = other DNA
agtcccggttctaaagtccc

SEQ ID NO: 3820 - DNA, 20 bp, synthetic construct
  misc_feature 1..20: note = CRISPR gRNA sequence
  source 1..20: mol_type = other DNA
aaagtccccagtcacccacc

SEQ ID NO: 3821 - DNA, 20 bp, synthetic construct
  misc_feature 1..20: note = CRISPR gRNA sequence
  source 1..20: mol_type = other DNA
acccggactcacattctccc

SEQ ID NO: 3822 - DNA, 20 bp, synthetic construct
  misc_feature 1..20: note = CRISPR gRNA sequence
  source 1..20: mol_type = other DNA
ccggactcacattctcccca

SEQ ID NO: 3823 - DNA, 20 bp, synthetic construct
  misc_feature 1..20: note = CRISPR gRNA sequence
  source 1..20: mol_type = other DNA
cggactcacattctccccag

SEQ ID NO: 3824 - DNA, 20 bp, synthetic construct
  misc_feature 1..20: note = CRISPR gRNA sequence
  source 1..20: mol_type = other DNA
tcacattctccccagaggcc

SEQ ID NO: 3825 - DNA, 20 bp, synthetic construct
  misc_feature 1..20: note = CRISPR gRNA sequence
  source 1..20: mol_type = other DNA
tctccccagaggccgagatg

SEQ ID NO: 3826 - DNA, 20 bp, synthetic construct
  misc_feature 1..20: note = CRISPR gRNA sequence
  source 1..20: mol_type = other DNA
ctccccagaggccgagatgc

SEQ ID NO: 3827 - DNA, 20 bp, synthetic construct
  misc_feature 1..20: note = CRISPR gRNA sequence
  source 1..20: mol_type = other DNA
agaggccgagatgcgggtca

SEQ ID NO: 3828 - DNA, 20 bp, synthetic construct
  misc_feature 1..20: note = CRISPR gRNA sequence
  source 1..20: mol_type = other DNA
gatgcgggtcatggcgcccc

SEQ ID NO: 3829 - DNA, 20 bp, synthetic construct
  misc_feature 1..20: note = CRISPR gRNA sequence
  source 1..20: mol_type = other DNA
agccctcctcctgctgctct

SEQ ID NO: 3830 - DNA, 20 bp, synthetic construct
  misc_feature 1..20: note = CRISPR gRNA sequence
  source 1..20: mol_type = other DNA
gccctcctcctgctgctctc

SEQ ID NO: 3831 - DNA, 20 bp, synthetic construct
  misc_feature 1..20: note = CRISPR gRNA sequence
  source 1..20: mol_type = other DNA
cctcctcctgctgctctcgg

SEQ ID NO: 3832 - DNA, 20 bp, synthetic construct
  misc_feature 1..20: note = CRISPR gRNA sequence
  source 1..20: mol_type = other DNA
ctcctcctgctgctctcggg

SEQ ID NO: 3833 - DNA, 20 bp, synthetic construct
  misc_feature 1..20: note = CRISPR gRNA sequence
  source 1..20: mol_type = other DNA
cctgctgctctcgggaggcc

SEQ ID NO: 3834 - DNA, 20 bp, synthetic construct
  misc_feature 1..20: note = CRISPR gRNA sequence
  source 1..20: mol_type = other DNA
cgggaggcctggccctgacc

SEQ ID NO: 3835 - DNA, 20 bp, synthetic construct
  misc_feature 1..20: note = CRISPR gRNA sequence
  source 1..20: mol_type = other DNA
gcctggccctgaccgagacc

SEQ ID NO: 3836 - DNA, 20 bp, synthetic construct
  misc_feature 1..20: note = CRISPR gRNA sequence
  source 1..20: mol_type = other DNA
cctggccctgaccgagacct

SEQ ID NO: 3837 - DNA, 20 bp, synthetic construct
  misc_feature 1..20: note = CRISPR gRNA sequence
  source 1..20: mol_type = other DNA
tgaccgagacctgggcctgt

SEQ ID NO: 3838 - DNA, 20 bp, synthetic construct
  misc_feature 1..20: note = CRISPR gRNA sequence
  source 1..20: mol_type = other DNA
gagacctgggcctgtgagtg

SEQ ID NO: 3839 - DNA, 20 bp, synthetic construct
  misc_feature 1..20: note = CRISPR gRNA sequence
  source 1..20: mol_type = other DNA
agacctgggcctgtgagtgc

SEQ ID NO: 3840 - DNA, 20 bp, synthetic construct
  misc_feature 1..20: note = CRISPR gRNA sequence
  source 1..20: mol_type = other DNA
gacctgggcctgtgagtgcg

SEQ ID NO: 3841 - DNA, 20 bp, synthetic construct
  misc_feature 1..20: note = CRISPR gRNA sequence
  source 1..20: mol_type = other DNA
tgggcctgtgagtgcggggt

SEQ ID NO: 3842 - DNA, 20 bp, synthetic construct
  misc_feature 1..20: note = CRISPR gRNA sequence
  source 1..20: mol_type = other DNA
gggcctgtgagtgcggggtt

SEQ ID NO: 3843 - DNA, 20 bp, synthetic construct
  misc_feature 1..20: note = CRISPR gRNA sequence
  source 1..20: mol_type = other DNA
gcctgtgagtgcggggttgg

SEQ ID NO: 3844 - DNA, 20 bp, synthetic construct
  misc_feature 1..20: note = CRISPR gRNA sequence
  source 1..20: mol_type = other DNA
cctgtgagtgcggggttggg

SEQ ID NO: 3845 - DNA, 20 bp, synthetic construct
  misc_feature 1..20: note = CRISPR gRNA sequence
  source 1..20: mol_type = other DNA
ctgtgagtgcggggttggga

SEQ ID NO: 3846 - DNA, 20 bp, synthetic construct
  misc_feature 1..20: note = CRISPR gRNA sequence
  source 1..20: mol_type = other DNA
tgagtgcggggttgggaggg

SEQ ID NO: 3847 - DNA, 20 bp, synthetic construct
  misc_feature 1..20: note = CRISPR gRNA sequence
  source 1..20: mol_type = other DNA
gtgcggggttgggagggaag

SEQ ID NO: 3848 - DNA, 20 bp, synthetic construct
  misc_feature 1..20: note = CRISPR gRNA sequence
  source 1..20: mol_type = other DNA
tgggagggaagcggcctctg

SEQ ID NO: 3849 - DNA, 20 bp, synthetic construct
  misc_feature 1..20: note = CRISPR gRNA sequence
  source 1..20: mol_type = other DNA
ggagggaagcggcctctgcg

SEQ ID NO: 3850 - DNA, 20 bp, synthetic construct
  misc_feature 1..20: note = CRISPR gRNA sequence
  source 1..20: mol_type = other DNA
agggaagcggcctctgcgga

SEQ ID NO: 3851 - DNA, 20 bp, synthetic construct
  misc_feature 1..20: note = CRISPR gRNA sequence
  source 1..20: mol_type = other DNA
gggaagcggcctctgcggag

SEQ ID NO: 3852 - DNA, 20 bp, synthetic construct
  misc_feature 1..20: note = CRISPR gRNA sequence
  source 1..20: mol_type = other DNA
gaagcggcctctgcggagag

SEQ ID NO: 3853 - DNA, 20 bp, synthetic construct
  misc_feature 1..20: note = CRISPR gRNA sequence
  source 1..20: mol_type = other DNA
cggcctctgcggagaggagc

SEQ ID NO: 3854 - DNA, 20 bp, synthetic construct
  misc_feature 1..20: note = CRISPR gRNA sequence
  source 1..20: mol_type = other DNA
ggcctctgcggagaggagcg

SEQ ID NO: 3855 - DNA, 20 bp, synthetic construct
  misc_feature 1..20: note = CRISPR gRNA sequence
  source 1..20: mol_type = other DNA
gcctctgcggagaggagcga

SEQ ID NO: 3856 - DNA, 20 bp, synthetic construct
  misc_feature 1..20: note = CRISPR gRNA sequence
  source 1..20: mol_type = other DNA
cctctgcggagaggagcgag

SEQ ID NO: 3857 - DNA, 20 bp, synthetic construct
  misc_feature 1..20: note = CRISPR gRNA sequence
  source 1..20: mol_type = other DNA
agaggagcgaggggcccgcc

SEQ ID NO: 3858 - DNA, 20 bp, synthetic construct
  misc_feature 1..20: note = CRISPR gRNA sequence
  source 1..20: mol_type = other DNA
gagcgaggggcccgcccggc

SEQ ID NO: 3859 - DNA, 20 bp, synthetic construct
  misc_feature 1..20: note = CRISPR gRNA sequence
  source 1..20: mol_type = other DNA
agcgaggggcccgcccggcg

SEQ ID NO: 3860 - DNA, 20 bp, synthetic construct
  misc_feature 1..20: note = CRISPR gRNA sequence
  source 1..20: mol_type = other DNA
gcgaggggcccgcccggcga

SEQ ID NO: 3861 - DNA, 20 bp, synthetic construct
  misc_feature 1..20: note = CRISPR gRNA sequence
  source 1..20: mol_type = other DNA
gggcccgcccggcgagggcg

SEQ ID NO: 3862 - DNA, 20 bp, synthetic construct
  misc_feature 1..20: note = CRISPR gRNA sequence
  source 1..20: mol_type = other DNA
ggcccgcccggcgagggcgc

SEQ ID NO: 3863 - DNA, 20 bp, synthetic construct
  misc_feature 1..20: note = CRISPR gRNA sequence
  source 1..20: mol_type = other DNA
cccggcgagggcgcaggacc

SEQ ID NO: 3864 - DNA, 20 bp, synthetic construct
  misc_feature 1..20: note = CRISPR gRNA sequence
  source 1..20: mol_type = other DNA
ccggcgagggcgcaggaccc

SEQ ID NO: 3865 - DNA, 20 bp, synthetic construct
  misc_feature 1..20: note = CRISPR gRNA sequence
  source 1..20: mol_type = other DNA
cggcgagggcgcaggacccg

SEQ ID NO: 3866 - DNA, 20 bp, synthetic construct
  misc_feature 1..20: note = CRISPR gRNA sequence
  source 1..20: mol_type = other DNA
gcgagggcgcaggacccggg

SEQ ID NO: 3867 - DNA, 20 bp, synthetic construct
  misc_feature 1..20: note = CRISPR gRNA sequence
  source 1..20: mol_type = other DNA
gcaggacccggggagccgcg

SEQ ID NO: 3868 - DNA, 20 bp, synthetic construct
  misc_feature 1..20: note = CRISPR gRNA sequence
  source 1..20: mol_type = other DNA
caggacccggggagccgcgc

SEQ ID NO: 3869 - DNA, 20 bp, synthetic construct
  misc_feature 1..20: note = CRISPR gRNA sequence
  source 1..20: mol_type = other DNA
aggacccggggagccgcgca

SEQ ID NO: 3870 - DNA, 20 bp, synthetic construct
  misc_feature 1..20: note = CRISPR gRNA sequence
  source 1..20: mol_type = other DNA
gacccggggagccgcgcagg

SEQ ID NO: 3871 - DNA, 20 bp, synthetic construct
  misc_feature 1..20: note = CRISPR gRNA sequence
  source 1..20: mol_type = other DNA
acccggggagccgcgcaggg

SEQ ID NO: 3872 - DNA, 20 bp, synthetic construct
  misc_feature 1..20: note = CRISPR gRNA sequence
  source 1..20: mol_type = other DNA
cggggagccgcgcagggagg

SEQ ID NO: 3873 - DNA, 20 bp, synthetic construct
  misc_feature 1..20: note = CRISPR gRNA sequence
  source 1..20: mol_type = other DNA
ggggagccgcgcagggaggt

SEQ ID NO: 3874 - DNA, 20 bp, synthetic construct
  misc_feature 1..20: note = CRISPR gRNA sequence
  source 1..20: mol_type = other DNA
agccgcgcagggaggtgggt

SEQ ID NO: 3875 - DNA, 20 bp, synthetic construct
  misc_feature 1..20: note = CRISPR gRNA sequence
  source 1..20: mol_type = other DNA
gccgcgcagggaggtgggtc

SEQ ID NO: 3876 - DNA, 20 bp, synthetic construct
  misc_feature 1..20: note = CRISPR gRNA sequence
  source 1..20: mol_type = other DNA
gcgcagggaggtgggtcggg

SEQ ID NO: 3877 - DNA, 20 bp, synthetic construct
  misc_feature 1..20: note = CRISPR gRNA sequence
  source 1..20: mol_type = other DNA
cgcagggaggtgggtcgggc

SEQ ID NO: 3878 - DNA, 20 bp, synthetic construct
  misc_feature 1..20: note = CRISPR gRNA sequence
  source 1..20: mol_type = other DNA
gaggtgggtcgggcgggtct

SEQ ID NO: 3879 - DNA, 20 bp, synthetic construct
  misc_feature 1..20: note = CRISPR gRNA sequence
  source 1..20: mol_type = other DNA
tctcagcccctcctcgcccc

SEQ ID NO: 3880 - DNA, 20 bp, synthetic construct
  misc_feature 1..20: note = CRISPR gRNA sequence
  source 1..20: mol_type = other DNA
ctcagcccctcctcgccccc

SEQ ID NO: 3881 - DNA, 20 bp, synthetic construct
  misc_feature 1..20: note = CRISPR gRNA sequence
  source 1..20: mol_type = other DNA
cccccaggctcccactccat

SEQ ID NO: 3882 - DNA, 20 bp, synthetic construct
  misc_feature 1..20: note = CRISPR gRNA sequence
  source 1..20: mol_type = other DNA
ccccaggctcccactccatg

SEQ ID NO: 3883 - DNA, 20 bp, synthetic construct
  misc_feature 1..20: note = CRISPR gRNA sequence
  source 1..20: mol_type = other DNA
atttcgacaccgccgtgtcc

SEQ ID NO: 3884 - DNA, 20 bp, synthetic construct
  misc_feature 1..20: note = CRISPR gRNA sequence
  source 1..20: mol_type = other DNA
gacaccgccgtgtcccggcc

SEQ ID NO: 3885 - DNA, 20 bp, synthetic construct
  misc_feature 1..20: note = CRISPR gRNA sequence
  source 1..20: mol_type = other DNA
gccgtgtcccggcccggccg

SEQ ID NO: 3886 - DNA, 20 bp, synthetic construct
  misc_feature 1..20: note = CRISPR gRNA sequence
  source 1..20: mol_type = other DNA
cgtgtcccggcccggccgcg

SEQ ID NO: 3887 - DNA, 20 bp, synthetic construct
  misc_feature 1..20: note = CRISPR gRNA sequence
  source 1..20: mol_type = other DNA
tgtcccggcccggccgcgga

SEQ ID NO: 3888 - DNA, 20 bp, synthetic construct
  misc_feature 1..20: note = CRISPR gRNA sequence
  source 1..20: mol_type = other DNA
cggagagccccgcttcatct

SEQ ID NO: 3889 - DNA, 20 bp, synthetic construct
  misc_feature 1..20: note = CRISPR gRNA sequence
  source 1..20: mol_type = other DNA
agagccccgcttcatctcag

SEQ ID NO: 3890 - DNA, 20 bp, synthetic construct
  misc_feature 1..20: note = CRISPR gRNA sequence
  source 1..20: mol_type = other DNA
gagccccgcttcatctcagt

SEQ ID NO: 3891 - DNA, 20 bp, synthetic construct
  misc_feature 1..20: note = CRISPR gRNA sequence
  source 1..20: mol_type = other DNA
cttcatctcagtgggctacg

SEQ ID NO: 3892 - DNA, 20 bp, synthetic construct
  misc_feature 1..20: note = CRISPR gRNA sequence
  source 1..20: mol_type = other DNA
tgggctacgtggacgacacg

SEQ ID NO: 3893 - DNA, 20 bp, synthetic construct
  misc_feature 1..20: note = CRISPR gRNA sequence
  source 1..20: mol_type = other DNA
tggacgacacgcagttcgtg

SEQ ID NO: 3894 - DNA, 20 bp, synthetic construct
  misc_feature 1..20: note = CRISPR gRNA sequence
  source 1..20: mol_type = other DNA
acgcagttcgtgcggttcga

SEQ ID NO: 3895 - DNA, 20 bp, synthetic construct
  misc_feature 1..20: note = CRISPR gRNA sequence
  source 1..20: mol_type = other DNA
cggttcgacagcgacgccgc

SEQ ID NO: 3896 - DNA, 20 bp, synthetic construct
  misc_feature 1..20: note = CRISPR gRNA sequence
  source 1..20: mol_type = other DNA
gacagcgacgccgcgagtcc

SEQ ID NO: 3897 - DNA, 20 bp, synthetic construct
  misc_feature 1..20: note = CRISPR gRNA sequence
  source 1..20: mol_type = other DNA
cagcgacgccgcgagtccga

SEQ ID NO: 3898 - DNA, 20 bp, synthetic construct
  misc_feature 1..20: note = CRISPR gRNA sequence
  source 1..20: mol_type = other DNA
agcgacgccgcgagtccgag

SEQ ID NO: 3899 - DNA, 20 bp, synthetic construct
  misc_feature 1..20: note = CRISPR gRNA sequence
  source 1..20: mol_type = other DNA
gcgacgccgcgagtccgaga

SEQ ID NO: 3900 - DNA, 20 bp, synthetic construct
  misc_feature 1..20: note = CRISPR gRNA sequence
  source 1..20: mol_type = other DNA
cgacgccgcgagtccgagag

SEQ ID NO: 3901 - DNA, 20 bp, synthetic construct
  misc_feature 1..20: note = CRISPR gRNA sequence
  source 1..20: mol_type = other DNA
acgccgcgagtccgagaggg

SEQ ID NO: 3902 - DNA, 20 bp, synthetic construct
  misc_feature 1..20: note = CRISPR gRNA sequence
  source 1..20: mol_type = other DNA
cgagtccgagaggggagccg

SEQ ID NO: 3903 - DNA, 20 bp, synthetic construct
  misc_feature 1..20: note = CRISPR gRNA sequence
  source 1..20: mol_type = other DNA
gagtccgagaggggagccgc

SEQ ID NO: 3904 - DNA, 20 bp, synthetic construct
  misc_feature 1..20: note = CRISPR gRNA sequence
  source 1..20: mol_type = other DNA
gaggggagccgcgggcgccg

SEQ ID NO: 3905 - DNA, 20 bp, synthetic construct
  misc_feature 1..20: note = CRISPR gRNA sequence
  source 1..20: mol_type = other DNA
aggggagccgcgggcgccgt

SEQ ID NO: 3906 - DNA, 20 bp, synthetic construct
  misc_feature 1..20: note = CRISPR gRNA sequence
  source 1..20: mol_type = other DNA
ggagccgcgggcgccgtggg

SEQ ID NO: 3907 - DNA, 20 bp, synthetic construct
  misc_feature 1..20: note = CRISPR gRNA sequence
  source 1..20: mol_type = other DNA
agccgcgggcgccgtgggtg

SEQ ID NO: 3908 - DNA, 20 bp, synthetic construct
  misc_feature 1..20: note = CRISPR gRNA sequence
  source 1..20: mol_type = other DNA
cgcgggcgccgtgggtggag

SEQ ID NO: 3909 - DNA, 20 bp, synthetic construct
  misc_feature 1..20: note = CRISPR gRNA sequence
  source 1..20: mol_type = other DNA
gcgggcgccgtgggtggagc

SEQ ID NO: 3910 - DNA, 20 bp, synthetic construct
  misc_feature 1..20: note = CRISPR gRNA sequence
  source 1..20: mol_type = other DNA
gggcgccgtgggtggagcag

SEQ ID NO: 3911 - DNA, 20 bp, synthetic construct
  misc_feature 1..20: note = CRISPR gRNA sequence
  source 1..20: mol_type = other DNA
ggcgccgtgggtggagcagg

SEQ ID NO: 3912 - DNA, 20 bp, synthetic construct
  misc_feature 1..20: note = CRISPR gRNA sequence
  source 1..20: mol_type = other DNA
gcgccgtgggtggagcagga

SEQ ID NO: 3913 - DNA, 20 bp, synthetic construct
  misc_feature 1..20: note = CRISPR gRNA sequence
  source 1..20: mol_type = other DNA
cgccgtgggtggagcaggag

SEQ ID NO: 3914 - DNA, 20 bp, synthetic construct
  misc_feature 1..20: note = CRISPR gRNA sequence
  source 1..20: mol_type = other DNA
gtgggtggagcaggaggggc

SEQ ID NO: 3915 - DNA, 20 bp, synthetic construct
  misc_feature 1..20: note = CRISPR gRNA sequence
  source 1..20: mol_type = other DNA
gggtggagcaggaggggccg

SEQ ID NO: 3916 - DNA, 20 bp, synthetic construct
  misc_feature 1..20: note = CRISPR gRNA sequence
  source 1..20: mol_type = other DNA
agcaggaggggccggagtat

SEQ ID NO: 3917 - DNA, 20 bp, synthetic construct
  misc_feature 1..20: note = CRISPR gRNA sequence
  source 1..20: mol_type = other DNA
gcaggaggggccggagtatt

SEQ ID NO: 3918 - DNA, 20 bp, synthetic construct
  misc_feature 1..20: note = CRISPR gRNA sequence
  source 1..20: mol_type = other DNA
aggggccggagtattgggac

SEQ ID NO: 3919 - DNA, 20 bp, synthetic construct
  misc_feature 1..20: note = CRISPR gRNA sequence
  source 1..20: mol_type = other DNA
ggggccggagtattgggacc

SEQ ID NO: 3920 - DNA, 20 bp, synthetic construct
  misc_feature 1..20: note = CRISPR gRNA sequence
  source 1..20: mol_type = other DNA
ggccggagtattgggaccgg

SEQ ID NO: 3921 - DNA, 20 bp, synthetic construct
  misc_feature 1..20: note = CRISPR gRNA sequence
  source 1..20: mol_type = other DNA
agtattgggaccgggagaca

SEQ ID NO: 3922 - DNA, 20 bp, synthetic construct
  misc_feature 1..20: note = CRISPR gRNA sequence
  source 1..20: mol_type = other DNA
accgggagacacagaactac

SEQ ID NO: 3923 - DNA, 20 bp, synthetic construct
  misc_feature 1..20: note = CRISPR gRNA sequence
  source 1..20: mol_type = other DNA
agacacagaactacaagcgc

SEQ ID NO: 3924 - DNA, 20 bp, synthetic construct
  misc_feature 1..20: note = CRISPR gRNA sequence
  source 1..20: mol_type = other DNA
gacacagaactacaagcgcc

SEQ ID NO: 3925 - DNA, 20 bp, synthetic construct
  misc_feature 1..20: note = CRISPR gRNA sequence
  source 1..20: mol_type = other DNA
agaactacaagcgccaggca

SEQ ID NO: 3926 - DNA, 20 bp, synthetic construct
  misc_feature 1..20: note = CRISPR gRNA sequence
  source 1..20: mol_type = other DNA
gaactacaagcgccaggcac

SEQ ID NO: 3927 - DNA, 20 bp, synthetic construct
  misc_feature 1..20: note = CRISPR gRNA sequence
  source 1..20: mol_type = other DNA
gcgccaggcacaggctgacc

SEQ ID NO: 3928 - DNA, 20 bp, synthetic construct
  misc_feature 1..20: note = CRISPR gRNA sequence
  source 1..20: mol_type = other DNA
caggcacaggctgaccgagt

SEQ ID NO: 3929 - DNA, 20 bp, synthetic construct
  misc_feature 1..20: note = CRISPR gRNA sequence
  source 1..20: mol_type = other DNA
aggctgaccgagtgagcctg

SEQ ID NO: 3930 - DNA, 20 bp, synthetic construct
  misc_feature 1..20: note = CRISPR gRNA sequence
  source 1..20: mol_type = other DNA
gtgagcctgcggaacctgcg

SEQ ID NO: 3931 - DNA, 20 bp, synthetic construct
  misc_feature 1..20: note = CRISPR gRNA sequence
  source 1..20: mol_type = other DNA
acctgcgcggctactacaac

SEQ ID NO: 3932 - DNA, 20 bp, synthetic construct
  misc_feature 1..20: note = CRISPR gRNA sequence
  source 1..20: mol_type = other DNA
ctgcgcggctactacaacca

SEQ ID NO: 3933 - DNA, 20 bp, synthetic construct
  misc_feature 1..20: note = CRISPR gRNA sequence
  source 1..20: mol_type = other DNA
gcggctactacaaccagagc

SEQ ID NO: 3934 - DNA, 20 bp, synthetic construct
  misc_feature 1..20: note = CRISPR gRNA sequence
  source 1..20: mol_type = other DNA
cggctactacaaccagagcg

SEQ ID NO: 3935 - DNA, 20 bp, synthetic construct
  misc_feature 1..20: note = CRISPR gRNA sequence
  source 1..20: mol_type = other DNA
tactacaaccagagcgagga

SEQ ID NO: 3936 - DNA, 20 bp, synthetic construct
  misc_feature 1..20: note = CRISPR gRNA sequence
  source 1..20: mol_type = other DNA
acaaccagagcgaggacggt

SEQ ID NO: 3937 - DNA, 20 bp, synthetic construct
  misc_feature 1..20: note = CRISPR gRNA sequence
  source 1..20: mol_type = other DNA
gcgaggacggtgagtgaccc

SEQ ID NO: 3938 - DNA, 20 bp, synthetic construct
  misc_feature 1..20: note = CRISPR gRNA sequence
  source 1..20: mol_type = other DNA
gacggtgagtgaccccggcc

SEQ ID NO: 3939 - DNA, 20 bp, synthetic construct
  misc_feature 1..20: note = CRISPR gRNA sequence
  source 1..20: mol_type = other DNA
acggtgagtgaccccggccc

SEQ ID NO: 3940 - DNA, 20 bp, synthetic construct
  misc_feature 1..20: note = CRISPR gRNA sequence
  source 1..20: mol_type = other DNA
cggtgagtgaccccggcccg

SEQ ID NO: 3941 - DNA, 20 bp, synthetic construct
  misc_feature 1..20: note = CRISPR gRNA sequence
  source 1..20: mol_type = other DNA
agtgaccccggcccggggcg

SEQ ID NO: 3942 - DNA, 20 bp, synthetic construct
  misc_feature 1..20: note = CRISPR gRNA sequence
  source 1..20: mol_type = other DNA
gtgaccccggcccggggcgc

SEQ ID NO: 3943 - DNA, 20 bp, synthetic construct
  misc_feature 1..20: note = CRISPR gRNA sequence
  source 1..20: mol_type = other DNA
cgacccctccccatccccca

SEQ ID NO: 3944 - DNA, 20 bp, synthetic construct
  misc_feature 1..20: note = CRISPR gRNA sequence
  source 1..20: mol_type = other DNA
ccctccccatcccccacgga

SEQ ID NO: 3945 - DNA, 20 bp, synthetic construct
  misc_feature 1..20: note = CRISPR gRNA sequence
  source 1..20: mol_type = other DNA
cccatcccccacggacggcc

SEQ ID NO: 3946 - DNA, 20 bp, synthetic construct
  misc_feature 1..20: note = CRISPR gRNA sequence
  source 1..20: mol_type = other DNA
ccatcccccacggacggccc

SEQ ID NO: 3947 - DNA, 20 bp, synthetic construct
  misc_feature 1..20: note = CRISPR gRNA sequence
  source 1..20: mol_type = other DNA
cggacggcccgggtcgcccc

SEQ ID NO: 3948 - DNA, 20 bp, synthetic construct
  misc_feature 1..20: note = CRISPR gRNA sequence
  source 1..20: mol_type = other DNA
cgccccgagtctccccgtct

SEQ ID NO: 3949 - DNA, 20 bp, synthetic construct
  misc_feature 1..20: note = CRISPR gRNA sequence
  source 1..20: mol_type = other DNA
ccccgtctgagatccacccc

SEQ ID NO: 3950 - DNA, 20 bp, synthetic construct
  misc_feature 1..20: note = CRISPR gRNA sequence
  source 1..20: mol_type = other DNA
cccgtctgagatccacccca

SEQ ID NO: 3951 - DNA, 20 bp, synthetic construct
  misc_feature 1..20: note = CRISPR gRNA sequence
  source 1..20: mol_type = other DNA
gtctgagatccaccccaagg

SEQ ID NO: 3952 - DNA, 20 bp, synthetic construct
  misc_feature 1..20: note = CRISPR gRNA sequence
  source 1..20: mol_type = other DNA
tccaccccaaggtggatctg

SEQ ID NO: 3953 - DNA, 20 bp, synthetic construct
  misc_feature 1..20: note = CRISPR gRNA sequence
  source 1..20: mol_type = other DNA
gtggatctgcggaacccgcc

SEQ ID NO: 3954 - DNA, 20 bp, synthetic construct
  misc_feature 1..20: note = CRISPR gRNA sequence
  source 1..20: mol_type = other DNA
aacccgcccagaccctcgac

SEQ ID NO: 3955 - DNA, 20 bp, synthetic construct
  misc_feature 1..20: note = CRISPR gRNA sequence
  source 1..20: mol_type = other DNA
cccgcccagaccctcgaccg

SEQ ID NO: 3956 - DNA, 20 bp, synthetic construct
  misc_feature 1..20: note = CRISPR gRNA sequence
  source 1..20: mol_type = other DNA
cgcccagaccctcgaccgga

SEQ ID NO: 3957 - DNA, 20 bp, synthetic construct
  misc_feature 1..20: note = CRISPR gRNA sequence
  source 1..20: mol_type = other DNA
cccagaccctcgaccggaga

SEQ ID NO: 3958 - DNA, 20 bp, synthetic construct
  misc_feature 1..20: note = CRISPR gRNA sequence
  source 1..20: mol_type = other DNA
ccctcgaccggagagagccc

SEQ ID NO: 3959 - DNA, 20 bp, synthetic construct
  misc_feature 1..20: note = CRISPR gRNA sequence
  source 1..20: mol_type = other DNA
gagccccagtcgcctttacc

SEQ ID NO: 3960 - DNA, 20 bp, synthetic construct
  misc_feature 1..20: note = CRISPR gRNA sequence
  source 1..20: mol_type = other DNA
cctttacccggtttcatttt

SEQ ID NO: 3961 - DNA, 20 bp, synthetic construct
  misc_feature 1..20: note = CRISPR gRNA sequence
  source 1..20: mol_type = other DNA
acccggtttcattttcggtt

SEQ ID NO: 3962 - DNA, 20 bp, synthetic construct
  misc_feature 1..20: note = CRISPR gRNA sequence
  source 1..20: mol_type = other DNA
cccggtttcattttcggttt

SEQ ID NO: 3963 - DNA, 20 bp, synthetic construct
  misc_feature 1..20: note = CRISPR gRNA sequence
  source 1..20: mol_type = other DNA
ggtttaggccaaaatccccg

SEQ ID NO: 3964 - DNA, 20 bp, synthetic construct
  misc_feature 1..20: note = CRISPR gRNA sequence
  source 1..20: mol_type = other DNA
gtttaggccaaaatccccgc

SEQ ID NO: 3965 - DNA, 20 bp, synthetic construct
  misc_feature 1..20: note = CRISPR gRNA sequence
  source 1..20: mol_type = other DNA
aggccaaaatccccgcgggt

SEQ ID NO: 3966 - DNA, 20 bp, synthetic construct
  misc_feature 1..20: note = CRISPR gRNA sequence
  source 1..20: mol_type = other DNA
caaaatccccgcgggttggt

SEQ ID NO: 3967 - DNA, 20 bp, synthetic construct
  misc_feature 1..20: note = CRISPR gRNA sequence
  source 1..20: mol_type = other DNA
aaaatccccgcgggttggtc

SEQ ID NO: 3968 - DNA, 20 bp, synthetic construct
  misc_feature 1..20: note = CRISPR gRNA sequence
  source 1..20: mol_type = other DNA
aaatccccgcgggttggtcg

SEQ ID NO: 3969 - DNA, 20 bp, synthetic construct
  misc_feature 1..20: note = CRISPR gRNA sequence
  source 1..20: mol_type = other DNA
tccccgcgggttggtcgggg

SEQ ID NO: 3970 - DNA, 20 bp, synthetic construct
  misc_feature 1..20: note = CRISPR gRNA sequence
  source 1..20: mol_type = other DNA
ccccgcgggttggtcggggc

SEQ ID NO: 3971 - DNA, 20 bp, synthetic construct
  misc_feature 1..20: note = CRISPR gRNA sequence
  source 1..20: mol_type = other DNA
cccgcgggttggtcggggcg

SEQ ID NO: 3972 - DNA, 20 bp, synthetic construct
  misc_feature 1..20: note = CRISPR gRNA sequence
  source 1..20: mol_type = other DNA
gcgggttggtcggggcgggg

SEQ ID NO: 3973 - DNA, 20 bp, synthetic construct
  misc_feature 1..20: note = CRISPR gRNA sequence
  source 1..20: mol_type = other DNA
cgggttggtcggggcggggc

SEQ ID NO: 3974 - DNA, 20 bp, synthetic construct
  misc_feature 1..20: note = CRISPR gRNA sequence
  source 1..20: mol_type = other DNA
gggttggtcggggcggggcg

SEQ ID NO: 3975 - DNA, 20 bp, synthetic construct
  misc_feature 1..20: note = CRISPR gRNA sequence
  source 1..20: mol_type = other DNA
ggtcggggcggggcggggct

SEQ ID NO: 3976 - DNA, 20 bp, synthetic construct
  misc_feature 1..20: note = CRISPR gRNA sequence
  source 1..20: mol_type = other DNA
gtcggggcggggcggggctc

SEQ ID NO: 3977 - DNA, 20 bp, synthetic construct
  misc_feature 1..20: note = CRISPR gRNA sequence
  source 1..20: mol_type = other DNA
tcggggcggggcggggctcg

SEQ ID NO: 3978 - DNA, 20 bp, synthetic construct
  misc_feature 1..20: note = CRISPR gRNA sequence
  source 1..20: mol_type = other DNA
cggggcggggcggggctcgg

SEQ ID NO: 3979 - DNA, 20 bp, synthetic construct
  misc_feature 1..20: note = CRISPR gRNA sequence
  source 1..20: mol_type = other DNA
cggggcggggctcgggggac

SEQ ID NO: 3980 - DNA, 20 bp, synthetic construct
  misc_feature 1..20: note = CRISPR gRNA sequence
  source 1..20: mol_type = other DNA
ggggcggggctcgggggact

SEQ ID NO: 3981 - DNA, 20 bp, synthetic construct
  misc_feature 1..20: note = CRISPR gRNA sequence
  source 1..20: mol_type = other DNA
tcgggggactgggctgaccg

SEQ ID NO: 3982 - DNA, 20 bp, synthetic construct
  misc_feature 1..20: note = CRISPR gRNA sequence
  source 1..20: mol_type = other DNA
cgggggactgggctgaccgc

SEQ ID NO: 3983 - DNA, 20 bp, synthetic construct
  misc_feature 1..20: note = CRISPR gRNA sequence
  source 1..20: mol_type = other DNA
gggggactgggctgaccgcg

SEQ ID NO: 3984 - DNA, 20 bp, synthetic construct
  misc_feature 1..20: note = CRISPR gRNA sequence
  source 1..20: mol_type = other DNA
ggggactgggctgaccgcgg

SEQ ID NO: 3985 - DNA, 20 bp, synthetic construct
  misc_feature 1..20: note = CRISPR gRNA sequence
  source 1..20: mol_type = other DNA
gactgggctgaccgcggggg

SEQ ID NO: 3986 - DNA, 20 bp, synthetic construct
  misc_feature 1..20: note = CRISPR gRNA sequence
  source 1..20: mol_type = other DNA
actgggctgaccgcgggggc

SEQ ID NO: 3987 - DNA, 20 bp, synthetic construct
  misc_feature 1..20: note = CRISPR gRNA sequence
  source 1..20: mol_type = other DNA
ctgggctgaccgcgggggcg

SEQ ID NO: 3988 - DNA, 20 bp, synthetic construct
  misc_feature 1..20: note = CRISPR gRNA sequence
  source 1..20: mol_type = other DNA
gctgaccgcgggggcggggc

SEQ ID NO: 3989 - DNA, 20 bp, synthetic construct
  misc_feature 1..20: note = CRISPR gRNA sequence
  source 1..20: mol_type = other DNA
ctgaccgcgggggcggggcc

SEQ ID NO: 3990 - DNA, 20 bp, synthetic construct
  misc_feature 1..20: note = CRISPR gRNA sequence
  source 1..20: mol_type = other DNA
tgaccgcgggggcggggcca

SEQ ID NO: 3991 - DNA, 20 bp, synthetic construct
  misc_feature 1..20: note = CRISPR gRNA sequence
  source 1..20: mol_type = other DNA
ggccagggtctcacaccctc

SEQ ID NO: 3992 - DNA, 20 bp, synthetic construct
  misc_feature 1..20: note = CRISPR gRNA sequence
  source 1..20: mol_type = other DNA
ccagggtctcacaccctcca

SEQ ID NO: 3993 - DNA, 20 bp, synthetic construct
  misc_feature 1..20: note = CRISPR gRNA sequence
  source 1..20: mol_type = other DNA
cagggtctcacaccctccag

SEQ ID NO: 3994 - DNA, 20 bp, synthetic construct
  misc_feature 1..20: note = CRISPR gRNA sequence
  source 1..20: mol_type = other DNA
cacaccctccagaggatgta

SEQ ID NO: 3995 - DNA, 20 bp, synthetic construct
  misc_feature 1..20: note = CRISPR gRNA sequence
  source 1..20: mol_type = other DNA
gaggatgtatggctgcgacc

SEQ ID NO: 3996 - DNA, 20 bp, synthetic construct
  misc_feature 1..20: note = CRISPR gRNA sequence
  source 1..20: mol_type = other DNA
aggatgtatggctgcgacct

SEQ ID NO: 3997 - DNA, 20 bp, synthetic construct
  misc_feature 1..20: note = CRISPR gRNA sequence
  source 1..20: mol_type = other DNA
ggatgtatggctgcgacctg

SEQ ID NO: 3998 - DNA, 20 bp, synthetic construct
  misc_feature 1..20: note = CRISPR gRNA sequence
  source 1..20: mol_type = other DNA
ggctgcgacctggggcccga

SEQ ID NO: 3999 - DNA, 20 bp, synthetic construct
  misc_feature 1..20: note = CRISPR gRNA sequence
  source 1..20: mol_type = other DNA
gctgcgacctggggcccgac

SEQ ID NO: 4000 - DNA, 20 bp, synthetic construct
  misc_feature 1..20: note = CRISPR gRNA sequence
  source 1..20: mol_type = other DNA
cccgacgggcgcctcctccg

SEQ ID NO: 4001 - DNA, 20 bp, synthetic construct
  misc_feature 1..20: note = CRISPR gRNA sequence
  source 1..20: mol_type = other DNA
ccgacgggcgcctcctccgc

SEQ ID NO: 4002 - DNA, 20 bp, synthetic construct
  misc_feature 1..20: note = CRISPR gRNA sequence
  source 1..20: mol_type = other DNA
gcctcctccgcgggtatgac

SEQ ID NO: 4003 - DNA, 20 bp, synthetic construct
  misc_feature 1..20: note = CRISPR gRNA sequence
  source 1..20: mol_type = other DNA
tatgaccagtccgcctacga

SEQ ID NO: 4004 - DNA, 20 bp, synthetic construct
  misc_feature 1..20: note = CRISPR gRNA sequence
  source 1..20: mol_type = other DNA
accagtccgcctacgacggc

SEQ ID NO: 4005 - DNA, 20 bp, synthetic construct
  misc_feature 1..20: note = CRISPR gRNA sequence
  source 1..20: mol_type = other DNA
ccagtccgcctacgacggca

SEQ ID NO: 4006 - DNA, 20 bp, synthetic construct
  misc_feature 1..20: note = CRISPR gRNA sequence
  source 1..20: mol_type = other DNA
aggattacatcgccctgaac

SEQ ID NO: 4007 - DNA, 20 bp, synthetic construct
  misc_feature 1..20: note = CRISPR gRNA sequence
  source 1..20: mol_type = other DNA
ggattacatcgccctgaacg

SEQ ID NO: 4008 - DNA, 20 bp, synthetic construct
  misc_feature 1..20: note = CRISPR gRNA sequence
  source 1..20: mol_type = other DNA
tgaacgaggacctgcgctcc

SEQ ID NO: 4009 - DNA, 20 bp, synthetic construct
  misc_feature 1..20: note = CRISPR gRNA sequence
  source 1..20: mol_type = other DNA
cctgcgctcctggaccgccg

SEQ ID NO: 4010 - DNA, 20 bp, synthetic construct
  misc_feature 1..20: note = CRISPR gRNA sequence
  source 1..20: mol_type = other DNA
ctggaccgccgcggacaccg

SEQ ID NO: 4011 - DNA, 20 bp, synthetic construct
  misc_feature 1..20: note = CRISPR gRNA sequence
  source 1..20: mol_type = other DNA
ccgccgcggacaccgcggct

SEQ ID NO: 4012 - DNA, 20 bp, synthetic construct
  misc_feature 1..20: note = CRISPR gRNA sequence
  source 1..20: mol_type = other DNA
acaccgcggctcagatcacc

SEQ ID NO: 4013 - DNA, 20 bp, synthetic construct
  misc_feature 1..20: note = CRISPR gRNA sequence
  source 1..20: mol_type = other DNA
cggctcagatcacccagcgc

SEQ ID NO: 4014 - DNA, 20 bp, synthetic construct
  misc_feature 1..20: note = CRISPR gRNA sequence
  source 1..20: mol_type = other DNA
tcagatcacccagcgcaagt

SEQ ID NO: 4015 - DNA, 20 bp, synthetic construct
  misc_feature 1..20: note = CRISPR gRNA sequence
  source 1..20: mol_type = other DNA
agatcacccagcgcaagttg

SEQ ID NO: 4016 - DNA, 20 bp, synthetic construct
  misc_feature 1..20: note = CRISPR gRNA sequence
  source 1..20: mol_type = other DNA
gatcacccagcgcaagttgg

SEQ ID NO: 4017 - DNA, 20 bp, synthetic construct
  misc_feature 1..20: note = CRISPR gRNA sequence
  source 1..20: mol_type = other DNA
cacccagcgcaagttggagg

SEQ ID NO: 4018 - DNA, 20 bp, synthetic construct
  misc_feature 1..20: note = CRISPR gRNA sequence
  source 1..20: mol_type = other DNA
caagttggaggcggcccgtg

SEQ ID NO: 4019 - DNA, 20 bp, synthetic construct
  misc_feature 1..20: note = CRISPR gRNA sequence
  source 1..20: mol_type = other DNA
gttggaggcggcccgtgcgg

SEQ ID NO: 4020 - DNA, 20 bp, synthetic construct
  misc_feature 1..20: note = CRISPR gRNA sequence
  source 1..20: mol_type = other DNA
tggaggcggcccgtgcggcg

SEQ ID NO: 4021 - DNA, 20 bp, synthetic construct
  misc_feature 1..20: note = CRISPR gRNA sequence
  source 1..20: mol_type = other DNA
aggcggcccgtgcggcggag

SEQ ID NO: 4022 - DNA, 20 bp, synthetic construct
  misc_feature 1..20: note = CRISPR gRNA sequence
  source 1..20: mol_type = other DNA
gcccgtgcggcggagcagct

SEQ ID NO: 4023 - DNA, 20 bp, synthetic construct
  misc_feature 1..20: note = CRISPR gRNA sequence
  source 1..20: mol_type = other DNA
ccgtgcggcggagcagctga

SEQ ID NO: 4024 - DNA, 20 bp, synthetic construct
  misc_feature 1..20: note = CRISPR gRNA sequence
  source 1..20: mol_type = other DNA
ggagcagctgagagcctacc

SEQ ID NO: 4025 - DNA, 20 bp, synthetic construct
  misc_feature 1..20: note = CRISPR gRNA sequence
  source 1..20: mol_type = other DNA
agcagctgagagcctacctg

SEQ ID NO: 4026 - DNA, 20 bp, synthetic construct
  misc_feature 1..20: note = CRISPR gRNA sequence
  source 1..20: mol_type = other DNA
gcagctgagagcctacctgg

SEQ ID NO: 4027 - DNA, 20 bp, synthetic construct
  misc_feature 1..20: note = CRISPR gRNA sequence
  source 1..20: mol_type = other DNA
cagctgagagcctacctgga

SEQ ID NO: 4028 - DNA, 20 bp, synthetic construct
  misc_feature 1..20: note = CRISPR gRNA sequence
  source 1..20: mol_type = other DNA
ctacctggagggcacgtgcg

SEQ ID NO: 4029 - DNA, 20 bp, synthetic construct
  misc_feature 1..20: note = CRISPR gRNA sequence
  source 1..20: mol_type = other DNA
acctggagggcacgtgcgtg

SEQ ID NO: 4030 - DNA, 20 bp, synthetic construct
  misc_feature 1..20: note = CRISPR gRNA sequence
  source 1..20: mol_type = other DNA
tggagggcacgtgcgtggag

SEQ ID NO: 4031 - DNA, 20 bp, synthetic construct
  misc_feature 1..20: note = CRISPR gRNA sequence
  source 1..20: mol_type = other DNA
acgtgcgtggagtggctccg

SEQ ID NO: 4032 - DNA, 20 bp, synthetic construct
  misc_feature 1..20: note = CRISPR gRNA sequence
  source 1..20: mol_type = other DNA
ggagtggctccgcagatacc

SEQ ID NO: 4033 - DNA, 20 bp, synthetic construct
  misc_feature 1..20: note = CRISPR gRNA sequence
  source 1..20: mol_type = other DNA
agtggctccgcagatacctg

SEQ ID NO: 4034 - DNA, 20 bp, synthetic construct
  misc_feature 1..20: note = CRISPR gRNA sequence
  source 1..20: mol_type = other DNA
ctccgcagatacctggagaa

SEQ ID NO: 4035 - DNA, 20 bp, synthetic construct
  misc_feature 1..20: note = CRISPR gRNA sequence
  source 1..20: mol_type = other DNA
tccgcagatacctggagaac

SEQ ID NO: 4036 - DNA, 20 bp, synthetic construct
  misc_feature 1..20: note = CRISPR gRNA sequence
  source 1..20: mol_type = other DNA
gcagatacctggagaacggg

SEQ ID NO: 4037 - DNA, 20 bp, synthetic construct
  misc_feature 1..20: note = CRISPR gRNA sequence
  source 1..20: mol_type = other DNA
cagatacctggagaacggga

SEQ ID NO: 4038 - DNA, 20 bp, synthetic construct
  misc_feature 1..20: note = CRISPR gRNA sequence
  source 1..20: mol_type = other DNA
gatacctggagaacgggaag

SEQ ID NO: 4039 - DNA, 20 bp, synthetic construct
  misc_feature 1..20: note = CRISPR gRNA sequence
  source 1..20: mol_type = other DNA
agaacgggaaggagacgctg

SEQ ID NO: 4040 - DNA, 20 bp, synthetic construct
  misc_feature 1..20: note = CRISPR gRNA sequence
  source 1..20: mol_type = other DNA
gaaggagacgctgcagcgcg

SEQ ID NO: 4041 - DNA, 20 bp, synthetic construct
  misc_feature 1..20: note = CRISPR gRNA sequence
  source 1..20: mol_type = other DNA
aaggagacgctgcagcgcgc

SEQ ID NO: 4042 - DNA, 20 bp, synthetic construct
  misc_feature 1..20: note = CRISPR gRNA sequence
  source 1..20: mol_type = other DNA
acgctgcagcgcgcaggtac

SEQ ID NO: 4043 - DNA, 20 bp, synthetic construct
  misc_feature 1..20: note = CRISPR gRNA sequence
  source 1..20: mol_type = other DNA
cgctgcagcgcgcaggtacc

SEQ ID NO: 4044 - DNA, 20 bp, synthetic construct
  misc_feature 1..20: note = CRISPR gRNA sequence
  source 1..20: mol_type = other DNA
gctgcagcgcgcaggtacca

SEQ ID NO: 4045 - DNA, 20 bp, synthetic construct
  misc_feature 1..20: note = CRISPR gRNA sequence
  source 1..20: mol_type = other DNA
ctgcagcgcgcaggtaccag

SEQ ID NO: 4046 - DNA, 20 bp, synthetic construct
  misc_feature 1..20: note = CRISPR gRNA sequence
  source 1..20: mol_type = other DNA
cagcgcgcaggtaccagggg

SEQ ID NO: 4047 - DNA, 20 bp, synthetic construct
  misc_feature 1..20: note = CRISPR gRNA sequence
  source 1..20: mol_type = other DNA
cgcgcaggtaccaggggcag

SEQ ID NO: 4048 - DNA, 20 bp, synthetic construct
  misc_feature 1..20: note = CRISPR gRNA sequence
  source 1..20: mol_type = other DNA
gcgcaggtaccaggggcagt

SEQ ID NO: 4049 - DNA, 20 bp, synthetic construct
  misc_feature 1..20: note = CRISPR gRNA sequence
  source 1..20: mol_type = other DNA
cgcaggtaccaggggcagtg

SEQ ID NO: 4050 - DNA, 20 bp, synthetic construct
  misc_feature 1..20: note = CRISPR gRNA sequence
  source 1..20: mol_type = other DNA
caggtaccaggggcagtggg

SEQ ID NO: 4051 - DNA, 20 bp, synthetic construct
  misc_feature 1..20: note = CRISPR gRNA sequence
  source 1..20: mol_type = other DNA
ggagccttccccatctccta

SEQ ID NO: 4052 - DNA, 20 bp, synthetic construct
  misc_feature 1..20: note = CRISPR gRNA sequence
  source 1..20: mol_type = other DNA
cccatctcctatagatctcc

SEQ ID NO: 4053 - DNA, 20 bp, synthetic construct
  misc_feature 1..20: note = CRISPR gRNA sequence
  source 1..20: mol_type = other DNA
ccatctcctatagatctccc

SEQ ID NO: 4054 - DNA, 20 bp, synthetic construct
  misc_feature 1..20: note = CRISPR gRNA sequence
  source 1..20: mol_type = other DNA
ctcctatagatctcccggga

SEQ ID NO: 4055 - DNA, 20 bp, synthetic construct
  misc_feature 1..20: note = CRISPR gRNA sequence
  source 1..20: mol_type = other DNA
ctcccgggatggcctcccac

SEQ ID NO: 4056 - DNA, 20 bp, synthetic construct
  misc_feature 1..20: note = CRISPR gRNA sequence
  source 1..20: mol_type = other DNA
tcccgggatggcctcccacg

SEQ ID NO: 4057 - DNA, 20 bp, synthetic construct
  misc_feature 1..20: note = CRISPR gRNA sequence
  source 1..20: mol_type = other DNA
ccgggatggcctcccacgag

SEQ ID NO: 4058 - DNA, 20 bp, synthetic construct
  misc_feature 1..20: note = CRISPR gRNA sequence
  source 1..20: mol_type = other DNA
cgggatggcctcccacgagg

SEQ ID NO: 4059 - DNA, 20 bp, synthetic construct
  misc_feature 1..20: note = CRISPR gRNA sequence
  source 1..20: mol_type = other DNA
gggatggcctcccacgagga

SEQ ID NO: 4060 - DNA, 20 bp, synthetic construct
  misc_feature 1..20: note = CRISPR gRNA sequence
  source 1..20: mol_type = other DNA
ggatggcctcccacgaggag

SEQ ID NO: 4061 - DNA, 20 bp, synthetic construct
  misc_feature 1..20: note = CRISPR gRNA sequence
  source 1..20: mol_type = other DNA
atggcctcccacgaggaggg

SEQ ID NO: 4062 - DNA, 20 bp, synthetic construct
  misc_feature 1..20: note = CRISPR gRNA sequence
  source 1..20: mol_type = other DNA
tggcctcccacgaggagggg

SEQ ID NO: 4063 - DNA, 20 bp, synthetic construct
  misc_feature 1..20: note = CRISPR gRNA sequence
  source 1..20: mol_type = other DNA
ccacgaggaggggaggaaaa

SEQ ID NO: 4064 - DNA, 20 bp, synthetic construct
  misc_feature 1..20: note = CRISPR gRNA sequence
  source 1..20: mol_type = other DNA
cacgaggaggggaggaaaat

SEQ ID NO: 4065 - DNA, 20 bp, synthetic construct
  misc_feature 1..20: note = CRISPR gRNA sequence
  source 1..20: mol_type = other DNA
ggaggggaggaaaatgggat

SEQ ID NO: 4066 - DNA, 20 bp, synthetic construct
  misc_feature 1..20: note = CRISPR gRNA sequence
  source 1..20: mol_type = other DNA
gaggaaaatgggatcagcac

SEQ ID NO: 4067 - DNA, 20 bp, synthetic construct
  misc_feature 1..20: note = CRISPR gRNA sequence
  source 1..20: mol_type = other DNA
gaatatcgccctcccttgaa

SEQ ID NO: 4068 - DNA, 20 bp, synthetic construct
  misc_feature 1..20: note = CRISPR gRNA sequence
  source 1..20: mol_type = other DNA
atatcgccctcccttgaatg

SEQ ID NO: 4069 - DNA, 20 bp, synthetic construct
  misc_feature 1..20: note = CRISPR gRNA sequence
  source 1..20: mol_type = other DNA
gccctcccttgaatggagaa

SEQ ID NO: 4070 - DNA, 20 bp, synthetic construct
  misc_feature 1..20: note = CRISPR gRNA sequence
  source 1..20: mol_type = other DNA
ccttgaatggagaatggcat

SEQ ID NO: 4071 - DNA, 20 bp, synthetic construct
  misc_feature 1..20: note = CRISPR gRNA sequence
  source 1..20: mol_type = other DNA
agaatggcatgagttttcct

SEQ ID NO: 4072 - DNA, 20 bp, synthetic construct
  misc_feature 1..20: note = CRISPR gRNA sequence
  source 1..20: mol_type = other DNA
agttttcctgagtttcctct

SEQ ID NO: 4073 - DNA, 20 bp, synthetic construct
  misc_feature 1..20: note = CRISPR gRNA sequence
  source 1..20: mol_type = other DNA
gttttcctgagtttcctctg

SEQ ID NO: 4074 - DNA, 20 bp, synthetic construct
  misc_feature 1..20: note = CRISPR gRNA sequence
  source 1..20: mol_type = other DNA
ttttcctgagtttcctctga

SEQ ID NO: 4075 - DNA, 20 bp, synthetic construct
  misc_feature 1..20: note = CRISPR gRNA sequence
  source 1..20: mol_type = other DNA
tgagggccccctctgctctc

SEQ ID NO: 4076 - DNA, 20 bp, synthetic construct
  misc_feature 1..20: note = CRISPR gRNA sequence
  source 1..20: mol_type = other DNA
gagggccccctctgctctct

SEQ ID NO: 4077 - DNA, 20 bp, synthetic construct
  misc_feature 1..20: note = CRISPR gRNA sequence
  source 1..20: mol_type = other DNA
ctctgctctctaggacaatt

SEQ ID NO: 4078 - DNA, 20 bp, synthetic construct
  misc_feature 1..20: note = CRISPR gRNA sequence
  source 1..20: mol_type = other DNA
tctgctctctaggacaatta

SEQ ID NO: 4079 - DNA, 20 bp, synthetic construct
  misc_feature 1..20: note = CRISPR gRNA sequence
  source 1..20: mol_type = other DNA
ctgctctctaggacaattaa

SEQ ID NO: 4080 - DNA, 20 bp, synthetic construct
  misc_feature 1..20: note = CRISPR gRNA sequence
  source 1..20: mol_type = other DNA
tctaggacaattaagggatg

SEQ ID NO: 4081 - DNA, 20 bp, synthetic construct
  misc_feature 1..20: note = CRISPR gRNA sequence
  source 1..20: mol_type = other DNA
aattaagggatgaagtctct

SEQ ID NO: 4082 - DNA, 20 bp, synthetic construct
  misc_feature 1..20: note = CRISPR gRNA sequence
  source 1..20: mol_type = other DNA
attaagggatgaagtctctg

SEQ ID NO: 4083 - DNA, 20 bp, synthetic construct
  misc_feature 1..20: note = CRISPR gRNA sequence
  source 1..20: mol_type = other DNA
ggatgaagtctctgaggaaa

SEQ ID NO: 4084 - DNA, 20 bp, synthetic construct
  misc_feature 1..20: note = CRISPR gRNA sequence
  source 1..20: mol_type = other DNA
atgaagtctctgaggaaatg

SEQ ID NO: 4085 - DNA, 20 bp, synthetic construct
  misc_feature 1..20: note = CRISPR gRNA sequence
  source 1..20: mol_type = other DNA
tgaagtctctgaggaaatgg

SEQ ID NO: 4086 - DNA, 20 bp, synthetic construct
  misc_feature 1..20: note = CRISPR gRNA sequence
  source 1..20: mol_type = other DNA
gaagtctctgaggaaatgga

SEQ ID NO: 4087 - DNA, 20 bp, synthetic construct
  misc_feature 1..20: note = CRISPR gRNA sequence
  source 1..20: mol_type = other DNA
aagtctctgaggaaatggag

SEQ ID NO: 4088 - DNA, 20 bp, synthetic construct
  misc_feature 1..20: note = CRISPR gRNA sequence
  source 1..20: mol_type = other DNA
tctctgaggaaatggagggg

SEQ ID NO: 4089 - DNA, 20 bp, synthetic construct
  misc_feature 1..20: note = CRISPR gRNA sequence
  source 1..20: mol_type = other DNA
tgaggaaatggaggggaaga

SEQ ID NO: 4090 - DNA, 20 bp, synthetic construct
  misc_feature 1..20: note = CRISPR gRNA sequence
  source 1..20: mol_type = other DNA
atggaggggaagacagtccc

SEQ ID NO: 4091 - DNA, 20 bp, synthetic construct
  misc_feature 1..20: note = CRISPR gRNA sequence
  source 1..20: mol_type = other DNA
acagtccctggaatactgat

SEQ ID NO: 4092 - DNA, 20 bp, synthetic construct
  misc_feature 1..20: note = CRISPR gRNA sequence
  source 1..20: mol_type = other DNA
cagtccctggaatactgatc

SEQ ID NO: 4093 - DNA, 20 bp, synthetic construct
  misc_feature 1..20: note = CRISPR gRNA sequence
  source 1..20: mol_type = other DNA
agtccctggaatactgatca

SEQ ID NO: 4094 - DNA, 20 bp, synthetic construct
  misc_feature 1..20: note = CRISPR gRNA sequence
  source 1..20: mol_type = other DNA
gtccctggaatactgatcag

SEQ ID NO: 4095 - DNA, 20 bp, synthetic construct
  misc_feature 1..20: note = CRISPR gRNA sequence
  source 1..20: mol_type = other DNA
tttgaccactttgaccactg

SEQ ID NO: 4096 - DNA, 20 bp, synthetic construct
  misc_feature 1..20: note = CRISPR gRNA sequence
  source 1..20: mol_type = other DNA
gaccactttgaccactgcag

SEQ ID NO: 4097 - DNA, 20 bp, synthetic construct
  misc_feature 1..20: note = CRISPR gRNA sequence
  source 1..20: mol_type = other DNA
tttgaccactgcagcagctg

SEQ ID NO: 4098 - DNA, 20 bp, synthetic construct
  misc_feature 1..20: note = CRISPR gRNA sequence
  source 1..20: mol_type = other DNA
accactgcagcagctgtggt

SEQ ID NO: 4099 - DNA, 20 bp, synthetic construct
  misc_feature 1..20: note = CRISPR gRNA sequence
  source 1..20: mol_type = other DNA
ccactgcagcagctgtggtc

SEQ ID NO: 4100 - DNA, 20 bp, synthetic construct
  misc_feature 1..20: note = CRISPR gRNA sequence
  source 1..20: mol_type = other DNA
caggctgctgacctttctct

SEQ ID NO: 4101 - DNA, 20 bp, synthetic construct
  misc_feature 1..20: note = CRISPR gRNA sequence
  source 1..20: mol_type = other DNA
aggctgctgacctttctctc

SEQ ID NO: 4102 - DNA, 20 bp, synthetic construct
  misc_feature 1..20: note = CRISPR gRNA sequence
  source 1..20: mol_type = other DNA
cctcacactcaatgtgtctg

SEQ ID NO: 4103 - DNA, 20 bp, synthetic construct
  misc_feature 1..20: note = CRISPR gRNA sequence
  source 1..20: mol_type = other DNA
ctcacactcaatgtgtctga

SEQ ID NO: 4104 - DNA, 20 bp, synthetic construct
  misc_feature 1..20: note = CRISPR gRNA sequence
  source 1..20: mol_type = other DNA
tgtgtctgaaggtttgattc

SEQ ID NO: 4105 - DNA, 20 bp, synthetic construct
  misc_feature 1..20: note = CRISPR gRNA sequence
  source 1..20: mol_type = other DNA
ggtttgattccagcttttct

SEQ ID NO: 4106 - DNA, 20 bp, synthetic construct
  misc_feature 1..20: note = CRISPR gRNA sequence
  source 1..20: mol_type = other DNA
tccagcttttctgagtcctg

SEQ ID NO: 4107 - DNA, 20 bp, synthetic construct
  misc_feature 1..20: note = CRISPR gRNA sequence
  source 1..20: mol_type = other DNA
tgagtcctgcagcctccact

SEQ ID NO: 4108 - DNA, 20 bp, synthetic construct
  misc_feature 1..20: note = CRISPR gRNA sequence
  source 1..20: mol_type = other DNA
gagtcctgcagcctccactc

SEQ ID NO: 4109 - DNA, 20 bp, synthetic construct
  misc_feature 1..20: note = CRISPR gRNA sequence
  source 1..20: mol_type = other DNA
cctgcagcctccactcaggt

SEQ ID NO: 4110 - DNA, 20 bp, synthetic construct
  misc_feature 1..20: note = CRISPR gRNA sequence
  source 1..20: mol_type = other DNA
ctgcagcctccactcaggtc

SEQ ID NO: 4111 - DNA, 20 bp, synthetic construct
  misc_feature 1..20: note = CRISPR gRNA sequence
  source 1..20: mol_type = other DNA
gcctccactcaggtcaggac

SEQ ID NO: 4112 - DNA, 20 bp, synthetic construct
  misc_feature 1..20: note = CRISPR gRNA sequence
  source 1..20: mol_type = other DNA
tccactcaggtcaggaccag

SEQ ID NO: 4113 - DNA, 20 bp, synthetic construct
  misc_feature 1..20: note = CRISPR gRNA sequence
  source 1..20: mol_type = other DNA
agaagtcgctgttcctccct

SEQ ID NO: 4114 - DNA, 20 bp, synthetic construct
  misc_feature 1..20: note = CRISPR gRNA sequence
  source 1..20: mol_type = other DNA
aagtcgctgttcctccctca

SEQ ID NO: 4115 - DNA, 20 bp, synthetic construct
  misc_feature 1..20: note = CRISPR gRNA sequence
  source 1..20: mol_type = other DNA
gctgttcctccctcagagac

SEQ ID NO: 4116 - DNA, 20 bp, synthetic construct
  misc_feature 1..20: note = CRISPR gRNA sequence
  source 1..20: mol_type = other DNA
gactagaactttccaatgaa

SEQ ID NO: 4117 - DNA, 20 bp, synthetic construct
  misc_feature 1..20: note = CRISPR gRNA sequence
  source 1..20: mol_type = other DNA
actagaactttccaatgaat

SEQ ID NO: 4118 - DNA, 20 bp, synthetic construct
  misc_feature 1..20: note = CRISPR gRNA sequence
  source 1..20: mol_type = other DNA
tagaactttccaatgaatag

SEQ ID NO: 4119 - DNA, 20 bp, synthetic construct
  misc_feature 1..20: note = CRISPR gRNA sequence
  source 1..20: mol_type = other DNA
caatgaataggagattatcc

SEQ ID NO: 4120 - DNA, 20 bp, synthetic construct
  misc_feature 1..20: note = CRISPR gRNA sequence
  source 1..20: mol_type = other DNA
aatgaataggagattatccc

SEQ ID NO: 4121 - DNA, 20 bp, synthetic construct
  misc_feature 1..20: note = CRISPR gRNA sequence
  source 1..20: mol_type = other DNA
ttatcccaggtgcctgtgtc

SEQ ID NO: 4122 - DNA, 20 bp, synthetic construct
  misc_feature 1..20: note = CRISPR gRNA sequence
  source 1..20: mol_type = other DNA
tatcccaggtgcctgtgtcc

SEQ ID NO: 4123 - DNA, 20 bp, synthetic construct
  misc_feature 1..20: note = CRISPR gRNA sequence
  source 1..20: mol_type = other DNA
ccaggtgcctgtgtccaggc

SEQ ID NO: 4124 - DNA, 20 bp, synthetic construct
  misc_feature 1..20: note = CRISPR gRNA sequence
  source 1..20: mol_type = other DNA
cctgtgtccaggctggcgtc

SEQ ID NO: 4125 - DNA, 20 bp, synthetic construct
  misc_feature 1..20: note = CRISPR gRNA sequence
  source 1..20: mol_type = other DNA
ctgtgtccaggctggcgtct

SEQ ID NO: 4126 - DNA, 20 bp, synthetic construct
  misc_feature 1..20: note = CRISPR gRNA sequence
  source 1..20: mol_type = other DNA
ctgtgccgccttccccaccc

SEQ ID NO: 4127 - DNA, 20 bp, synthetic construct
  misc_feature 1..20: note = CRISPR gRNA sequence
  source 1..20: mol_type = other DNA
tgtgccgccttccccacccc

SEQ ID NO: 4128 - DNA, 20 bp, synthetic construct
  misc_feature 1..20: note = CRISPR gRNA sequence
  source 1..20: mol_type = other DNA
ccaggtgtcctgtccattct

SEQ ID NO: 4129 - DNA, 20 bp, synthetic construct
  misc_feature 1..20: note = CRISPR gRNA sequence
  source 1..20: mol_type = other DNA
caggtgtcctgtccattctc

SEQ ID NO: 4130 - DNA, 20 bp, synthetic construct
  misc_feature 1..20: note = CRISPR gRNA sequence
  source 1..20: mol_type = other DNA
tgtcctgtccattctcagga

SEQ ID NO: 4131 - DNA, 20 bp, synthetic construct
  misc_feature 1..20: note = CRISPR gRNA sequence
  source 1..20: mol_type = other DNA
ccattctcaggatggtcaca

SEQ ID NO: 4132 - DNA, 20 bp, synthetic construct
  misc_feature 1..20: note = CRISPR gRNA sequence
  source 1..20: mol_type = other DNA
cattctcaggatggtcacat

SEQ ID NO: 4133 - DNA, 20 bp, synthetic construct
  misc_feature 1..20: note = CRISPR gRNA sequence
  source 1..20: mol_type = other DNA
gatggtcacatgggcgctgc

SEQ ID NO: 4134 - DNA, 20 bp, synthetic construct
  misc_feature 1..20: note = CRISPR gRNA sequence
  source 1..20: mol_type = other DNA
tggtcacatgggcgctgctg

SEQ ID NO: 4135 - DNA, 20 bp, synthetic construct
  misc_feature 1..20: note = CRISPR gRNA sequence
  source 1..20: mol_type = other DNA
gggcgctgctggagtgtccc

SEQ ID NO: 4136 - DNA, 20 bp, synthetic construct
  misc_feature 1..20: note = CRISPR gRNA sequence
  source 1..20: mol_type = other DNA
gcgctgctggagtgtcccaa

SEQ ID NO: 4137 - DNA, 20 bp, synthetic construct
  misc_feature 1..20: note = CRISPR gRNA sequence
  source 1..20: mol_type = other DNA
gctgctggagtgtcccaaga

SEQ ID NO: 4138 - DNA, 20 bp, synthetic construct
  misc_feature 1..20: note = CRISPR gRNA sequence
  source 1..20: mol_type = other DNA
agtgtcccaagagagatgca

SEQ ID NO: 4139 - DNA, 20 bp, synthetic construct
  misc_feature 1..20: note = CRISPR gRNA sequence
  source 1..20: mol_type = other DNA
aattttctgactcttcccgt

SEQ ID NO: 4140 - DNA, 20 bp, synthetic construct
  misc_feature 1..20: note = CRISPR gRNA sequence
  source 1..20: mol_type = other DNA
tcttcccgtcagaaccccca

SEQ ID NO: 4141 - DNA, 20 bp, synthetic construct
  misc_feature 1..20: note = CRISPR gRNA sequence
  source 1..20: mol_type = other DNA
accaccccctctctgaccat

SEQ ID NO: 4142 - DNA, 20 bp, synthetic construct
  misc_feature 1..20: note = CRISPR gRNA sequence
  source 1..20: mol_type = other DNA
ccaccccctctctgaccatg

SEQ ID NO: 4143 - DNA, 20 bp, synthetic construct
  misc_feature 1..20: note = CRISPR gRNA sequence
  source 1..20: mol_type = other DNA
tctgaccatgaggccaccct

SEQ ID NO: 4144 - DNA, 20 bp, synthetic construct
  misc_feature 1..20: note = CRISPR gRNA sequence
  source 1..20: mol_type = other DNA
ctgaccatgaggccaccctg

SEQ ID NO: 4145 - DNA, 20 bp, synthetic construct
  misc_feature 1..20: note = CRISPR gRNA sequence
  source 1..20: mol_type = other DNA
atgaggccaccctgaggtgc

SEQ ID NO: 4146 - DNA, 20 bp, synthetic construct
  misc_feature 1..20: note = CRISPR gRNA sequence
  source 1..20: mol_type = other DNA
tgaggccaccctgaggtgct

SEQ ID NO: 4147 - DNA, 20 bp, synthetic construct
  misc_feature 1..20: note = CRISPR gRNA sequence
  source 1..20: mol_type = other DNA
caccctgaggtgctgggccc

SEQ ID NO: 4148 - DNA, 20 bp, synthetic construct
  misc_feature 1..20: note = CRISPR gRNA sequence
  source 1..20: mol_type = other DNA
accctgaggtgctgggccct

SEQ ID NO: 4149 - DNA, 20 bp, synthetic construct
  misc_feature 1..20: note = CRISPR gRNA sequence
  source 1..20: mol_type = other DNA
ggccctgggcttctaccctg

SEQ ID NO: 4150 - DNA, 20 bp, synthetic construct
  misc_feature 1..20: note = CRISPR gRNA sequence
  source 1..20: mol_type = other DNA
ccctgggcttctaccctgcg

SEQ ID NO: 4151 - DNA, 20 bp, synthetic construct
  misc_feature 1..20: note = CRISPR gRNA sequence
  source 1..20: mol_type = other DNA
ctgcggagatcacactgacc

SEQ ID NO: 4152 - DNA, 20 bp, synthetic construct
  misc_feature 1..20: note = CRISPR gRNA sequence
  source 1..20: mol_type = other DNA
cggagatcacactgacctgg

SEQ ID NO: 4153 - DNA, 20 bp, synthetic construct
  misc_feature 1..20: note = CRISPR gRNA sequence
  source 1..20: mol_type = other DNA
agatcacactgacctggcag

SEQ ID NO: 4154 - DNA, 20 bp, synthetic construct
  misc_feature 1..20: note = CRISPR gRNA sequence
  source 1..20: mol_type = other DNA
gatcacactgacctggcagc

SEQ ID NO: 4155 - DNA, 20 bp, synthetic construct
  misc_feature 1..20: note = CRISPR gRNA sequence
  source 1..20: mol_type = other DNA
acactgacctggcagcggga

SEQ ID NO: 4156 - DNA, 20 bp, synthetic construct
  misc_feature 1..20: note = CRISPR gRNA sequence
  source 1..20: mol_type = other DNA
cactgacctggcagcgggat

SEQ ID NO: 4157 - DNA, 20 bp, synthetic construct
  misc_feature 1..20: note = CRISPR gRNA sequence
  source 1..20: mol_type = other DNA
actgacctggcagcgggatg

SEQ ID NO: 4158 - DNA, 20 bp, synthetic construct
  misc_feature 1..20: note = CRISPR gRNA sequence
  source 1..20: mol_type = other DNA
tgacctggcagcgggatggg

SEQ ID NO: 4159 - DNA, 20 bp, synthetic construct
  misc_feature 1..20: note = CRISPR gRNA sequence
  source 1..20: mol_type = other DNA
gacctggcagcgggatgggg

SEQ ID NO: 4160 - DNA, 20 bp, synthetic construct
  misc_feature 1..20: note = CRISPR gRNA sequence
  source 1..20: mol_type = other DNA
ggcagcgggatggggaggac

SEQ ID NO: 4161 - DNA, 20 bp, synthetic construct
  misc_feature 1..20: note = CRISPR gRNA sequence
  source 1..20: mol_type = other DNA
gggatggggaggaccagacc

SEQ ID NO: 4162 - DNA, 20 bp, synthetic construct
  misc_feature 1..20: note = CRISPR gRNA sequence
  source 1..20: mol_type = other DNA
ggatggggaggaccagaccc

SEQ ID NO: 4163 - DNA, 20 bp, synthetic construct
  misc_feature 1..20: note = CRISPR gRNA sequence
  source 1..20: mol_type = other DNA
aggaccagacccaggacacc

SEQ ID NO: 4164 - DNA, 20 bp, synthetic construct
  misc_feature 1..20: note = CRISPR gRNA sequence
  source 1..20: mol_type = other DNA
gacccaggacaccgagcttg

SEQ ID NO: 4165 - DNA, 20 bp, synthetic construct
  misc_feature 1..20: note = CRISPR gRNA sequence
  source 1..20: mol_type = other DNA
cccaggacaccgagcttgtg

SEQ ID NO: 4166 - DNA, 20 bp, synthetic construct
  misc_feature 1..20: note = CRISPR gRNA sequence
  source 1..20: mol_type = other DNA
gacaccgagcttgtggagac

SEQ ID NO: 4167 - DNA, 20 bp, synthetic construct
  misc_feature 1..20: note = CRISPR gRNA sequence
  source 1..20: mol_type = other DNA
acaccgagcttgtggagacc

SEQ ID NO: 4168 - DNA, 20 bp, synthetic construct
  misc_feature 1..20: note = CRISPR gRNA sequence
  source 1..20: mol_type = other DNA
cgagcttgtggagaccaggc

SEQ ID NO: 4169 - DNA, 20 bp, synthetic construct
  misc_feature 1..20: note = CRISPR gRNA sequence
  source 1..20: mol_type = other DNA
gcttgtggagaccaggccag

SEQ ID NO: 4170 - DNA, 20 bp, synthetic construct
  misc_feature 1..20: note = CRISPR gRNA sequence
  source 1..20: mol_type = other DNA
cttgtggagaccaggccagc

SEQ ID NO: 4171 - DNA, 20 bp, synthetic construct
  misc_feature 1..20: note = CRISPR gRNA sequence
  source 1..20: mol_type = other DNA
tgtggagaccaggccagcag

SEQ ID NO: 4172 - DNA, 20 bp, synthetic construct
  misc_feature 1..20: note = CRISPR gRNA sequence
  source 1..20: mol_type = other DNA
gagaccaggccagcaggaga

SEQ ID NO: 4173 - DNA, 20 bp, synthetic construct
  misc_feature 1..20: note = CRISPR gRNA sequence
  source 1..20: mol_type = other DNA
cagcaggagatggaaccttc

SEQ ID NO: 4174 - DNA, 20 bp, synthetic construct
  misc_feature 1..20: note = CRISPR gRNA sequence
  source 1..20: mol_type = other DNA
caggagatggaaccttccag

SEQ ID NO: 4175 - DNA, 20 bp, synthetic construct
  misc_feature 1..20: note = CRISPR gRNA sequence
  source 1..20: mol_type = other DNA
gagatggaaccttccagaag

SEQ ID NO: 4176 - DNA, 20 bp, synthetic construct
  misc_feature 1..20: note = CRISPR gRNA sequence
  source 1..20: mol_type = other DNA
agatggaaccttccagaagt

SEQ ID NO: 4177 - DNA, 20 bp, synthetic construct
  misc_feature 1..20: note = CRISPR gRNA sequence
  source 1..20: mol_type = other DNA
tggaaccttccagaagtggg

SEQ ID NO: 4178 - DNA, 20 bp, synthetic construct
  misc_feature 1..20: note = CRISPR gRNA sequence
  source 1..20: mol_type = other DNA
cttccagaagtgggcagctg

SEQ ID NO: 4179 - DNA, 20 bp, synthetic construct
  misc_feature 1..20: note = CRISPR gRNA sequence
  source 1..20: mol_type = other DNA
ccagaagtgggcagctgtgg

SEQ ID NO: 4180 - DNA, 20 bp, synthetic construct
  misc_feature 1..20: note = CRISPR gRNA sequence
  source 1..20: mol_type = other DNA
gcagctgtggtggtgccttc

SEQ ID NO: 4181 - DNA, 20 bp, synthetic construct
  misc_feature 1..20: note = CRISPR gRNA sequence
  source 1..20: mol_type = other DNA
tgtggtggtgccttctggac

SEQ ID NO: 4182 - DNA, 20 bp, synthetic construct
  misc_feature 1..20: note = CRISPR gRNA sequence
  source 1..20: mol_type = other DNA
tggtggtgccttctggacaa

SEQ ID NO: 4183 - DNA, 20 bp, synthetic construct
  misc_feature 1..20: note = CRISPR gRNA sequence
  source 1..20: mol_type = other DNA
tggtgccttctggacaagag

SEQ ID NO: 4184 - DNA, 20 bp, synthetic construct
  misc_feature 1..20: note = CRISPR gRNA sequence
  source 1..20: mol_type = other DNA
gtgccttctggacaagagca

SEQ ID NO: 4185 - DNA, 20 bp, synthetic construct
  misc_feature 1..20: note = CRISPR gRNA sequence
  source 1..20: mol_type = other DNA
agagatacacgtgccatatg

SEQ ID NO: 4186 - DNA, 20 bp, synthetic construct
  misc_feature 1..20: note = CRISPR gRNA sequence
  source 1..20: mol_type = other DNA
acacgtgccatatgcagcac

SEQ ID NO: 4187 - DNA, 20 bp, synthetic construct
  misc_feature 1..20: note = CRISPR gRNA sequence
  source 1..20: mol_type = other DNA
cacgtgccatatgcagcacg

SEQ ID NO: 4188 - DNA, 20 bp, synthetic construct
  misc_feature 1..20: note = CRISPR gRNA sequence
  source 1..20: mol_type = other DNA
acgtgccatatgcagcacga

SEQ ID NO: 4189 - DNA, 20 bp, synthetic construct
  misc_feature 1..20: note = CRISPR gRNA sequence
  source 1..20: mol_type = other DNA
cgtgccatatgcagcacgag

SEQ ID NO: 4190 - DNA, 20 bp, synthetic construct
  misc_feature 1..20: note = CRISPR gRNA sequence
  source 1..20: mol_type = other DNA
tatgcagcacgaggggctgc

SEQ ID NO: 4191 - DNA, 20 bp, synthetic construct
  misc_feature 1..20: note = CRISPR gRNA sequence
  source 1..20: mol_type = other DNA
tgcagcacgaggggctgcaa

SEQ ID NO: 4192 - DNA, 20 bp, synthetic construct
  misc_feature 1..20: note = CRISPR gRNA sequence
  source 1..20: mol_type = other DNA
ctgcaagagcccctcaccct

SEQ ID NO: 4193 - DNA, 20 bp, synthetic construct
  misc_feature 1..20: note = CRISPR gRNA sequence
  source 1..20: mol_type = other DNA
aagagcccctcaccctgagc

SEQ ID NO: 4194 - DNA, 20 bp, synthetic construct
  misc_feature 1..20: note = CRISPR gRNA sequence
  source 1..20: mol_type = other DNA
agagcccctcaccctgagct

SEQ ID NO: 4195 - DNA, 20 bp, synthetic construct
  misc_feature 1..20: note = CRISPR gRNA sequence
  source 1..20: mol_type = other DNA
gagcccctcaccctgagctg

SEQ ID NO: 4196 - DNA, 20 bp, synthetic construct
  misc_feature 1..20: note = CRISPR gRNA sequence
  source 1..20: mol_type = other DNA
ccctcaccctgagctggggt

SEQ ID NO: 4197 - DNA, 20 bp, synthetic construct
  misc_feature 1..20: note = CRISPR gRNA sequence
  source 1..20: mol_type = other DNA
cctcaccctgagctggggta

SEQ ID NO: 4198 - DNA, 20 bp, synthetic construct
  misc_feature 1..20: note = CRISPR gRNA sequence
  source 1..20: mol_type = other DNA
tcaccctgagctggggtaag

SEQ ID NO: 4199 - DNA, 20 bp, synthetic construct
  misc_feature 1..20: note = CRISPR gRNA sequence
  source 1..20: mol_type = other DNA
caccctgagctggggtaagg

SEQ ID NO: 4200 - DNA, 20 bp, synthetic construct
  misc_feature 1..20: note = CRISPR gRNA sequence
  source 1..20: mol_type = other DNA
accctgagctggggtaagga

SEQ ID NO: 4201 - DNA, 20 bp, synthetic construct
  misc_feature 1..20: note = CRISPR gRNA sequence
  source 1..20: mol_type = other DNA
ccctgagctggggtaaggag

SEQ ID NO: 4202 - DNA, 20 bp, synthetic construct
  misc_feature 1..20: note = CRISPR gRNA sequence
  source 1..20: mol_type = other DNA
agctggggtaaggaggggaa

SEQ ID NO: 4203 - DNA, 20 bp, synthetic construct
  misc_feature 1..20: note = CRISPR gRNA sequence
  source 1..20: mol_type = other DNA
gctggggtaaggaggggaat

SEQ ID NO: 4204 - DNA, 20 bp, synthetic construct
  misc_feature 1..20: note = CRISPR gRNA sequence
  source 1..20: mol_type = other DNA
ctggggtaaggaggggaatg

SEQ ID NO: 4205 - DNA, 20 bp, synthetic construct
  misc_feature 1..20: note = CRISPR gRNA sequence
  source 1..20: mol_type = other DNA
tggggtaaggaggggaatgg

SEQ ID NO: 4206 - DNA, 20 bp, synthetic construct
  misc_feature 1..20: note = CRISPR gRNA sequence
  source 1..20: mol_type = other DNA
ggggtaaggaggggaatggg

SEQ ID NO: 4207 - DNA, 20 bp, synthetic construct
  misc_feature 1..20: note = CRISPR gRNA sequence
  source 1..20: mol_type = other DNA
tggggggtcacatctcttat

SEQ ID NO: 4208 - DNA, 20 bp, synthetic construct
  misc_feature 1..20: note = CRISPR gRNA sequence
  source 1..20: mol_type = other DNA
gggggtcacatctcttatca

SEQ ID NO: 4209 - DNA, 20 bp, synthetic construct
  misc_feature 1..20: note = CRISPR gRNA sequence
  source 1..20: mol_type = other DNA
gtcacatctcttatcagaga

SEQ ID NO: 4210 - DNA, 20 bp, synthetic construct
  misc_feature 1..20: note = CRISPR gRNA sequence
  source 1..20: mol_type = other DNA
acatctcttatcagagaaag

SEQ ID NO: 4211 - DNA, 20 bp, synthetic construct
  misc_feature 1..20: note = CRISPR gRNA sequence
  source 1..20: mol_type = other DNA
tctcttatcagagaaagcag

SEQ ID NO: 4212 - DNA, 20 bp, synthetic construct
  misc_feature 1..20: note = CRISPR gRNA sequence
  source 1..20: mol_type = other DNA
agagaaagcagaagtccttc

SEQ ID NO: 4213 - DNA, 20 bp, synthetic construct
  misc_feature 1..20: note = CRISPR gRNA sequence
  source 1..20: mol_type = other DNA
agaaagcagaagtccttctg

SEQ ID NO: 4214 - DNA, 20 bp, synthetic construct
  misc_feature 1..20: note = CRISPR gRNA sequence
  source 1..20: mol_type = other DNA
gaagtccttctggagccctt

SEQ ID NO: 4215 - DNA, 20 bp, synthetic construct
  misc_feature 1..20: note = CRISPR gRNA sequence
  source 1..20: mol_type = other DNA
tccttctggagcccttcagc

SEQ ID NO: 4216 - DNA, 20 bp, synthetic construct
  misc_feature 1..20: note = CRISPR gRNA sequence
  source 1..20: mol_type = other DNA
ccttctggagcccttcagcc

SEQ ID NO: 4217 - DNA, 20 bp, synthetic construct
  misc_feature 1..20: note = CRISPR gRNA sequence
  source 1..20: mol_type = other DNA
ctggagcccttcagccgggt

SEQ ID NO: 4218 - DNA, 20 bp, synthetic construct
  misc_feature 1..20: note = CRISPR gRNA sequence
  source 1..20: mol_type = other DNA
tggagcccttcagccgggtc

SEQ ID NO: 4219 - DNA, 20 bp, synthetic construct
  misc_feature 1..20: note = CRISPR gRNA sequence
  source 1..20: mol_type = other DNA
ggagcccttcagccgggtca

SEQ ID NO: 4220 - DNA, 20 bp, synthetic construct
  misc_feature 1..20: note = CRISPR gRNA sequence
  source 1..20: mol_type = other DNA
ccttcagccgggtcagggct

SEQ ID NO: 4221 - DNA, 20 bp, synthetic construct
  misc_feature 1..20: note = CRISPR gRNA sequence
  source 1..20: mol_type = other DNA
cttcagccgggtcagggctg

SEQ ID NO: 4222 - DNA, 20 bp, synthetic construct
  misc_feature 1..20: note = CRISPR gRNA sequence
  source 1..20: mol_type = other DNA
gccgggtcagggctgaggct

SEQ ID NO: 4223 - DNA, 20 bp, synthetic construct
  misc_feature 1..20: note = CRISPR gRNA sequence
  source 1..20: mol_type = other DNA
ccgggtcagggctgaggctt

SEQ ID NO: 4224 - DNA, 20 bp, synthetic construct
  misc_feature 1..20: note = CRISPR gRNA sequence
  source 1..20: mol_type = other DNA
cgggtcagggctgaggcttg

SEQ ID NO: 4225 - DNA, 20 bp, synthetic construct
  misc_feature 1..20: note = CRISPR gRNA sequence
  source 1..20: mol_type = other DNA
gggtcagggctgaggcttgg

SEQ ID NO: 4226 - DNA, 20 bp, synthetic construct
  misc_feature 1..20: note = CRISPR gRNA sequence
  source 1..20: mol_type = other DNA
cagggctgaggcttgggggt

SEQ ID NO: 4227 - DNA, 20 bp, synthetic construct
  misc_feature 1..20: note = CRISPR gRNA sequence
  source 1..20: mol_type = other DNA
agggctgaggcttgggggtc

SEQ ID NO: 4228 - DNA, 20 bp, synthetic construct
  misc_feature 1..20: note = CRISPR gRNA sequence
  source 1..20: mol_type = other DNA
gggctgaggcttgggggtca

SEQ ID NO: 4229 - DNA, 20 bp, synthetic construct
  misc_feature 1..20: note = CRISPR gRNA sequence
  source 1..20: mol_type = other DNA
ctcaccttctcctcctttcc

SEQ ID NO: 4230 - DNA, 20 bp, synthetic construct
  misc_feature 1..20: note = CRISPR gRNA sequence
  source 1..20: mol_type = other DNA
caccttctcctcctttccca

SEQ ID NO: 4231 - DNA, 20 bp, synthetic construct
  misc_feature 1..20: note = CRISPR gRNA sequence
  source 1..20: mol_type = other DNA
ctttcccagagccatcttcc

SEQ ID NO: 4232 - DNA, 20 bp, synthetic construct
  misc_feature 1..20: note = CRISPR gRNA sequence
  source 1..20: mol_type = other DNA
ccagcccaccatccccatca

SEQ ID NO: 4233 - DNA, 20 bp, synthetic construct
  misc_feature 1..20: note = CRISPR gRNA sequence
  source 1..20: mol_type = other DNA
cagcccaccatccccatcat

SEQ ID NO: 4234 - DNA, 20 bp, synthetic construct
  misc_feature 1..20: note = CRISPR gRNA sequence
  source 1..20: mol_type = other DNA
cccatcatgggcatcgttgc

SEQ ID NO: 4235 - DNA, 20 bp, synthetic construct
  misc_feature 1..20: note = CRISPR gRNA sequence
  source 1..20: mol_type = other DNA
catgggcatcgttgctggcc

SEQ ID NO: 4236 - DNA, 20 bp, synthetic construct
  misc_feature 1..20: note = CRISPR gRNA sequence
  source 1..20: mol_type = other DNA
cgttgctggcctggctgtcc

SEQ ID NO: 4237 - DNA, 20 bp, synthetic construct
  misc_feature 1..20: note = CRISPR gRNA sequence
  source 1..20: mol_type = other DNA
cctggctgtcctggttgtcc

SEQ ID NO: 4238 - DNA, 20 bp, synthetic construct
  misc_feature 1..20: note = CRISPR gRNA sequence
  source 1..20: mol_type = other DNA
ctggttgtcctagctgtcct

SEQ ID NO: 4239 - DNA, 20 bp, synthetic construct
  misc_feature 1..20: note = CRISPR gRNA sequence
  source 1..20: mol_type = other DNA
ggttgtcctagctgtccttg

SEQ ID NO: 4240 - DNA, 20 bp, synthetic construct
  misc_feature 1..20: note = CRISPR gRNA sequence
  source 1..20: mol_type = other DNA
cctagctgtccttggagctg

SEQ ID NO: 4241 - DNA, 20 bp, synthetic construct
  misc_feature 1..20: note = CRISPR gRNA sequence
  source 1..20: mol_type = other DNA
gtggtcaccgctatgatgtg

SEQ ID NO: 4242 - DNA, 20 bp, synthetic construct
  misc_feature 1..20: note = CRISPR gRNA sequence
  source 1..20: mol_type = other DNA
tggtcaccgctatgatgtgt

SEQ ID NO: 4243 - DNA, 20 bp, synthetic construct
  misc_feature 1..20: note = CRISPR gRNA sequence
  source 1..20: mol_type = other DNA
gtcaccgctatgatgtgtag

SEQ ID NO: 4244 - DNA, 20 bp, synthetic construct
  misc_feature 1..20: note = CRISPR gRNA sequence
  source 1..20: mol_type = other DNA
tcaccgctatgatgtgtagg

SEQ ID NO: 4245 - DNA, 20 bp, synthetic construct
  misc_feature 1..20: note = CRISPR gRNA sequence
  source 1..20: mol_type = other DNA
ccgctatgatgtgtaggagg

SEQ ID NO: 4246 - DNA, 20 bp, synthetic construct
  misc_feature 1..20: note = CRISPR gRNA sequence
  source 1..20: mol_type = other DNA
gctatgatgtgtaggaggaa

SEQ ID NO: 4247 - DNA, 20 bp, synthetic construct
  misc_feature 1..20: note = CRISPR gRNA sequence
  source 1..20: mol_type = other DNA
gatgtgtaggaggaagagct

SEQ ID NO: 4248 - DNA, 20 bp, synthetic construct
  misc_feature 1..20: note = CRISPR gRNA sequence
  source 1..20: mol_type = other DNA
atgtgtaggaggaagagctc

SEQ ID NO: 4249 - DNA, 20 bp, synthetic construct
  misc_feature 1..20: note = CRISPR gRNA sequence
  source 1..20: mol_type = other DNA
tgtaggaggaagagctcagg

SEQ ID NO: 4250 - DNA, 20 bp, synthetic construct
  misc_feature 1..20: note = CRISPR gRNA sequence
  source 1..20: mol_type = other DNA
gtaggaggaagagctcaggt

SEQ ID NO: 4251 - DNA, 20 bp, synthetic construct
  misc_feature 1..20: note = CRISPR gRNA sequence
  source 1..20: mol_type = other DNA
taggaggaagagctcaggta

SEQ ID NO: 4252 - DNA, 20 bp, synthetic construct
  misc_feature 1..20: note = CRISPR gRNA sequence
  source 1..20: mol_type = other DNA
gaggaagagctcaggtaggg

SEQ ID NO: 4253 - DNA, 20 bp, synthetic construct
  misc_feature 1..20: note = CRISPR gRNA sequence
  source 1..20: mol_type = other DNA
aggaagagctcaggtaggga

SEQ ID NO: 4254 - DNA, 20 bp, synthetic construct
  misc_feature 1..20: note = CRISPR gRNA sequence
  source 1..20: mol_type = other DNA
ggaagagctcaggtagggaa

SEQ ID NO: 4255 - DNA, 20 bp, synthetic construct
  misc_feature 1..20: note = CRISPR gRNA sequence
  source 1..20: mol_type = other DNA
gaagagctcaggtagggaag

SEQ ID NO: 4256 - DNA, 20 bp, synthetic construct
  misc_feature 1..20: note = CRISPR gRNA sequence
  source 1..20: mol_type = other DNA
gctcaggtagggaaggggtg

SEQ ID NO: 4257 - DNA, 20 bp, synthetic construct
  misc_feature 1..20: note = CRISPR gRNA sequence
  source 1..20: mol_type = other DNA
tcaggtagggaaggggtgaa

SEQ ID NO: 4258 - DNA, 20 bp, synthetic construct
  misc_feature 1..20: note = CRISPR gRNA sequence
  source 1..20: mol_type = other DNA
ggtagggaaggggtgaagag

SEQ ID NO: 4259 - DNA, 20 bp, synthetic construct
  misc_feature 1..20: note = CRISPR gRNA sequence
  source 1..20: mol_type = other DNA
gtagggaaggggtgaagagc

SEQ ID NO: 4260 - DNA, 20 bp, synthetic construct
  misc_feature 1..20: note = CRISPR gRNA sequence
  source 1..20: mol_type = other DNA
tagggaaggggtgaagagcg

SEQ ID NO: 4261 - DNA, 20 bp, synthetic construct
  misc_feature 1..20: note = CRISPR gRNA sequence
  source 1..20: mol_type = other DNA
aaggggtgaagagcggggtc

SEQ ID NO: 4262 - DNA, 20 bp, synthetic construct
  misc_feature 1..20: note = CRISPR gRNA sequence
  source 1..20: mol_type = other DNA
aggggtgaagagcggggtct

SEQ ID NO: 4263 - DNA, 20 bp, synthetic construct
  misc_feature 1..20: note = CRISPR gRNA sequence
  source 1..20: mol_type = other DNA
tctgggttttcttgtcccac

SEQ ID NO: 4264 - DNA, 20 bp, synthetic construct
  misc_feature 1..20: note = CRISPR gRNA sequence
  source 1..20: mol_type = other DNA
ctgggttttcttgtcccact

SEQ ID NO: 4265 - DNA, 20 bp, synthetic construct
  misc_feature 1..20: note = CRISPR gRNA sequence
  source 1..20: mol_type = other DNA
gggttttcttgtcccactgg

SEQ ID NO: 4266 - DNA, 20 bp, synthetic construct
  misc_feature 1..20: note = CRISPR gRNA sequence
  source 1..20: mol_type = other DNA
cttgtcccactgggagtttc

SEQ ID NO: 4267 - DNA, 20 bp, synthetic construct
  misc_feature 1..20: note = CRISPR gRNA sequence
  source 1..20: mol_type = other DNA
ccactgggagtttcaagccc

SEQ ID NO: 4268 - DNA, 20 bp, synthetic construct
  misc_feature 1..20: note = CRISPR gRNA sequence
  source 1..20: mol_type = other DNA
cactgggagtttcaagcccc

SEQ ID NO: 4269 - DNA, 20 bp, synthetic construct
  misc_feature 1..20: note = CRISPR gRNA sequence
  source 1..20: mol_type = other DNA
tgggagtttcaagccccagg

SEQ ID NO: 4270 - DNA, 20 bp, synthetic construct
  misc_feature 1..20: note = CRISPR gRNA sequence
  source 1..20: mol_type = other DNA
gagtttcaagccccaggtag

SEQ ID NO: 4271 - DNA, 20 bp, synthetic construct
  misc_feature 1..20: note = CRISPR gRNA sequence
  source 1..20: mol_type = other DNA
agtgtgccccgccttgttac

SEQ ID NO: 4272 - DNA, 20 bp, synthetic construct
  misc_feature 1..20: note = CRISPR gRNA sequence
  source 1..20: mol_type = other DNA
gtgccccgccttgttactgg

SEQ ID NO: 4273 - DNA, 20 bp, synthetic construct
  misc_feature 1..20: note = CRISPR gRNA sequence
  source 1..20: mol_type = other DNA
ctggaagcaccatccacaca

SEQ ID NO: 4274 - DNA, 20 bp, synthetic construct
  misc_feature 1..20: note = CRISPR gRNA sequence
  source 1..20: mol_type = other DNA
tggaagcaccatccacacat

SEQ ID NO: 4275 - DNA, 20 bp, synthetic construct
  misc_feature 1..20: note = CRISPR gRNA sequence
  source 1..20: mol_type = other DNA
catccacacatgggccatcc

SEQ ID NO: 4276 - DNA, 20 bp, synthetic construct
  misc_feature 1..20: note = CRISPR gRNA sequence
  source 1..20: mol_type = other DNA
acacatgggccatcccagcc

SEQ ID NO: 4277 - DNA, 20 bp, synthetic construct
  misc_feature 1..20: note = CRISPR gRNA sequence
  source 1..20: mol_type = other DNA
cacatgggccatcccagcct

SEQ ID NO: 4278 - DNA, 20 bp, synthetic construct
  misc_feature 1..20: note = CRISPR gRNA sequence
  source 1..20: mol_type = other DNA
cagcctgggaccctgtgtgc

SEQ ID NO: 4279 - DNA, 20 bp, synthetic construct
  misc_feature 1..20: note = CRISPR gRNA sequence
  source 1..20: mol_type = other DNA
ccagcacttactcttttgtg

SEQ ID NO: 4280 - DNA, 20 bp, synthetic construct
  misc_feature 1..20: note = CRISPR gRNA sequence
  source 1..20: mol_type = other DNA
gtgaagcacatgtgacaatg

SEQ ID NO: 4281 - DNA, 20 bp, synthetic construct
  misc_feature 1..20: note = CRISPR gRNA sequence
  source 1..20: mol_type = other DNA
tgaagcacatgtgacaatga

SEQ ID NO: 4282 - DNA, 20 bp, synthetic construct
  misc_feature 1..20: note = CRISPR gRNA sequence
  source 1..20: mol_type = other DNA
gcacatgtgacaatgaagga

SEQ ID NO: 4283 - DNA, 20 bp, synthetic construct
  misc_feature 1..20: note = CRISPR gRNA sequence
  source 1..20: mol_type = other DNA
atgtatcaccttgatgatta

SEQ ID NO: 4284 - DNA, 20 bp, synthetic construct
  misc_feature 1..20: note = CRISPR gRNA sequence
  source 1..20: mol_type = other DNA
caccttgatgattatggtgt

SEQ ID NO: 4285 - DNA, 20 bp, synthetic construct
  misc_feature 1..20: note = CRISPR gRNA sequence
  source 1..20: mol_type = other DNA
accttgatgattatggtgtt

SEQ ID NO: 4286 - DNA, 20 bp, synthetic construct
  misc_feature 1..20: note = CRISPR gRNA sequence
  source 1..20: mol_type = other DNA
ccttgatgattatggtgttg

SEQ ID NO: 4287 - DNA, 20 bp, synthetic construct
  misc_feature 1..20: note = CRISPR gRNA sequence
  source 1..20: mol_type = other DNA
tggtgttggggtcctgattc

SEQ ID NO: 4288 - DNA, 20 bp, synthetic construct
  misc_feature 1..20: note = CRISPR gRNA sequence
  source 1..20: mol_type = other DNA
gtcctgattccagcattcat

SEQ ID NO: 4289 - DNA, 20 bp, synthetic construct
  misc_feature 1..20: note = CRISPR gRNA sequence
  source 1..20: mol_type = other DNA
tgattccagcattcatgagt

SEQ ID NO: 4290 - DNA, 20 bp, synthetic construct
  misc_feature 1..20: note = CRISPR gRNA sequence
  source 1..20: mol_type = other DNA
gattccagcattcatgagtc

SEQ ID NO: 4291 - DNA, 20 bp, synthetic construct
  misc_feature 1..20: note = CRISPR gRNA sequence
  source 1..20: mol_type = other DNA
attccagcattcatgagtca

SEQ ID NO: 4292 - DNA, 20 bp, synthetic construct
  misc_feature 1..20: note = CRISPR gRNA sequence
  source 1..20: mol_type = other DNA
ttccagcattcatgagtcag

SEQ ID NO: 4293 - DNA, 20 bp, synthetic construct
  misc_feature 1..20: note = CRISPR gRNA sequence
  source 1..20: mol_type = other DNA
cagcattcatgagtcagggg

SEQ ID NO: 4294 - DNA, 20 bp, synthetic construct
  misc_feature 1..20: note = CRISPR gRNA sequence
  source 1..20: mol_type = other DNA
agcattcatgagtcagggga

SEQ ID NO: 4295 - DNA, 20 bp, synthetic construct
  misc_feature 1..20: note = CRISPR gRNA sequence
  source 1..20: mol_type = other DNA
gtcaggggaaggtccctgct

SEQ ID NO: 4296 - DNA, 20 bp, synthetic construct
  misc_feature 1..20: note = CRISPR gRNA sequence
  source 1..20: mol_type = other DNA
tcaggggaaggtccctgcta

SEQ ID NO: 4297 - DNA, 20 bp, synthetic construct
  misc_feature 1..20: note = CRISPR gRNA sequence
  source 1..20: mol_type = other DNA
gggaaggtccctgctaagga

SEQ ID NO: 4298 - DNA, 20 bp, synthetic construct
  misc_feature 1..20: note = CRISPR gRNA sequence
  source 1..20: mol_type = other DNA
tccctgctaaggacagacct

SEQ ID NO: 4299 - DNA, 20 bp, synthetic construct
  misc_feature 1..20: note = CRISPR gRNA sequence
  source 1..20: mol_type = other DNA
ccctgctaaggacagacctt

SEQ ID NO: 4300 - DNA, 20 bp, synthetic construct
  misc_feature 1..20: note = CRISPR gRNA sequence
  source 1..20: mol_type = other DNA
ctgctaaggacagaccttag

SEQ ID NO: 4301 - DNA, 20 bp, synthetic construct
  misc_feature 1..20: note = CRISPR gRNA sequence
  source 1..20: mol_type = other DNA
tgctaaggacagaccttagg

SEQ ID NO: 4302 - DNA, 20 bp, synthetic construct
  misc_feature 1..20: note = CRISPR gRNA sequence
  source 1..20: mol_type = other DNA
gctaaggacagaccttagga

SEQ ID NO: 4303 - DNA, 20 bp, synthetic construct
  misc_feature 1..20: note = CRISPR gRNA sequence
  source 1..20: mol_type = other DNA
aaggacagaccttaggaggg

SEQ ID NO: 4304 - DNA, 20 bp, synthetic construct
  misc_feature 1..20: note = CRISPR gRNA sequence
  source 1..20: mol_type = other DNA
acagaccttaggagggcagt

SEQ ID NO: 4305 - DNA, 20 bp, synthetic construct
  misc_feature 1..20: note = CRISPR gRNA sequence
  source 1..20: mol_type = other DNA
ccttaggagggcagttggtc

SEQ ID NO: 4306 - DNA, 20 bp, synthetic construct
  misc_feature 1..20: note = CRISPR gRNA sequence
  source 1..20: mol_type = other DNA
catgtttcctgatcctgccc

SEQ ID NO: 4307 - DNA, 20 bp, synthetic construct
  misc_feature 1..20: note = CRISPR gRNA sequence
  source 1..20: mol_type = other DNA
atgtttcctgatcctgccct

SEQ ID NO: 4308 - DNA, 20 bp, synthetic construct
  misc_feature 1..20: note = CRISPR gRNA sequence
  source 1..20: mol_type = other DNA
ctgatcctgccctgggtctg

SEQ ID NO: 4309 - DNA, 20 bp, synthetic construct
  misc_feature 1..20: note = CRISPR gRNA sequence
  source 1..20: mol_type = other DNA
ctgccctgggtctgcagtcg

SEQ ID NO: 4310 - DNA, 20 bp, synthetic construct
  misc_feature 1..20: note = CRISPR gRNA sequence
  source 1..20: mol_type = other DNA
tgggtctgcagtcgtagttc

SEQ ID NO: 4311 - DNA, 20 bp, synthetic construct
  misc_feature 1..20: note = CRISPR gRNA sequence
  source 1..20: mol_type = other DNA
gtagttctggaaacttctct

SEQ ID NO: 4312 - DNA, 20 bp, synthetic construct
  misc_feature 1..20: note = CRISPR gRNA sequence
  source 1..20: mol_type = other DNA
tagttctggaaacttctctt

SEQ ID NO: 4313 - DNA, 20 bp, synthetic construct
  misc_feature 1..20: note = CRISPR gRNA sequence
  source 1..20: mol_type = other DNA
tggaaacttctcttgggtcc

SEQ ID NO: 4314 - DNA, 20 bp, synthetic construct
  misc_feature 1..20: note = CRISPR gRNA sequence
  source 1..20: mol_type = other DNA
acttctcttgggtccaagac

SEQ ID NO: 4315 - DNA, 20 bp, synthetic construct
  misc_feature 1..20: note = CRISPR gRNA sequence
  source 1..20: mol_type = other DNA
cttctcttgggtccaagact

SEQ ID NO: 4316 - DNA, 20 bp, synthetic construct
  misc_feature 1..20: note = CRISPR gRNA sequence
  source 1..20: mol_type = other DNA
tctcttgggtccaagactag

SEQ ID NO: 4317 - DNA, 20 bp, synthetic construct
  misc_feature 1..20: note = CRISPR gRNA sequence
  source 1..20: mol_type = other DNA
ctcttgggtccaagactagg

SEQ ID NO: 4318 - DNA, 20 bp, synthetic construct
  misc_feature 1..20: note = CRISPR gRNA sequence
  source 1..20: mol_type = other DNA
caagactaggaggttcccct

SEQ ID NO: 4319 - DNA, 20 bp, synthetic construct
  misc_feature 1..20: note = CRISPR gRNA sequence
  source 1..20: mol_type = other DNA
gaggttcccctaagatcaca

SEQ ID NO: 4320 - DNA, 20 bp, synthetic construct
  misc_feature 1..20: note = CRISPR gRNA sequence
  source 1..20: mol_type = other DNA
cacatggccctgcctcctcc

SEQ ID NO: 4321 - DNA, 20 bp, synthetic construct
  misc_feature 1..20: note = CRISPR gRNA sequence
  source 1..20: mol_type = other DNA
gcctcctcccagtcccctca

SEQ ID NO: 4322 - DNA, 20 bp, synthetic construct
  misc_feature 1..20: note = CRISPR gRNA sequence
  source 1..20: mol_type = other DNA
cctcctcccagtcccctcat

SEQ ID NO: 4323 - DNA, 20 bp, synthetic construct
  misc_feature 1..20: note = CRISPR gRNA sequence
  source 1..20: mol_type = other DNA
ctcctcccagtcccctcata

SEQ ID NO: 4324 - DNA, 20 bp, synthetic construct
  misc_feature 1..20: note = CRISPR gRNA sequence
  source 1..20: mol_type = other DNA
catagggcattttcttccca

SEQ ID NO: 4325 - DNA, 20 bp, synthetic construct
  misc_feature 1..20: note = CRISPR gRNA sequence
  source 1..20: mol_type = other DNA
atagggcattttcttcccac

SEQ ID NO: 4326 - DNA, 20 bp, synthetic construct
  misc_feature 1..20: note = CRISPR gRNA sequence
  source 1..20: mol_type = other DNA
gggcattttcttcccacagg

SEQ ID NO: 4327 - DNA, 20 bp, synthetic construct
  misc_feature 1..20: note = CRISPR gRNA sequence
  source 1..20: mol_type = other DNA
ttttcttcccacaggtggaa

SEQ ID NO: 4328 - DNA, 20 bp, synthetic construct
  misc_feature 1..20: note = CRISPR gRNA sequence
  source 1..20: mol_type = other DNA
tttcttcccacaggtggaaa

SEQ ID NO: 4329 - DNA, 20 bp, synthetic construct
  misc_feature 1..20: note = CRISPR gRNA sequence
  source 1..20: mol_type = other DNA
tcttcccacaggtggaaaag

SEQ ID NO: 4330 - DNA, 20 bp, synthetic construct
  misc_feature 1..20: note = CRISPR gRNA sequence
  source 1..20: mol_type = other DNA
cttcccacaggtggaaaagg

SEQ ID NO: 4331 - DNA, 20 bp, synthetic construct
  misc_feature 1..20: note = CRISPR gRNA sequence
  source 1..20: mol_type = other DNA
ttcccacaggtggaaaagga

SEQ ID NO: 4332 - DNA, 20 bp, synthetic construct
  misc_feature 1..20: note = CRISPR gRNA sequence
  source 1..20: mol_type = other DNA
cccacaggtggaaaaggagg

SEQ ID NO: 4333 - DNA, 20 bp, synthetic construct
  misc_feature 1..20: note = CRISPR gRNA sequence
  source 1..20: mol_type = other DNA
gaaaaggagggagctgctct

SEQ ID NO: 4334 - DNA, 20 bp, synthetic construct
  misc_feature 1..20: note = CRISPR gRNA sequence
  source 1..20: mol_type = other DNA
aaaaggagggagctgctctc

SEQ ID NO: 4335 - DNA, 20 bp, synthetic construct
  misc_feature 1..20: note = CRISPR gRNA sequence
  source 1..20: mol_type = other DNA
gctgctctcaggctgcgtgt

SEQ ID NO: 4336 - DNA, 20 bp, synthetic construct
  misc_feature 1..20: note = CRISPR gRNA sequence
  source 1..20: mol_type = other DNA
ctcaggctgcgtgtaagtga

SEQ ID NO: 4337 - DNA, 20 bp, synthetic construct
  misc_feature 1..20: note = CRISPR gRNA sequence
  source 1..20: mol_type = other DNA
aggctgcgtgtaagtgatgg

SEQ ID NO: 4338 - DNA, 20 bp, synthetic construct
  misc_feature 1..20: note = CRISPR gRNA sequence
  source 1..20: mol_type = other DNA
ctgcgtgtaagtgatggcgg

SEQ ID NO: 4339 - DNA, 20 bp, synthetic construct
  misc_feature 1..20: note = CRISPR gRNA sequence
  source 1..20: mol_type = other DNA
tgcgtgtaagtgatggcggc

SEQ ID NO: 4340 - DNA, 20 bp, synthetic construct
  misc_feature 1..20: note = CRISPR gRNA sequence
  source 1..20: mol_type = other DNA
aagtgatggcggcgggcgtg

SEQ ID NO: 4341 - DNA, 20 bp, synthetic construct
  misc_feature 1..20: note = CRISPR gRNA sequence
  source 1..20: mol_type = other DNA
gtgatggcggcgggcgtgtg

SEQ ID NO: 4342 - DNA, 20 bp, synthetic construct
  misc_feature 1..20: note = CRISPR gRNA sequence
  source 1..20: mol_type = other DNA
tgatggcggcgggcgtgtgg

SEQ ID NO: 4343 - DNA, 20 bp, synthetic construct
  misc_feature 1..20: note = CRISPR gRNA sequence
  source 1..20: mol_type = other DNA
atggcggcgggcgtgtggag

SEQ ID NO: 4344 - DNA, 20 bp, synthetic construct
  misc_feature 1..20: note = CRISPR gRNA sequence
  source 1..20: mol_type = other DNA
ctcttgtcccacatctcctg

SEQ ID NO: 4345 - DNA, 20 bp, synthetic construct
  misc_feature 1..20: note = CRISPR gRNA sequence
  source 1..20: mol_type = other DNA
tcttgtcccacatctcctgc

SEQ ID NO: 4346 - DNA, 20 bp, synthetic construct
  misc_feature 1..20: note = CRISPR gRNA sequence
  source 1..20: mol_type = other DNA
catctcctgcgggctctgac

SEQ ID NO: 4347 - DNA, 20 bp, synthetic construct
  misc_feature 1..20: note = CRISPR gRNA sequence
  source 1..20: mol_type = other DNA
atctcctgcgggctctgacc

SEQ ID NO: 4348 - DNA, 20 bp, synthetic construct
  misc_feature 1..20: note = CRISPR gRNA sequence
  source 1..20: mol_type = other DNA
tctttttttttgttctaccc

SEQ ID NO: 4349 - DNA, 20 bp, synthetic construct
  misc_feature 1..20: note = CRISPR gRNA sequence
  source 1..20: mol_type = other DNA
ctttttttttgttctacccc

SEQ ID NO: 4350 - DNA, 20 bp, synthetic construct
  misc_feature 1..20: note = CRISPR gRNA sequence
  source 1..20: mol_type = other DNA
tttttttgttctaccccagg

SEQ ID NO: 4351 - DNA, 20 bp, synthetic construct
  misc_feature 1..20: note = CRISPR gRNA sequence
  source 1..20: mol_type = other DNA
tgttctaccccaggcagcaa

SEQ ID NO: 4352 - DNA, 20 bp, synthetic construct
  misc_feature 1..20: note = CRISPR gRNA sequence
  source 1..20: mol_type = other DNA
ccccaggcagcaacagtgcc

SEQ ID NO: 4353 - DNA, 20 bp, synthetic construct
  misc_feature 1..20: note = CRISPR gRNA sequence
  source 1..20: mol_type = other DNA
cccaggcagcaacagtgccc

SEQ ID NO: 4354 - DNA, 20 bp, synthetic construct
  misc_feature 1..20: note = CRISPR gRNA sequence
  source 1..20: mol_type = other DNA
ccaggcagcaacagtgccca

SEQ ID NO: 4355 - DNA, 20 bp, synthetic construct
  misc_feature 1..20: note = CRISPR gRNA sequence
  source 1..20: mol_type = other DNA
acagtgcccagggctctgat

SEQ ID NO: 4356 - DNA, 20 bp, synthetic construct
  misc_feature 1..20: note = CRISPR gRNA sequence
  source 1..20: mol_type = other DNA
tgagtctctcatcacttgta

SEQ ID NO: 4357 - DNA, 20 bp, synthetic construct
  misc_feature 1..20: note = CRISPR gRNA sequence
  source 1..20: mol_type = other DNA
gagtctctcatcacttgtaa

SEQ ID NO: 4358 - DNA, 20 bp, synthetic construct
  misc_feature 1..20: note = CRISPR gRNA sequence
  source 1..20: mol_type = other DNA
ctctcatcacttgtaaaggt

SEQ ID NO: 4359 - DNA, 20 bp, synthetic construct
  misc_feature 1..20: note = CRISPR gRNA sequence
  source 1..20: mol_type = other DNA
cacttgtaaaggtgagattc

SEQ ID NO: 4360 - DNA, 20 bp, synthetic construct
  misc_feature 1..20: note = CRISPR gRNA sequence
  source 1..20: mol_type = other DNA
acttgtaaaggtgagattct

SEQ ID NO: 4361 - DNA, 20 bp, synthetic construct
  misc_feature 1..20: note = CRISPR gRNA sequence
  source 1..20: mol_type = other DNA
cttgtaaaggtgagattctg

SEQ ID NO: 4362 - DNA, 20 bp, synthetic construct
  misc_feature 1..20: note = CRISPR gRNA sequence
  source 1..20: mol_type = other DNA
tgtaaaggtgagattctggg

SEQ ID NO: 4363 - DNA, 20 bp, synthetic construct
  misc_feature 1..20: note = CRISPR gRNA sequence
  source 1..20: mol_type = other DNA
ggtgagattctggggagctg

SEQ ID NO: 4364 - DNA, 20 bp, synthetic construct
  misc_feature 1..20: note = CRISPR gRNA sequence
  source 1..20: mol_type = other DNA
gagattctggggagctgaag

SEQ ID NO: 4365 - DNA, 20 bp, synthetic construct
  misc_feature 1..20: note = CRISPR gRNA sequence
  source 1..20: mol_type = other DNA
ttctggggagctgaagtggt

SEQ ID NO: 4366 - DNA, 20 bp, synthetic construct
  misc_feature 1..20: note = CRISPR gRNA sequence
  source 1..20: mol_type = other DNA
tctggggagctgaagtggtc

SEQ ID NO: 4367 - DNA, 20 bp, synthetic construct
  misc_feature 1..20: note = CRISPR gRNA sequence
  source 1..20: mol_type = other DNA
ctggggagctgaagtggtcg

SEQ ID NO: 4368 - DNA, 20 bp, synthetic construct
  misc_feature 1..20: note = CRISPR gRNA sequence
  source 1..20: mol_type = other DNA
tggggagctgaagtggtcgg

SEQ ID NO: 4369 - DNA, 20 bp, synthetic construct
  misc_feature 1..20: note = CRISPR gRNA sequence
  source 1..20: mol_type = other DNA
ggagctgaagtggtcggggg

SEQ ID NO: 4370 - DNA, 20 bp, synthetic construct
  misc_feature 1..20: note = CRISPR gRNA sequence
  source 1..20: mol_type = other DNA
gagctgaagtggtcgggggt

SEQ ID NO: 4371 - DNA, 20 bp, synthetic construct
  misc_feature 1..20: note = CRISPR gRNA sequence
  source 1..20: mol_type = other DNA
agctgaagtggtcgggggtg

SEQ ID NO: 4372 - DNA, 20 bp, synthetic construct
  misc_feature 1..20: note = CRISPR gRNA sequence
  source 1..20: mol_type = other DNA
tgaagtggtcgggggtgggg

SEQ ID NO: 4373 - DNA, 20 bp, synthetic construct
  misc_feature 1..20: note = CRISPR gRNA sequence
  source 1..20: mol_type = other DNA
aagtggtcgggggtggggca

SEQ ID NO: 4374 - DNA, 20 bp, synthetic construct
  misc_feature 1..20: note = CRISPR gRNA sequence
  source 1..20: mol_type = other DNA
agtggtcgggggtggggcag

SEQ ID NO: 4375 - DNA, 20 bp, synthetic construct
  misc_feature 1..20: note = CRISPR gRNA sequence
  source 1..20: mol_type = other DNA
gtggtcgggggtggggcaga

SEQ ID NO: 4376 - DNA, 20 bp, synthetic construct
  misc_feature 1..20: note = CRISPR gRNA sequence
  source 1..20: mol_type = other DNA
cgggggtggggcagagggaa

SEQ ID NO: 4377 - DNA, 20 bp, synthetic construct
  misc_feature 1..20: note = CRISPR gRNA sequence
  source 1..20: mol_type = other DNA
gggggtggggcagagggaaa

SEQ ID NO: 4378 - DNA, 20 bp, synthetic construct
  misc_feature 1..20: note = CRISPR gRNA sequence
  source 1..20: mol_type = other DNA
tggggcagagggaaaaggcc

SEQ ID NO: 4379 - DNA, 20 bp, synthetic construct
  misc_feature 1..20: note = CRISPR gRNA sequence
  source 1..20: mol_type = other DNA
ggggcagagggaaaaggcct

SEQ ID NO: 4380 - DNA, 20 bp, synthetic construct
  misc_feature 1..20: note = CRISPR gRNA sequence
  source 1..20: mol_type = other DNA
gagggaaaaggcctgggtaa

SEQ ID NO: 4381 - DNA, 20 bp, synthetic construct
  misc_feature 1..20: note = CRISPR gRNA sequence
  source 1..20: mol_type = other DNA
agggaaaaggcctgggtaat

SEQ ID NO: 4382 - DNA, 20 bp, synthetic construct
  misc_feature 1..20: note = CRISPR gRNA sequence
  source 1..20: mol_type = other DNA
gggaaaaggcctgggtaatg

SEQ ID NO: 4383 - DNA, 20 bp, synthetic construct
  misc_feature 1..20: note = CRISPR gRNA sequence
  source 1..20: mol_type = other DNA
ggtaatggggattctttgat

SEQ ID NO: 4384 - DNA, 20 bp, synthetic construct
  misc_feature 1..20: note = CRISPR gRNA sequence
  source 1..20: mol_type = other DNA
gtaatggggattctttgatt

SEQ ID NO: 4385 - DNA, 20 bp, synthetic construct
  misc_feature 1..20: note = CRISPR gRNA sequence
  source 1..20: mol_type = other DNA
ttctttgattgggacgtttc

SEQ ID NO: 4386 - DNA, 20 bp, synthetic construct
  misc_feature 1..20: note = CRISPR gRNA sequence
  source 1..20: mol_type = other DNA
attgggacgtttcgagtgtg

SEQ ID NO: 4387 - DNA, 20 bp, synthetic construct
  misc_feature 1..20: note = CRISPR gRNA sequence
  source 1..20: mol_type = other DNA
gggacgtttcgagtgtgtgg

SEQ ID NO: 4388 - DNA, 20 bp, synthetic construct
  misc_feature 1..20: note = CRISPR gRNA sequence
  source 1..20: mol_type = other DNA
ggacgtttcgagtgtgtggt

SEQ ID NO: 4389 - DNA, 20 bp, synthetic construct
  misc_feature 1..20: note = CRISPR gRNA sequence
  source 1..20: mol_type = other DNA
cactcgaaacgtcccaatca

SEQ ID NO: 4390 - DNA, 20 bp, synthetic construct
  misc_feature 1..20: note = CRISPR gRNA sequence
  source 1..20: mol_type = other DNA
ccccgaccacttcagctccc

SEQ ID NO: 4391 - DNA, 20 bp, synthetic construct
  misc_feature 1..20: note = CRISPR gRNA sequence
  source 1..20: mol_type = other DNA
ccctgggcactgttgctgcc

SEQ ID NO: 4392 - DNA, 20 bp, synthetic construct
  misc_feature 1..20: note = CRISPR gRNA sequence
  source 1..20: mol_type = other DNA
cgcaggagatgtgggacaag

SEQ ID NO: 4393 - DNA, 20 bp, synthetic construct
  misc_feature 1..20: note = CRISPR gRNA sequence
  source 1..20: mol_type = other DNA
atgtgggacaagaggaatta

SEQ ID NO: 4394 - DNA, 20 bp, synthetic construct
  misc_feature 1..20: note = CRISPR gRNA sequence
  source 1..20: mol_type = other DNA
ctacgactgcagacccaggg

SEQ ID NO: 4395 - DNA, 20 bp, synthetic construct
  misc_feature 1..20: note = CRISPR gRNA sequence
  source 1..20: mol_type = other DNA
gaaacatggggaaagcagtt

SEQ ID NO: 4396 - DNA, 20 bp, synthetic construct
  misc_feature 1..20: note = CRISPR gRNA sequence
  source 1..20: mol_type = other DNA
cagggaccttcccctgactc

SEQ ID NO: 4397 - DNA, 20 bp, synthetic construct
  misc_feature 1..20: note = CRISPR gRNA sequence
  source 1..20: mol_type = other DNA
ttcccctgactcatgaatgc

SEQ ID NO: 4398 - DNA, 20 bp, synthetic construct
  misc_feature 1..20: note = CRISPR gRNA sequence
  source 1..20: mol_type = other DNA
ttgtcacatgtgcttcacaa

SEQ ID NO: 4399 - DNA, 20 bp, synthetic construct
  misc_feature 1..20: note = CRISPR gRNA sequence
  source 1..20: mol_type = other DNA
aaagagtaagtgctggcaca

SEQ ID NO: 4400 - DNA, 20 bp, synthetic construct
  misc_feature 1..20: note = CRISPR gRNA sequence
  source 1..20: mol_type = other DNA
tggcacacagggtcccaggc

SEQ ID NO: 4401 - DNA, 20 bp, synthetic construct
  misc_feature 1..20: note = CRISPR gRNA sequence
  source 1..20: mol_type = other DNA
caggctgggatggcccatgt

SEQ ID NO: 4402 - DNA, 20 bp, synthetic construct
  misc_feature 1..20: note = CRISPR gRNA sequence
  source 1..20: mol_type = other DNA
ccagcaacgatgcccatgat

SEQ ID NO: 4403 - DNA, 20 bp, synthetic construct
  misc_feature 1..20: note = CRISPR gRNA sequence
  source 1..20: mol_type = other DNA
ttcccctccttaccccagct

SEQ ID NO: 4404 - DNA, 20 bp, synthetic construct
  misc_feature 1..20: note = CRISPR gRNA sequence
  source 1..20: mol_type = other DNA
gtctccacaagctcggtgtc

SEQ ID NO: 4405 - DNA, 20 bp, synthetic construct
  misc_feature 1..20: note = CRISPR gRNA sequence
  source 1..20: mol_type = other DNA
ccaggtcagtgtgatctccg

SEQ ID NO: 4406 - DNA, 20 bp, synthetic construct
  misc_feature 1..20: note = CRISPR gRNA sequence
  source 1..20: mol_type = other DNA
aagcccagggcccagcacct

SEQ ID NO: 4407 - DNA, 20 bp, synthetic construct
  misc_feature 1..20: note = CRISPR gRNA sequence
  source 1..20: mol_type = other DNA
ggtggcctcatggtcagaga

SEQ ID NO: 4408 - DNA, 20 bp, synthetic construct
  misc_feature 1..20: note = CRISPR gRNA sequence
  source 1..20: mol_type = other DNA
tcatggtcagagagggggtg

SEQ ID NO: 4409 - DNA, 20 bp, synthetic construct
  misc_feature 1..20: note = CRISPR gRNA sequence
  source 1..20: mol_type = other DNA
ggtgggtcacgtgtgtcttt

SEQ ID NO: 4410 - DNA, 20 bp, synthetic construct
  misc_feature 1..20: note = CRISPR gRNA sequence
  source 1..20: mol_type = other DNA
tctttgggggttctgacggg

SEQ ID NO: 4411 - DNA, 20 bp, synthetic construct
  misc_feature 1..20: note = CRISPR gRNA sequence
  source 1..20: mol_type = other DNA
agcgcccatgtgaccatcct

SEQ ID NO: 4412 - DNA, 20 bp, synthetic construct
  misc_feature 1..20: note = CRISPR gRNA sequence
  source 1..20: mol_type = other DNA
ctgagaatggacaggacacc

SEQ ID NO: 4413 - DNA, 20 bp, synthetic construct
  misc_feature 1..20: note = CRISPR gRNA sequence
  source 1..20: mol_type = other DNA
ccagcctggacacaggcacc

SEQ ID NO: 4414 - DNA, 20 bp, synthetic construct
  misc_feature 1..20: note = CRISPR gRNA sequence
  source 1..20: mol_type = other DNA
cagcgacttctggtcctgac

SEQ ID NO: 4415 - DNA, 20 bp, synthetic construct
  misc_feature 1..20: note = CRISPR gRNA sequence
  source 1..20: mol_type = other DNA
gctgcaggactcagaaaagc

SEQ ID NO: 4416 - DNA, 20 bp, synthetic construct
  misc_feature 1..20: note = CRISPR gRNA sequence
  source 1..20: mol_type = other DNA
gaatcaaaccttcagacaca

SEQ ID NO: 4417 - DNA, 20 bp, synthetic construct
  misc_feature 1..20: note = CRISPR gRNA sequence
  source 1..20: mol_type = other DNA
cgggccgcctccaacttgcg

SEQ ID NO: 4418 - DNA, 20 bp, synthetic construct
  misc_feature 1..20: note = CRISPR gRNA sequence
  source 1..20: mol_type = other DNA
tcgcagccatacatcctctg

SEQ ID NO: 4419 - DNA, 20 bp, synthetic construct
  misc_feature 1..20: note = CRISPR gRNA sequence
  source 1..20: mol_type = other DNA
ccccgccccgaccaacccgc

SEQ ID NO: 4420 - DNA, 20 bp, synthetic construct
  misc_feature 1..20: note = CRISPR gRNA sequence
  source 1..20: mol_type = other DNA
ggcctaaaccgaaaatgaaa

SEQ ID NO: 4421 - DNA, 20 bp, synthetic construct
  misc_feature 1..20: note = CRISPR gRNA sequence
  source 1..20: mol_type = other DNA
gactggggctctctccggtc

SEQ ID NO: 4422 - DNA, 20 bp, synthetic construct
  misc_feature 1..20: note = CRISPR gRNA sequence
  source 1..20: mol_type = other DNA
ctctccggtcgagggtctgg

SEQ ID NO: 4423 - DNA, 20 bp, synthetic construct
  misc_feature 1..20: note = CRISPR gRNA sequence
  source 1..20: mol_type = other DNA
cgggttccgcagatccacct

SEQ ID NO: 4424 - DNA, 20 bp, synthetic construct
  misc_feature 1..20: note = CRISPR gRNA sequence
  source 1..20: mol_type = other DNA
ttccgcagatccaccttggg

SEQ ID NO: 4425 - DNA, 20 bp, synthetic construct
  misc_feature 1..20: note = CRISPR gRNA sequence
  source 1..20: mol_type = other DNA
ggcgacccgggccgtccgtg

SEQ ID NO: 4426 - DNA, 20 bp, synthetic construct
  misc_feature 1..20: note = CRISPR gRNA sequence
  source 1..20: mol_type = other DNA
gccgtccgtgggggatgggg

SEQ ID NO: 4427 - DNA, 20 bp, synthetic construct
  misc_feature 1..20: note = CRISPR gRNA sequence
  source 1..20: mol_type = other DNA
tcgtgacctgcgccccgggc

SEQ ID NO: 4428 - DNA, 20 bp, synthetic construct
  misc_feature 1..20: note = CRISPR gRNA sequence
  source 1..20: mol_type = other DNA
ggcggtgtcgaaatacctca

SEQ ID NO: 4429 - DNA, 20 bp, synthetic construct
  misc_feature 1..20: note = CRISPR gRNA sequence
  source 1..20: mol_type = other DNA
ccacctccctgcgcggctcc

SEQ ID NO: 4430 - DNA, 20 bp, synthetic construct
  misc_feature 1..20: note = CRISPR gRNA sequence
  source 1..20: mol_type = other DNA
cccgcatctcggcctctggg

SEQ ID NO: 4431 - DNA, 20 bp, synthetic construct
  misc_feature 1..20: note = CRISPR gRNA sequence
  source 1..20: mol_type = other DNA
tctcggcctctggggagaat

SEQ ID NO: 4432 - DNA, 20 bp, synthetic construct
  misc_feature 1..20: note = CRISPR gRNA sequence
  source 1..20: mol_type = other DNA
cctctggggagaatgtgagt

SEQ ID NO: 4433 - DNA, 20 bp, synthetic construct
  misc_feature 1..20: note = CRISPR gRNA sequence
  source 1..20: mol_type = other DNA
tggggagaatgtgagtccgg

SEQ ID NO: 4434 - DNA, 20 bp, synthetic construct
  misc_feature 1..20: note = CRISPR gRNA sequence
  source 1..20: mol_type = other DNA
ttctccccagaggccgagat

SEQ ID NO: 4435 - DNA, 20 bp, synthetic construct
  misc_feature 1..20: note = CRISPR gRNA sequence
  source 1..20: mol_type = other DNA
cctgaccgagacctgggcct

SEQ ID NO: 4436 - DNA, 20 bp, synthetic construct
  misc_feature 1..20: note = CRISPR gRNA sequence
  source 1..20: mol_type = other DNA
gagacctgggcctgtgagtg

SEQ ID NO: 4437 - DNA, 20 bp, synthetic construct
  misc_feature 1..20: note = CRISPR gRNA sequence
  source 1..20: mol_type = other DNA
ccggggagccgcgcagggag

SEQ ID NO: 4438 - DNA, 20 bp, synthetic construct
  misc_feature 1..20: note = CRISPR gRNA sequence
  source 1..20: mol_type = other DNA
cgcgcagggaggtgggtcgg

SEQ ID NO: 4439 - DNA, 20 bp, synthetic construct
  misc_feature 1..20: note = CRISPR gRNA sequence
  source 1..20: mol_type = other DNA
tgcggttcgacagcgacgcc

SEQ ID NO: 4440 - DNA, 20 bp, synthetic construct
  misc_feature 1..20: note = CRISPR gRNA sequence
  source 1..20: mol_type = other DNA
agaggggagccgcgggcgcc

SEQ ID NO: 4441 - DNA, 20 bp, synthetic construct
  misc_feature 1..20: note = CRISPR gRNA sequence
  source 1..20: mol_type = other DNA
gtgggtggagcaggaggggc

SEQ ID NO: 4442 - DNA, 20 bp, synthetic construct
  misc_feature 1..20: note = CRISPR gRNA sequence
  source 1..20: mol_type = other DNA
aagcgccaggcacaggctga

SEQ ID NO: 4443 - DNA, 20 bp, synthetic construct
  misc_feature 1..20: note = CRISPR gRNA sequence
  source 1..20: mol_type = other DNA
ctacaaccagagcgaggacg

SEQ ID NO: 4444 - DNA, 20 bp, synthetic construct
  misc_feature 1..20: note = CRISPR gRNA sequence
  source 1..20: mol_type = other DNA
ccccatcccccacggacggc

SEQ ID NO: 4445 - DNA, 20 bp, synthetic construct
  misc_feature 1..20: note = CRISPR gRNA sequence
  source 1..20: mol_type = other DNA
cacggacggcccgggtcgcc

SEQ ID NO: 4446 - DNA, 20 bp, synthetic construct
  misc_feature 1..20: note = CRISPR gRNA sequence
  source 1..20: mol_type = other DNA
cgtctgagatccaccccaag

SEQ ID NO: 4447 - DNA, 20 bp, synthetic construct
  misc_feature 1..20: note = CRISPR gRNA sequence
  source 1..20: mol_type = other DNA
cggtttaggccaaaatcccc

SEQ ID NO: 4448 - DNA, 20 bp, synthetic construct
  misc_feature 1..20: note = CRISPR gRNA sequence
  source 1..20: mol_type = other DNA
gctgaccgcgggggcggggc

SEQ ID NO: 4449 - DNA, 20 bp, synthetic construct
  misc_feature 1..20: note = CRISPR gRNA sequence
  source 1..20: mol_type = other DNA
ccagggtctcacaccctcca

SEQ ID NO: 4450 - DNA, 20 bp, synthetic construct
  misc_feature 1..20: note = CRISPR gRNA sequence
  source 1..20: mol_type = other DNA
gcccgacgggcgcctcctcc

SEQ ID NO: 4451 - DNA, 20 bp, synthetic construct
  misc_feature 1..20: note = CRISPR gRNA sequence
  source 1..20: mol_type = other DNA
accagtccgcctacgacggc

SEQ ID NO: 4452 - DNA, 20 bp, synthetic construct
  misc_feature 1..20: note = CRISPR gRNA sequence
  source 1..20: mol_type = other DNA
ctacctggagggcacgtgcg

SEQ ID NO: 4453 - DNA, 20 bp, synthetic construct
  misc_feature 1..20: note = CRISPR gRNA sequence
  source 1..20: mol_type = other DNA
cccatctcctatagatctcc

SEQ ID NO: 4454 - DNA, 20 bp, synthetic construct
  misc_feature 1..20: note = CRISPR gRNA sequence
  source 1..20: mol_type = other DNA
ccacgaggaggggaggaaaa

SEQ ID NO: 4455 - DNA, 20 bp, synthetic construct
  misc_feature 1..20: note = CRISPR gRNA sequence
  source 1..20: mol_type = other DNA
gaggaaaatgggatcagcac

SEQ ID NO: 4456 - DNA, 20 bp, synthetic construct
  misc_feature 1..20: note = CRISPR gRNA sequence
  source 1..20: mol_type = other DNA
cactggaatatcgccctccc

SEQ ID NO: 4457 - DNA, 20 bp, synthetic construct
  misc_feature 1..20: note = CRISPR gRNA sequence
  source 1..20: mol_type = other DNA
atatcgccctcccttgaatg

SEQ ID NO: 4458 - DNA, 20 bp, synthetic construct
  misc_feature 1..20: note = CRISPR gRNA sequence
  source 1..20: mol_type = other DNA
tcccttgaatggagaatggc

SEQ ID NO: 4459 - DNA, 20 bp, synthetic construct
  misc_feature 1..20: note = CRISPR gRNA sequence
  source 1..20: mol_type = other DNA
ggagaatggcatgagttttc

SEQ ID NO: 4460 - DNA, 20 bp, synthetic construct
  misc_feature 1..20: note = CRISPR gRNA sequence
  source 1..20: mol_type = other DNA
tctgctctctaggacaatta

SEQ ID NO: 4461 - DNA, 20 bp, synthetic construct
  misc_feature 1..20: note = CRISPR gRNA sequence
  source 1..20: mol_type = other DNA
atggaggggaagacagtccc

SEQ ID NO: 4462 - DNA, 20 bp, synthetic construct
  misc_feature 1..20: note = CRISPR gRNA sequence
  source 1..20: mol_type = other DNA
cagtccctggaatactgatc

SEQ ID NO: 4463 - DNA, 20 bp, synthetic construct
  misc_feature 1..20: note = CRISPR gRNA sequence
  source 1..20: mol_type = other DNA
aaggtttgattccagctttt

SEQ ID NO: 4464 - DNA, 20 bp, synthetic construct
  misc_feature 1..20: note = CRISPR gRNA sequence
  source 1..20: mol_type = other DNA
tcagagactagaactttcca

SEQ ID NO: 4465 - DNA, 20 bp, synthetic construct
  misc_feature 1..20: note = CRISPR gRNA sequence
  source 1..20: mol_type = other DNA
gcctgtgtccaggctggcgt

SEQ ID NO: 4466 - DNA, 20 bp, synthetic construct
  misc_feature 1..20: note = CRISPR gRNA sequence
  source 1..20: mol_type = other DNA
ccaggtgtcctgtccattct

SEQ ID NO: 4467 - DNA, 20 bp, synthetic construct
  misc_feature 1..20: note = CRISPR gRNA sequence
  source 1..20: mol_type = other DNA
gatggtcacatgggcgctgc

SEQ ID NO: 4468 - DNA, 20 bp, synthetic construct
  misc_feature 1..20: note = CRISPR gRNA sequence
  source 1..20: mol_type = other DNA
ccaagagagatgcaaagtgt

SEQ ID NO: 4469 - DNA, 20 bp, synthetic construct
  misc_feature 1..20: note = CRISPR gRNA sequence
  source 1..20: mol_type = other DNA
agatcacactgacctggcag

SEQ ID NO: 4470 - DNA, 20 bp, synthetic construct
  misc_feature 1..20: note = CRISPR gRNA sequence
  source 1..20: mol_type = other DNA
aagagcccctcaccctgagc

SEQ ID NO: 4471 - DNA, 20 bp, synthetic construct
  misc_feature 1..20: note = CRISPR gRNA sequence
  source 1..20: mol_type = other DNA
ccctgagctggggtaaggag

SEQ ID NO: 4472 - DNA, 20 bp, synthetic construct
  misc_feature 1..20: note = CRISPR gRNA sequence
  source 1..20: mol_type = other DNA
ctggggtaaggaggggaatg

SEQ ID NO: 4473 - DNA, 20 bp, synthetic construct
  misc_feature 1..20: note = CRISPR gRNA sequence
  source 1..20: mol_type = other DNA
gtccttctggagcccttcag

SEQ ID NO: 4474 - DNA, 20 bp, synthetic construct
  misc_feature 1..20: note = CRISPR gRNA sequence
  source 1..20: mol_type = other DNA
ccgggtcagggctgaggctt

SEQ ID NO: 4475 - DNA, 20 bp, synthetic construct
  misc_feature 1..20: note = CRISPR gRNA sequence
  source 1..20: mol_type = other DNA
aggaagagctcaggtaggga

SEQ ID NO: 4476 - DNA, 20 bp, synthetic construct
  misc_feature 1..20: note = CRISPR gRNA sequence
  source 1..20: mol_type = other DNA
ggtagggaaggggtgaagag

SEQ ID NO: 4477 - DNA, 20 bp, synthetic construct
  misc_feature 1..20: note = CRISPR gRNA sequence
  source 1..20: mol_type = other DNA
gaaggggtgaagagcggggt

SEQ ID NO: 4478 - DNA, 20 bp, synthetic construct
  misc_feature 1..20: note = CRISPR gRNA sequence
  source 1..20: mol_type = other DNA
ctgggttttcttgtcccact

SEQ ID NO: 4479 - DNA, 20 bp, synthetic construct
  misc_feature 1..20: note = CRISPR gRNA sequence
  source 1..20: mol_type = other DNA
agcacatgtgacaatgaagg

SEQ ID NO: 4480 - DNA, 20 bp, synthetic construct
  misc_feature 1..20: note = CRISPR gRNA sequence
  source 1..20: mol_type = other DNA
caccttgatgattatggtgt

SEQ ID NO: 4481 - DNA, 20 bp, synthetic construct
  misc_feature 1..20: note = CRISPR gRNA sequence
  source 1..20: mol_type = other DNA
gggtcctgattccagcattc

SEQ ID NO: 4482 - DNA, 20 bp, synthetic construct
  misc_feature 1..20: note = CRISPR gRNA sequence
  source 1..20: mol_type = other DNA
ccatgtttcctgatcctgcc

SEQ ID NO: 4483 - DNA, 20 bp, synthetic construct
  misc_feature 1..20: note = CRISPR gRNA sequence
  source 1..20: mol_type = other DNA
cgtagttctggaaacttctc

SEQ ID NO: 4484 - DNA, 20 bp, synthetic construct
  misc_feature 1..20: note = CRISPR gRNA sequence
  source 1..20: mol_type = other DNA
caacagtgcccagggctctg

SEQ ID NO: 4485 - DNA, 20 bp, synthetic construct
  misc_feature 1..20: note = CRISPR gRNA sequence
  source 1..20: mol_type = other DNA
tctggggagctgaagtggtc

SEQ ID NO: 4486 - DNA, 20 bp, synthetic construct
  misc_feature 1..20: note = CRISPR gRNA sequence
  source 1..20: mol_type = other DNA
gtggggcagagggaaaaggc

SEQ ID NO: 4487 - DNA, 20 bp, synthetic construct
  misc_feature 1..20: note = CRISPR gRNA sequence
  source 1..20: mol_type = other DNA
agggaaaaggcctgggtaat

SEQ ID NO: 4488 - DNA, 20 bp, synthetic construct
  misc_feature 1..20: note = CRISPR gRNA sequence
  source 1..20: mol_type = other DNA
gattctttgattgggacgtt

SEQ ID NO: 4489 - DNA, 20 bp, synthetic construct
  misc_feature 1..20: note = CRISPR gRNA sequence
  source 1..20: mol_type = other DNA
ctcctagtcttggacccaag

SEQ ID NO: 4490 - DNA, 20 bp, synthetic construct
  misc_feature 1..20: note = CRISPR gRNA sequence
  source 1..20: mol_type = other DNA
catccgtccttcattgtcac

SEQ ID NO: 4491 - DNA, 20 bp, synthetic construct
  misc_feature 1..20: note = CRISPR gRNA sequence
  source 1..20: mol_type = other DNA
tgggatggcccatgtgtgga

SEQ ID NO: 4492 - DNA, 20 bp, synthetic construct
  misc_feature 1..20: note = CRISPR gRNA sequence
  source 1..20: mol_type = other DNA
aggcggggcacacttctacc

SEQ ID NO: 4493 - DNA, 20 bp, synthetic construct
  misc_feature 1..20: note = CRISPR gRNA sequence
  source 1..20: mol_type = other DNA
ctgaagggctccagaaggac

SEQ ID NO: 4494 - DNA, 20 bp, synthetic construct
  misc_feature 1..20: note = CRISPR gRNA sequence
  source 1..20: mol_type = other DNA
gccccgccccgaccaacccg

SEQ ID NO: 4495 - DNA, 20 bp, synthetic construct
  misc_feature 1..20: note = CRISPR gRNA sequence
  source 1..20: mol_type = other DNA
tcactcggtcagcctgtgcc

SEQ ID NO: 4496 - DNA, 20 bp, synthetic construct
  misc_feature 1..20: note = CRISPR gRNA sequence
  source 1..20: mol_type = other DNA
ccctcgctcctctccgcaga

SEQ ID NO: 4497 - DNA, 20 bp, synthetic construct
  misc_feature 1..20: note = CRISPR gRNA sequence
  source 1..20: mol_type = other DNA
tagaaccgggactgcggaga

SEQ ID NO: 4498 - DNA, 20 bp, synthetic construct
  misc_feature 1..20: note = CRISPR gRNA sequence
  source 1..20: mol_type = other DNA
ccgggactgcggagacgctg

SEQ ID NO: 4499 - DNA, 20 bp, synthetic construct
  misc_feature 1..20: note = CRISPR gRNA sequence
  source 1..20: mol_type = other DNA
cccggcccggccgcggagag

SEQ ID NO: 4500 - DNA, 20 bp, synthetic construct
  misc_feature 1..20: note = CRISPR gRNA sequence
  source 1..20: mol_type = other DNA
gagagccccagtcgccttta

SEQ ID NO: 4501 - DNA, 20 bp, synthetic construct
  misc_feature 1..20: note = CRISPR gRNA sequence
  source 1..20: mol_type = other DNA
cgcctttacccggtttcatt

SEQ ID NO: 4502 - DNA, 20 bp, synthetic construct
  misc_feature 1..20: note = CRISPR gRNA sequence
  source 1..20: mol_type = other DNA
gaccagtccgcctacgacgg

SEQ ID NO: 4503 - DNA, 20 bp, synthetic construct
  misc_feature 1..20: note = CRISPR gRNA sequence
  source 1..20: mol_type = other DNA
tcccttgaatggagaatggc

SEQ ID NO: 4504 - DNA, 20 bp, synthetic construct
  misc_feature 1..20: note = CRISPR gRNA sequence
  source 1..20: mol_type = other DNA
ggagaatggcatgagttttc

SEQ ID NO: 4505 - DNA, 20 bp, synthetic construct
  misc_feature 1..20: note = CRISPR gRNA sequence
  source 1..20: mol_type = other DNA
gcctcacactcaatgtgtct

SEQ ID NO: 4506 - DNA, 20 bp, synthetic construct
  misc_feature 1..20: note = CRISPR gRNA sequence
  source 1..20: mol_type = other DNA
cacactcaatgtgtctgaag

SEQ ID NO: 4507 - DNA, 20 bp, synthetic construct
  misc_feature 1..20: note = CRISPR gRNA sequence
  source 1..20: mol_type = other DNA
aatgtgtctgaaggtttgat

SEQ ID NO: 4508 - DNA, 20 bp, synthetic construct
  misc_feature 1..20: note = CRISPR gRNA sequence
  source 1..20: mol_type = other DNA
actagaactttccaatgaat

SEQ ID NO: 4509 - DNA, 20 bp, synthetic construct
  misc_feature 1..20: note = CRISPR gRNA sequence
  source 1..20: mol_type = other DNA
ccaccctgaggtgctgggcc

SEQ ID NO: 4510 - DNA, 20 bp, synthetic construct
  misc_feature 1..20: note = CRISPR gRNA sequence
  source 1..20: mol_type = other DNA
ggaggaccagacccaggaca

SEQ ID NO: 4511 - DNA, 20 bp, synthetic construct
  misc_feature 1..20: note = CRISPR gRNA sequence
  source 1..20: mol_type = other DNA
cccttcagccgggtcagggc

SEQ ID NO: 4512 - DNA, 20 bp, synthetic construct
  misc_feature 1..20: note = CRISPR gRNA sequence
  source 1..20: mol_type = other DNA
gaaggggtgaagagcggggt

SEQ ID NO: 4513 - DNA, 20 bp, synthetic construct
  misc_feature 1..20: note = CRISPR gRNA sequence
  source 1..20: mol_type = other DNA
ctgggttttcttgtcccact

SEQ ID NO: 4514 - DNA, 20 bp, synthetic construct
  misc_feature 1..20: note = CRISPR gRNA sequence
  source 1..20: mol_type = other DNA
gaaggacggatgtatcacct

SEQ ID NO: 4515 - DNA, 20 bp, synthetic construct
  misc_feature 1..20: note = CRISPR gRNA sequence
  source 1..20: mol_type = other DNA
tgatgattatggtgttgggg

SEQ ID NO: 4516 - DNA, 20 bp, synthetic construct
  misc_feature 1..20: note = CRISPR gRNA sequence
  source 1..20: mol_type = other DNA
gcagttggtccagaacccac

SEQ ID NO: 4517 - DNA, 20 bp, synthetic construct
  misc_feature 1..20: note = CRISPR gRNA sequence
  source 1..20: mol_type = other DNA
agaacccacaactgctttcc

SEQ ID NO: 4518 - DNA, 20 bp, synthetic construct
  misc_feature 1..20: note = CRISPR gRNA sequence
  source 1..20: mol_type = other DNA
gtctctcatcacttgtaaag

SEQ ID NO: 4519 - DNA, 20 bp, synthetic construct
  misc_feature 1..20: note = CRISPR gRNA sequence
  source 1..20: mol_type = other DNA
gagggaaaaggcctgggtaa

SEQ ID NO: 4520 - DNA, 20 bp, synthetic construct
  misc_feature 1..20: note = CRISPR gRNA sequence
  source 1..20: mol_type = other DNA
aggcctgggtaatggggatt

SEQ ID NO: 4521 - DNA, 20 bp, synthetic construct
  misc_feature 1..20: note = CRISPR gRNA sequence
  source 1..20: mol_type = other DNA
taatggggattctttgattg

SEQ ID NO: 4522 - DNA, 20 bp, synthetic construct
  misc_feature 1..20: note = CRISPR gRNA sequence
  source 1..20: mol_type = other DNA
acactcgaaacgtcccaatc

SEQ ID NO: 4523 - DNA, 20 bp, synthetic construct
  misc_feature 1..20: note = CRISPR gRNA sequence
  source 1..20: mol_type = other DNA
cccccgaccacttcagctcc

SEQ ID NO: 4524 - DNA, 20 bp, synthetic construct
  misc_feature 1..20: note = CRISPR gRNA sequence
  source 1..20: mol_type = other DNA
ccctccttttccacctgtgg

SEQ ID NO: 4525 - DNA, 20 bp, synthetic construct
  misc_feature 1..20: note = CRISPR gRNA sequence
  source 1..20: mol_type = other DNA
gcttgaaactcccagtggga

SEQ ID NO: 4526 - DNA, 20 bp, synthetic construct
  misc_feature 1..20: note = CRISPR gRNA sequence
  source 1..20: mol_type = other DNA
gggggttctgacgggaagag

SEQ ID NO: 4527 - DNA, 20 bp, synthetic construct
  misc_feature 1..20: note = CRISPR gRNA sequence
  source 1..20: mol_type = other DNA
cagcgcccatgtgaccatcc

SEQ ID NO: 4528 - DNA, 20 bp, synthetic construct
  misc_feature 1..20: note = CRISPR gRNA sequence
  source 1..20: mol_type = other DNA
ctgagtggaggctgcaggac

SEQ ID NO: 4529 - DNA, 20 bp, synthetic construct
  misc_feature 1..20: note = CRISPR gRNA sequence
  source 1..20: mol_type = other DNA
gaggcagagaacaaggcctg

SEQ ID NO: 4530 - DNA, 20 bp, synthetic construct
  misc_feature 1..20: note = CRISPR gRNA sequence
  source 1..20: mol_type = other DNA
acccgcatctcggcctctgg

SEQ ID NO: 4531 - DNA, 20 bp, synthetic construct
  misc_feature 1..20: note = CRISPR gRNA sequence
  source 1..20: mol_type = other DNA
aatatcgccctcccttgaat

SEQ ID NO: 4532 - DNA, 20 bp, synthetic construct
  misc_feature 1..20: note = CRISPR gRNA sequence
  source 1..20: mol_type = other DNA
ggggggtcacatctcttatc

SEQ ID NO: 4533 - DNA, 20 bp, synthetic construct
  misc_feature 1..20: note = CRISPR gRNA sequence
  source 1..20: mol_type = other DNA
tgaaactcccagtgggacaa

SEQ ID NO: 4534 - DNA, 20 bp, synthetic construct
  misc_feature 1..20: note = CRISPR gRNA sequence
  source 1..20: mol_type = other DNA
ggccctcagaggaaactcag

SEQ ID NO: 4535 - DNA, 20 bp, synthetic construct
  misc_feature 1..20: note = CRISPR gRNA sequence
  source 1..20: mol_type = other DNA
gaaacgtcccaatcaaagaa

SEQ ID NO: 4536 - DNA, 20 bp, synthetic construct
  misc_feature 1..20: note = CRISPR gRNA sequence
  source 1..20: mol_type = other DNA
cccaggccttttccctctgc

SEQ ID NO: 4537 - DNA, 20 bp, synthetic construct
  misc_feature 1..20: note = CRISPR gRNA sequence
  source 1..20: mol_type = other DNA
ttccctctgccccacccccg

SEQ ID NO: 4538 - DNA, 20 bp, synthetic construct
  misc_feature 1..20: note = CRISPR gRNA sequence
  source 1..20: mol_type = other DNA
tccctctgccccacccccga

SEQ ID NO: 4539 - DNA, 20 bp, synthetic construct
  misc_feature 1..20: note = CRISPR gRNA sequence
  source 1..20: mol_type = other DNA
ccctctgccccacccccgac

SEQ ID NO: 4540 - DNA, 20 bp, synthetic construct
  misc_feature 1..20: note = CRISPR gRNA sequence
  source 1..20: mol_type = other DNA
cctctgccccacccccgacc

SEQ ID NO: 4541 - DNA, 20 bp, synthetic construct
  misc_feature 1..20: note = CRISPR gRNA sequence
  source 1..20: mol_type = other DNA
tgccccacccccgaccactt

SEQ ID NO: 4542 - DNA, 20 bp, synthetic construct
  misc_feature 1..20: note = CRISPR gRNA sequence
  source 1..20: mol_type = other DNA
ccccacccccgaccacttca

SEQ ID NO: 4543 - DNA, 20 bp, synthetic construct
  misc_feature 1..20: note = CRISPR gRNA sequence
  source 1..20: mol_type = other DNA
cagctccccagaatctcacc

SEQ ID NO: 4544 - DNA, 20 bp, synthetic construct
  misc_feature 1..20: note = CRISPR gRNA sequence
  source 1..20: mol_type = other DNA
agctccccagaatctcacct

SEQ ID NO: 4545 - DNA, 20 bp, synthetic construct
  misc_feature 1..20: note = CRISPR gRNA sequence
  source 1..20: mol_type = other DNA
cccagaatctcacctttaca

SEQ ID NO: 4546 - DNA, 20 bp, synthetic construct
  misc_feature 1..20: note = CRISPR gRNA sequence
  source 1..20: mol_type = other DNA
acctttacaagtgatgagag

SEQ ID NO: 4547 - DNA, 20 bp, synthetic construct
  misc_feature 1..20: note = CRISPR gRNA sequence
  source 1..20: mol_type = other DNA
tacaagtgatgagagactca

SEQ ID NO: 4548 - DNA, 20 bp, synthetic construct
  misc_feature 1..20: note = CRISPR gRNA sequence
  source 1..20: mol_type = other DNA
acaagtgatgagagactcat

SEQ ID NO: 4549 - DNA, 20 bp, synthetic construct
  misc_feature 1..20: note = CRISPR gRNA sequence
  source 1..20: mol_type = other DNA
caagtgatgagagactcatc

SEQ ID NO: 4550 - DNA, 20 bp, synthetic construct
  misc_feature 1..20: note = CRISPR gRNA sequence
  source 1..20: mol_type = other DNA
atcagagccctgggcactgt

SEQ ID NO: 4551 - DNA, 20 bp, synthetic construct
  misc_feature 1..20: note = CRISPR gRNA sequence
  source 1..20: mol_type = other DNA
ggcactgttgctgcctgggg

SEQ ID NO: 4552 - DNA, 20 bp, synthetic construct
  misc_feature 1..20: note = CRISPR gRNA sequence
  source 1..20: mol_type = other DNA
ttgctgcctggggtagaaca

SEQ ID NO: 4553 - DNA, 20 bp, synthetic construct
  misc_feature 1..20: note = CRISPR gRNA sequence
  source 1..20: mol_type = other DNA
ctgcctggggtagaacaaaa

SEQ ID NO: 4554 - DNA, 20 bp, synthetic construct
  misc_feature 1..20: note = CRISPR gRNA sequence
  source 1..20: mol_type = other DNA
cctggggtagaacaaaaaaa

SEQ ID NO: 4555 - DNA, 20 bp, synthetic construct
  misc_feature 1..20: note = CRISPR gRNA sequence
  source 1..20: mol_type = other DNA
gggtagaacaaaaaaaaaga

SEQ ID NO: 4556 - DNA, 20 bp, synthetic construct
  misc_feature 1..20: note = CRISPR gRNA sequence
  source 1..20: mol_type = other DNA
gtcagagcccgcaggagatg

SEQ ID NO: 4557 - DNA, 20 bp, synthetic construct
  misc_feature 1..20: note = CRISPR gRNA sequence
  source 1..20: mol_type = other DNA
tggagtaggtgagctcctcc

SEQ ID NO: 4558 - DNA, 20 bp, synthetic construct
  misc_feature 1..20: note = CRISPR gRNA sequence
  source 1..20: mol_type = other DNA
ctccacacgcccgccgccat

SEQ ID NO: 4559 - DNA, 20 bp, synthetic construct
  misc_feature 1..20: note = CRISPR gRNA sequence
  source 1..20: mol_type = other DNA
cacacgcccgccgccatcac

SEQ ID NO: 4560 - DNA, 20 bp, synthetic construct
  misc_feature 1..20: note = CRISPR gRNA sequence
  source 1..20: mol_type = other DNA
acacgcagcctgagagcagc

SEQ ID NO: 4561 - DNA, 20 bp, synthetic construct
  misc_feature 1..20: note = CRISPR gRNA sequence
  source 1..20: mol_type = other DNA
cacgcagcctgagagcagct

SEQ ID NO: 4562 - DNA, 20 bp, synthetic construct
  misc_feature 1..20: note = CRISPR gRNA sequence
  source 1..20: mol_type = other DNA
agagcagctccctccttttc

SEQ ID NO: 4563 - DNA, 20 bp, synthetic construct
  misc_feature 1..20: note = CRISPR gRNA sequence
  source 1..20: mol_type = other DNA
cctccttttccacctgtggg

SEQ ID NO: 4564 - DNA, 20 bp, synthetic construct
  misc_feature 1..20: note = CRISPR gRNA sequence
  source 1..20: mol_type = other DNA
cttttccacctgtgggaaga

SEQ ID NO: 4565 - DNA, 20 bp, synthetic construct
  misc_feature 1..20: note = CRISPR gRNA sequence
  source 1..20: mol_type = other DNA
ttccacctgtgggaagaaaa

SEQ ID NO: 4566 - DNA, 20 bp, synthetic construct
  misc_feature 1..20: note = CRISPR gRNA sequence
  source 1..20: mol_type = other DNA
tccacctgtgggaagaaaat

SEQ ID NO: 4567 - DNA, 20 bp, synthetic construct
  misc_feature 1..20: note = CRISPR gRNA sequence
  source 1..20: mol_type = other DNA
ccacctgtgggaagaaaatg

SEQ ID NO: 4568 - DNA, 20 bp, synthetic construct
  misc_feature 1..20: note = CRISPR gRNA sequence
  source 1..20: mol_type = other DNA
cacctgtgggaagaaaatgc

SEQ ID NO: 4569 - DNA, 20 bp, synthetic construct
  misc_feature 1..20: note = CRISPR gRNA sequence
  source 1..20: mol_type = other DNA
tgggaagaaaatgccctatg

SEQ ID NO: 4570 - DNA, 20 bp, synthetic construct
  misc_feature 1..20: note = CRISPR gRNA sequence
  source 1..20: mol_type = other DNA
tgaggggactgggaggaggc

SEQ ID NO: 4571 - DNA, 20 bp, synthetic construct
  misc_feature 1..20: note = CRISPR gRNA sequence
  source 1..20: mol_type = other DNA
ggaggaggcagggccatgtg

SEQ ID NO: 4572 - DNA, 20 bp, synthetic construct
  misc_feature 1..20: note = CRISPR gRNA sequence
  source 1..20: mol_type = other DNA
aggggaacctcctagtcttg

SEQ ID NO: 4573 - DNA, 20 bp, synthetic construct
  misc_feature 1..20: note = CRISPR gRNA sequence
  source 1..20: mol_type = other DNA
ggggaacctcctagtcttgg

SEQ ID NO: 4574 - DNA, 20 bp, synthetic construct
  misc_feature 1..20: note = CRISPR gRNA sequence
  source 1..20: mol_type = other DNA
ctagtcttggacccaagaga

SEQ ID NO: 4575 - DNA, 20 bp, synthetic construct
  misc_feature 1..20: note = CRISPR gRNA sequence
  source 1..20: mol_type = other DNA
gtcttggacccaagagaagt

SEQ ID NO: 4576 - DNA, 20 bp, synthetic construct
  misc_feature 1..20: note = CRISPR gRNA sequence
  source 1..20: mol_type = other DNA
ggacccaagagaagtttcca

SEQ ID NO: 4577 - DNA, 20 bp, synthetic construct
  misc_feature 1..20: note = CRISPR gRNA sequence
  source 1..20: mol_type = other DNA
gacccaagagaagtttccag

SEQ ID NO: 4578 - DNA, 20 bp, synthetic construct
  misc_feature 1..20: note = CRISPR gRNA sequence
  source 1..20: mol_type = other DNA
ccagaactacgactgcagac

SEQ ID NO: 4579 - DNA, 20 bp, synthetic construct
  misc_feature 1..20: note = CRISPR gRNA sequence
  source 1..20: mol_type = other DNA
cagaactacgactgcagacc

SEQ ID NO: 4580 - DNA, 20 bp, synthetic construct
  misc_feature 1..20: note = CRISPR gRNA sequence
  source 1..20: mol_type = other DNA
cgactgcagacccagggcag

SEQ ID NO: 4581 - DNA, 20 bp, synthetic construct
  misc_feature 1..20: note = CRISPR gRNA sequence
  source 1..20: mol_type = other DNA
cagacccagggcaggatcag

SEQ ID NO: 4582 - DNA, 20 bp, synthetic construct
  misc_feature 1..20: note = CRISPR gRNA sequence
  source 1..20: mol_type = other DNA
tgggttctggaccaactgcc

SEQ ID NO: 4583 - DNA, 20 bp, synthetic construct
  misc_feature 1..20: note = CRISPR gRNA sequence
  source 1..20: mol_type = other DNA
tggaccaactgccctcctaa

SEQ ID NO: 4584 - DNA, 20 bp, synthetic construct
  misc_feature 1..20: note = CRISPR gRNA sequence
  source 1..20: mol_type = other DNA
gaccaactgccctcctaagg

SEQ ID NO: 4585 - DNA, 20 bp, synthetic construct
  misc_feature 1..20: note = CRISPR gRNA sequence
  source 1..20: mol_type = other DNA
ccctcctaaggtctgtcctt

SEQ ID NO: 4586 - DNA, 20 bp, synthetic construct
  misc_feature 1..20: note = CRISPR gRNA sequence
  source 1..20: mol_type = other DNA
ctaaggtctgtccttagcag

SEQ ID NO: 4587 - DNA, 20 bp, synthetic construct
  misc_feature 1..20: note = CRISPR gRNA sequence
  source 1..20: mol_type = other DNA
aggtctgtccttagcaggga

SEQ ID NO: 4588 - DNA, 20 bp, synthetic construct
  misc_feature 1..20: note = CRISPR gRNA sequence
  source 1..20: mol_type = other DNA
tccttagcagggaccttccc

SEQ ID NO: 4589 - DNA, 20 bp, synthetic construct
  misc_feature 1..20: note = CRISPR gRNA sequence
  source 1..20: mol_type = other DNA
agcagggaccttcccctgac

SEQ ID NO: 4590 - DNA, 20 bp, synthetic construct
  misc_feature 1..20: note = CRISPR gRNA sequence
  source 1..20: mol_type = other DNA
gcagggaccttcccctgact

SEQ ID NO: 4591 - DNA, 20 bp, synthetic construct
  misc_feature 1..20: note = CRISPR gRNA sequence
  source 1..20: mol_type = other DNA
cccctgactcatgaatgctg

SEQ ID NO: 4592 - DNA, 20 bp, synthetic construct
  misc_feature 1..20: note = CRISPR gRNA sequence
  source 1..20: mol_type = other DNA
ccctgactcatgaatgctgg

SEQ ID NO: 4593 - DNA, 20 bp, synthetic construct
  misc_feature 1..20: note = CRISPR gRNA sequence
  source 1..20: mol_type = other DNA
actcatgaatgctggaatca

SEQ ID NO: 4594 - DNA, 20 bp, synthetic construct
  misc_feature 1..20: note = CRISPR gRNA sequence
  source 1..20: mol_type = other DNA
atgaatgctggaatcaggac

SEQ ID NO: 4595 - DNA, 20 bp, synthetic construct
  misc_feature 1..20: note = CRISPR gRNA sequence
  source 1..20: mol_type = other DNA
gaatcaggaccccaacacca

SEQ ID NO: 4596 - DNA, 20 bp, synthetic construct
  misc_feature 1..20: note = CRISPR gRNA sequence
  source 1..20: mol_type = other DNA
cattgtcacatgtgcttcac

SEQ ID NO: 4597 - DNA, 20 bp, synthetic construct
  misc_feature 1..20: note = CRISPR gRNA sequence
  source 1..20: mol_type = other DNA
attgtcacatgtgcttcaca

SEQ ID NO: 4598 - DNA, 20 bp, synthetic construct
  misc_feature 1..20: note = CRISPR gRNA sequence
  source 1..20: mol_type = other DNA
tcacatgtgcttcacaaaag

SEQ ID NO: 4599 - DNA, 20 bp, synthetic construct
  misc_feature 1..20: note = CRISPR gRNA sequence
  source 1..20: mol_type = other DNA
cacaaaagagtaagtgctgg

SEQ ID NO: 4600 - DNA, 20 bp, synthetic construct
  misc_feature 1..20: note = CRISPR gRNA sequence
  source 1..20: mol_type = other DNA
acaaaagagtaagtgctggc

SEQ ID NO: 4601 - DNA, 20 bp, synthetic construct
  misc_feature 1..20: note = CRISPR gRNA sequence
  source 1..20: mol_type = other DNA
gcacacagggtcccaggctg

SEQ ID NO: 4602 - DNA, 20 bp, synthetic construct
  misc_feature 1..20: note = CRISPR gRNA sequence
  source 1..20: mol_type = other DNA
ggatggcccatgtgtggatg

SEQ ID NO: 4603 - DNA, 20 bp, synthetic construct
  misc_feature 1..20: note = CRISPR gRNA sequence
  source 1..20: mol_type = other DNA
ccagtaacaaggcggggcac

SEQ ID NO: 4604 - DNA, 20 bp, synthetic construct
  misc_feature 1..20: note = CRISPR gRNA sequence
  source 1..20: mol_type = other DNA
cagtaacaaggcggggcaca

SEQ ID NO: 4605 - DNA, 20 bp, synthetic construct
  misc_feature 1..20: note = CRISPR gRNA sequence
  source 1..20: mol_type = other DNA
ctacctggggcttgaaactc

SEQ ID NO: 4606 - DNA, 20 bp, synthetic construct
  misc_feature 1..20: note = CRISPR gRNA sequence
  source 1..20: mol_type = other DNA
tacctggggcttgaaactcc

SEQ ID NO: 4607 - DNA, 20 bp, synthetic construct
  misc_feature 1..20: note = CRISPR gRNA sequence
  source 1..20: mol_type = other DNA
cctggggcttgaaactccca

SEQ ID NO: 4608 - DNA, 20 bp, synthetic construct
  misc_feature 1..20: note = CRISPR gRNA sequence
  source 1..20: mol_type = other DNA
gggcttgaaactcccagtgg

SEQ ID NO: 4609 - DNA, 20 bp, synthetic construct
  misc_feature 1..20: note = CRISPR gRNA sequence
  source 1..20: mol_type = other DNA
gaaactcccagtgggacaag

SEQ ID NO: 4610 - DNA, 20 bp, synthetic construct
  misc_feature 1..20: note = CRISPR gRNA sequence
  source 1..20: mol_type = other DNA
aaactcccagtgggacaaga

SEQ ID NO: 4611 - DNA, 20 bp, synthetic construct
  misc_feature 1..20: note = CRISPR gRNA sequence
  source 1..20: mol_type = other DNA
ccagtgggacaagaaaaccc

SEQ ID NO: 4612 - DNA, 20 bp, synthetic construct
  misc_feature 1..20: note = CRISPR gRNA sequence
  source 1..20: mol_type = other DNA
ttcaccccttccctacctga

SEQ ID NO: 4613 - DNA, 20 bp, synthetic construct
  misc_feature 1..20: note = CRISPR gRNA sequence
  source 1..20: mol_type = other DNA
caccccttccctacctgagc

SEQ ID NO: 4614 - DNA, 20 bp, synthetic construct
  misc_feature 1..20: note = CRISPR gRNA sequence
  source 1..20: mol_type = other DNA
accccttccctacctgagct

SEQ ID NO: 4615 - DNA, 20 bp, synthetic construct
  misc_feature 1..20: note = CRISPR gRNA sequence
  source 1..20: mol_type = other DNA
ccctacctgagctcttcctc

SEQ ID NO: 4616 - DNA, 20 bp, synthetic construct
  misc_feature 1..20: note = CRISPR gRNA sequence
  source 1..20: mol_type = other DNA
cctacctgagctcttcctcc

SEQ ID NO: 4617 - DNA, 20 bp, synthetic construct
  misc_feature 1..20: note = CRISPR gRNA sequence
  source 1..20: mol_type = other DNA
cctgagctcttcctcctaca

SEQ ID NO: 4618 - DNA, 20 bp, synthetic construct
  misc_feature 1..20: note = CRISPR gRNA sequence
  source 1..20: mol_type = other DNA
agctcttcctcctacacatc

SEQ ID NO: 4619 - DNA, 20 bp, synthetic construct
  misc_feature 1..20: note = CRISPR gRNA sequence
  source 1..20: mol_type = other DNA
ttcctcctacacatcatagc

SEQ ID NO: 4620 - DNA, 20 bp, synthetic construct
  misc_feature 1..20: note = CRISPR gRNA sequence
  source 1..20: mol_type = other DNA
cctcctacacatcatagcgg

SEQ ID NO: 4621 - DNA, 20 bp, synthetic construct
  misc_feature 1..20: note = CRISPR gRNA sequence
  source 1..20: mol_type = other DNA
ctcctacacatcatagcggt

SEQ ID NO: 4622 - DNA, 20 bp, synthetic construct
  misc_feature 1..20: note = CRISPR gRNA sequence
  source 1..20: mol_type = other DNA
ctacacatcatagcggtgac

SEQ ID NO: 4623 - DNA, 20 bp, synthetic construct
  misc_feature 1..20: note = CRISPR gRNA sequence
  source 1..20: mol_type = other DNA
cacatcatagcggtgaccac

SEQ ID NO: 4624 - DNA, 20 bp, synthetic construct
  misc_feature 1..20: note = CRISPR gRNA sequence
  source 1..20: mol_type = other DNA
caaggacagctaggacaacc

SEQ ID NO: 4625 - DNA, 20 bp, synthetic construct
  misc_feature 1..20: note = CRISPR gRNA sequence
  source 1..20: mol_type = other DNA
ggacaaccaggacagccagg

SEQ ID NO: 4626 - DNA, 20 bp, synthetic construct
  misc_feature 1..20: note = CRISPR gRNA sequence
  source 1..20: mol_type = other DNA
ggaagatggctctgggaaag

SEQ ID NO: 4627 - DNA, 20 bp, synthetic construct
  misc_feature 1..20: note = CRISPR gRNA sequence
  source 1..20: mol_type = other DNA
tgggaaaggaggagaaggtg

SEQ ID NO: 4628 - DNA, 20 bp, synthetic construct
  misc_feature 1..20: note = CRISPR gRNA sequence
  source 1..20: mol_type = other DNA
ggaaaggaggagaaggtgag

SEQ ID NO: 4629 - DNA, 20 bp, synthetic construct
  misc_feature 1..20: note = CRISPR gRNA sequence
  source 1..20: mol_type = other DNA
acccccaagcctcagccctg

SEQ ID NO: 4630 - DNA, 20 bp, synthetic construct
  misc_feature 1..20: note = CRISPR gRNA sequence
  source 1..20: mol_type = other DNA
agccctgacccggctgaagg

SEQ ID NO: 4631 - DNA, 20 bp, synthetic construct
  misc_feature 1..20: note = CRISPR gRNA sequence
  source 1..20: mol_type = other DNA
acccggctgaagggctccag

SEQ ID NO: 4632 - DNA, 20 bp, synthetic construct
  misc_feature 1..20: note = CRISPR gRNA sequence
  source 1..20: mol_type = other DNA
aagggctccagaaggacttc

SEQ ID NO: 4633 - DNA, 20 bp, synthetic construct
  misc_feature 1..20: note = CRISPR gRNA sequence
  source 1..20: mol_type = other DNA
cagaaggacttctgctttct

SEQ ID NO: 4634 - DNA, 20 bp, synthetic construct
  misc_feature 1..20: note = CRISPR gRNA sequence
  source 1..20: mol_type = other DNA
ctgctttctctgataagaga

SEQ ID NO: 4635 - DNA, 20 bp, synthetic construct
  misc_feature 1..20: note = CRISPR gRNA sequence
  source 1..20: mol_type = other DNA
tgctttctctgataagagat

SEQ ID NO: 4636 - DNA, 20 bp, synthetic construct
  misc_feature 1..20: note = CRISPR gRNA sequence
  source 1..20: mol_type = other DNA
ctttctctgataagagatgt

SEQ ID NO: 4637 - DNA, 20 bp, synthetic construct
  misc_feature 1..20: note = CRISPR gRNA sequence
  source 1..20: mol_type = other DNA
tctctgataagagatgtgac

SEQ ID NO: 4638 - DNA, 20 bp, synthetic construct
  misc_feature 1..20: note = CRISPR gRNA sequence
  source 1..20: mol_type = other DNA
ctctgataagagatgtgacc

SEQ ID NO: 4639 - DNA, 20 bp, synthetic construct
  misc_feature 1..20: note = CRISPR gRNA sequence
  source 1..20: mol_type = other DNA
tctgataagagatgtgaccc

SEQ ID NO: 4640 - DNA, 20 bp, synthetic construct
  misc_feature 1..20: note = CRISPR gRNA sequence
  source 1..20: mol_type = other DNA
tgataagagatgtgaccccc

SEQ ID NO: 4641 - DNA, 20 bp, synthetic construct
  misc_feature 1..20: note = CRISPR gRNA sequence
  source 1..20: mol_type = other DNA
ataagagatgtgacccccca

SEQ ID NO: 4642 - DNA, 20 bp, synthetic construct
  misc_feature 1..20: note = CRISPR gRNA sequence
  source 1..20: mol_type = other DNA
ccctccttaccccagctcag

SEQ ID NO: 4643 - DNA, 20 bp, synthetic construct
  misc_feature 1..20: note = CRISPR gRNA sequence
  source 1..20: mol_type = other DNA
cttaccccagctcagggtga

SEQ ID NO: 4644 - DNA, 20 bp, synthetic construct
  misc_feature 1..20: note = CRISPR gRNA sequence
  source 1..20: mol_type = other DNA
accccagctcagggtgaggg

SEQ ID NO: 4645 - DNA, 20 bp, synthetic construct
  misc_feature 1..20: note = CRISPR gRNA sequence
  source 1..20: mol_type = other DNA
ccccagctcagggtgagggg

SEQ ID NO: 4646 - DNA, 20 bp, synthetic construct
  misc_feature 1..20: note = CRISPR gRNA sequence
  source 1..20: mol_type = other DNA
agggtgaggggctcttgcag

SEQ ID NO: 4647 - DNA, 20 bp, synthetic construct
  misc_feature 1..20: note = CRISPR gRNA sequence
  source 1..20: mol_type = other DNA
ttgcagcccctcgtgctgca

SEQ ID NO: 4648 - DNA, 20 bp, synthetic construct
  misc_feature 1..20: note = CRISPR gRNA sequence
  source 1..20: mol_type = other DNA
gcagcccctcgtgctgcata

SEQ ID NO: 4649 - DNA, 20 bp, synthetic construct
  misc_feature 1..20: note = CRISPR gRNA sequence
  source 1..20: mol_type = other DNA
cagcccctcgtgctgcatat

SEQ ID NO: 4650 - DNA, 20 bp, synthetic construct
  misc_feature 1..20: note = CRISPR gRNA sequence
  source 1..20: mol_type = other DNA
gtgctgcatatggcacgtgt

SEQ ID NO: 4651 - DNA, 20 bp, synthetic construct
  misc_feature 1..20: note = CRISPR gRNA sequence
  source 1..20: mol_type = other DNA
catatggcacgtgtatctct

SEQ ID NO: 4652 - DNA, 20 bp, synthetic construct
  misc_feature 1..20: note = CRISPR gRNA sequence
  source 1..20: mol_type = other DNA
tgctcttgtccagaaggcac

SEQ ID NO: 4653 - DNA, 20 bp, synthetic construct
  misc_feature 1..20: note = CRISPR gRNA sequence
  source 1..20: mol_type = other DNA
ctcttgtccagaaggcacca

SEQ ID NO: 4654 - DNA, 20 bp, synthetic construct
  misc_feature 1..20: note = CRISPR gRNA sequence
  source 1..20: mol_type = other DNA
ttgtccagaaggcaccacca

SEQ ID NO: 4655 - DNA, 20 bp, synthetic construct
  misc_feature 1..20: note = CRISPR gRNA sequence
  source 1..20: mol_type = other DNA
gtccagaaggcaccaccaca

SEQ ID NO: 4656 - DNA, 20 bp, synthetic construct
  misc_feature 1..20: note = CRISPR gRNA sequence
  source 1..20: mol_type = other DNA
tccagaaggcaccaccacag

SEQ ID NO: 4657 - DNA, 20 bp, synthetic construct
  misc_feature 1..20: note = CRISPR gRNA sequence
  source 1..20: mol_type = other DNA
cccacttctggaaggttcca

SEQ ID NO: 4658 - DNA, 20 bp, synthetic construct
  misc_feature 1..20: note = CRISPR gRNA sequence
  source 1..20: mol_type = other DNA
ctggaaggttccatctcctg

SEQ ID NO: 4659 - DNA, 20 bp, synthetic construct
  misc_feature 1..20: note = CRISPR gRNA sequence
  source 1..20: mol_type = other DNA
tggaaggttccatctcctgc

SEQ ID NO: 4660 - DNA, 20 bp, synthetic construct
  misc_feature 1..20: note = CRISPR gRNA sequence
  source 1..20: mol_type = other DNA
gaaggttccatctcctgctg

SEQ ID NO: 4661 - DNA, 20 bp, synthetic construct
  misc_feature 1..20: note = CRISPR gRNA sequence
  source 1..20: mol_type = other DNA
catctcctgctggcctggtc

SEQ ID NO: 4662 - DNA, 20 bp, synthetic construct
  misc_feature 1..20: note = CRISPR gRNA sequence
  source 1..20: mol_type = other DNA
ctgctggcctggtctccaca

SEQ ID NO: 4663 - DNA, 20 bp, synthetic construct
  misc_feature 1..20: note = CRISPR gRNA sequence
  source 1..20: mol_type = other DNA
ctggcctggtctccacaagc

SEQ ID NO: 4664 - DNA, 20 bp, synthetic construct
  misc_feature 1..20: note = CRISPR gRNA sequence
  source 1..20: mol_type = other DNA
gcctggtctccacaagctcg

SEQ ID NO: 4665 - DNA, 20 bp, synthetic construct
  misc_feature 1..20: note = CRISPR gRNA sequence
  source 1..20: mol_type = other DNA
gtctccacaagctcggtgtc

SEQ ID NO: 4666 - DNA, 20 bp, synthetic construct
  misc_feature 1..20: note = CRISPR gRNA sequence
  source 1..20: mol_type = other DNA
cacaagctcggtgtcctggg

SEQ ID NO: 4667 - DNA, 20 bp, synthetic construct
  misc_feature 1..20: note = CRISPR gRNA sequence
  source 1..20: mol_type = other DNA
ggtgtcctgggtctggtcct

SEQ ID NO: 4668 - DNA, 20 bp, synthetic construct
  misc_feature 1..20: note = CRISPR gRNA sequence
  source 1..20: mol_type = other DNA
ggtctggtcctccccatccc

SEQ ID NO: 4669 - DNA, 20 bp, synthetic construct
  misc_feature 1..20: note = CRISPR gRNA sequence
  source 1..20: mol_type = other DNA
gtcctccccatcccgctgcc

SEQ ID NO: 4670 - DNA, 20 bp, synthetic construct
  misc_feature 1..20: note = CRISPR gRNA sequence
  source 1..20: mol_type = other DNA
cccatcccgctgccaggtca

SEQ ID NO: 4671 - DNA, 20 bp, synthetic construct
  misc_feature 1..20: note = CRISPR gRNA sequence
  source 1..20: mol_type = other DNA
ccaggtcagtgtgatctccg

SEQ ID NO: 4672 - DNA, 20 bp, synthetic construct
  misc_feature 1..20: note = CRISPR gRNA sequence
  source 1..20: mol_type = other DNA
cgcagggtagaagcccaggg

SEQ ID NO: 4673 - DNA, 20 bp, synthetic construct
  misc_feature 1..20: note = CRISPR gRNA sequence
  source 1..20: mol_type = other DNA
agggtggcctcatggtcaga

SEQ ID NO: 4674 - DNA, 20 bp, synthetic construct
  misc_feature 1..20: note = CRISPR gRNA sequence
  source 1..20: mol_type = other DNA
atggtcagagagggggtggt

SEQ ID NO: 4675 - DNA, 20 bp, synthetic construct
  misc_feature 1..20: note = CRISPR gRNA sequence
  source 1..20: mol_type = other DNA
tgggggttctgacgggaaga

SEQ ID NO: 4676 - DNA, 20 bp, synthetic construct
  misc_feature 1..20: note = CRISPR gRNA sequence
  source 1..20: mol_type = other DNA
gggggttctgacgggaagag

SEQ ID NO: 4677 - DNA, 20 bp, synthetic construct
  misc_feature 1..20: note = CRISPR gRNA sequence
  source 1..20: mol_type = other DNA
ggggttctgacgggaagagt

SEQ ID NO: 4678 - DNA, 20 bp, synthetic construct
  misc_feature 1..20: note = CRISPR gRNA sequence
  source 1..20: mol_type = other DNA
tgacgggaagagtcagaaaa

SEQ ID NO: 4679 - DNA, 20 bp, synthetic construct
  misc_feature 1..20: note = CRISPR gRNA sequence
  source 1..20: mol_type = other DNA
acgggaagagtcagaaaatt

SEQ ID NO: 4680 - DNA, 20 bp, synthetic construct
  misc_feature 1..20: note = CRISPR gRNA sequence
  source 1..20: mol_type = other DNA
agacactttgcatctctctt

SEQ ID NO: 4681 - DNA, 20 bp, synthetic construct
  misc_feature 1..20: note = CRISPR gRNA sequence
  source 1..20: mol_type = other DNA
tgcatctctcttgggacact

SEQ ID NO: 4682 - DNA, 20 bp, synthetic construct
  misc_feature 1..20: note = CRISPR gRNA sequence
  source 1..20: mol_type = other DNA
gcatctctcttgggacactc

SEQ ID NO: 4683 - DNA, 20 bp, synthetic construct
  misc_feature 1..20: note = CRISPR gRNA sequence
  source 1..20: mol_type = other DNA
catctctcttgggacactcc

SEQ ID NO: 4684 - DNA, 20 bp, synthetic construct
  misc_feature 1..20: note = CRISPR gRNA sequence
  source 1..20: mol_type = other DNA
tcttgggacactccagcagc

SEQ ID NO: 4685 - DNA, 20 bp, synthetic construct
  misc_feature 1..20: note = CRISPR gRNA sequence
  source 1..20: mol_type = other DNA
ttgggacactccagcagcgc

SEQ ID NO: 4686 - DNA, 20 bp, synthetic construct
  misc_feature 1..20: note = CRISPR gRNA sequence
  source 1..20: mol_type = other DNA
gggacactccagcagcgccc

SEQ ID NO: 4687 - DNA, 20 bp, synthetic construct
  misc_feature 1..20: note = CRISPR gRNA sequence
  source 1..20: mol_type = other DNA
ggacactccagcagcgccca

SEQ ID NO: 4688 - DNA, 20 bp, synthetic construct
  misc_feature 1..20: note = CRISPR gRNA sequence
  source 1..20: mol_type = other DNA
cagcagcgcccatgtgacca

SEQ ID NO: 4689 - DNA, 20 bp, synthetic construct
  misc_feature 1..20: note = CRISPR gRNA sequence
  source 1..20: mol_type = other DNA
agaatggacaggacacctgg

SEQ ID NO: 4690 - DNA, 20 bp, synthetic construct
  misc_feature 1..20: note = CRISPR gRNA sequence
  source 1..20: mol_type = other DNA
gggtggggaaggcggcacag

SEQ ID NO: 4691 - DNA, 20 bp, synthetic construct
  misc_feature 1..20: note = CRISPR gRNA sequence
  source 1..20: mol_type = other DNA
gacacaggcacctgggataa

SEQ ID NO: 4692 - DNA, 20 bp, synthetic construct
  misc_feature 1..20: note = CRISPR gRNA sequence
  source 1..20: mol_type = other DNA
ggataatctcctattcattg

SEQ ID NO: 4693 - DNA, 20 bp, synthetic construct
  misc_feature 1..20: note = CRISPR gRNA sequence
  source 1..20: mol_type = other DNA
ctattcattggaaagttcta

SEQ ID NO: 4694 - DNA, 20 bp, synthetic construct
  misc_feature 1..20: note = CRISPR gRNA sequence
  source 1..20: mol_type = other DNA
ttcattggaaagttctagtc

SEQ ID NO: 4695 - DNA, 20 bp, synthetic construct
  misc_feature 1..20: note = CRISPR gRNA sequence
  source 1..20: mol_type = other DNA
attggaaagttctagtctct

SEQ ID NO: 4696 - DNA, 20 bp, synthetic construct
  misc_feature 1..20: note = CRISPR gRNA sequence
  source 1..20: mol_type = other DNA
gaaagttctagtctctgagg

SEQ ID NO: 4697 - DNA, 20 bp, synthetic construct
  misc_feature 1..20: note = CRISPR gRNA sequence
  source 1..20: mol_type = other DNA
tagtctctgagggaggaaca

SEQ ID NO: 4698 - DNA, 20 bp, synthetic construct
  misc_feature 1..20: note = CRISPR gRNA sequence
  source 1..20: mol_type = other DNA
gtctctgagggaggaacagc

SEQ ID NO: 4699 - DNA, 20 bp, synthetic construct
  misc_feature 1..20: note = CRISPR gRNA sequence
  source 1..20: mol_type = other DNA
tgagggaggaacagcgactt

SEQ ID NO: 4700 - DNA, 20 bp, synthetic construct
  misc_feature 1..20: note = CRISPR gRNA sequence
  source 1..20: mol_type = other DNA
agggaggaacagcgacttct

SEQ ID NO: 4701 - DNA, 20 bp, synthetic construct
  misc_feature 1..20: note = CRISPR gRNA sequence
  source 1..20: mol_type = other DNA
ctggtcctgacctgagtgga

SEQ ID NO: 4702 - DNA, 20 bp, synthetic construct
  misc_feature 1..20: note = CRISPR gRNA sequence
  source 1..20: mol_type = other DNA
tggtcctgacctgagtggag

SEQ ID NO: 4703 - DNA, 20 bp, synthetic construct
  misc_feature 1..20: note = CRISPR gRNA sequence
  source 1..20: mol_type = other DNA
gtcctgacctgagtggaggc

SEQ ID NO: 4704 - DNA, 20 bp, synthetic construct
  misc_feature 1..20: note = CRISPR gRNA sequence
  source 1..20: mol_type = other DNA
acctgagtggaggctgcagg

SEQ ID NO: 4705 - DNA, 20 bp, synthetic construct
  misc_feature 1..20: note = CRISPR gRNA sequence
  source 1..20: mol_type = other DNA
agtggaggctgcaggactca

SEQ ID NO: 4706 - DNA, 20 bp, synthetic construct
  misc_feature 1..20: note = CRISPR gRNA sequence
  source 1..20: mol_type = other DNA
caggactcagaaaagctgga

SEQ ID NO: 4707 - DNA, 20 bp, synthetic construct
  misc_feature 1..20: note = CRISPR gRNA sequence
  source 1..20: mol_type = other DNA
agaaaagctggaatcaaacc

SEQ ID NO: 4708 - DNA, 20 bp, synthetic construct
  misc_feature 1..20: note = CRISPR gRNA sequence
  source 1..20: mol_type = other DNA
gaatcaaaccttcagacaca

SEQ ID NO: 4709 - DNA, 20 bp, synthetic construct
  misc_feature 1..20: note = CRISPR gRNA sequence
  source 1..20: mol_type = other DNA
cagacacattgagtgtgagg

SEQ ID NO: 4710 - DNA, 20 bp, synthetic construct
  misc_feature 1..20: note = CRISPR gRNA sequence
  source 1..20: mol_type = other DNA
agacacattgagtgtgaggc

SEQ ID NO: 4711 - DNA, 20 bp, synthetic construct
  misc_feature 1..20: note = CRISPR gRNA sequence
  source 1..20: mol_type = other DNA
agtgtgaggcagagaacaag

SEQ ID NO: 4712 - DNA, 20 bp, synthetic construct
  misc_feature 1..20: note = CRISPR gRNA sequence
  source 1..20: mol_type = other DNA
agagaaaggtcagcagcctg

SEQ ID NO: 4713 - DNA, 20 bp, synthetic construct
  misc_feature 1..20: note = CRISPR gRNA sequence
  source 1..20: mol_type = other DNA
accacagctgctgcagtggt

SEQ ID NO: 4714 - DNA, 20 bp, synthetic construct
  misc_feature 1..20: note = CRISPR gRNA sequence
  source 1..20: mol_type = other DNA
ctgcagtggtcaaagtggtc

SEQ ID NO: 4715 - DNA, 20 bp, synthetic construct
  misc_feature 1..20: note = CRISPR gRNA sequence
  source 1..20: mol_type = other DNA
cagtggtcaaagtggtcaaa

SEQ ID NO: 4716 - DNA, 20 bp, synthetic construct
  misc_feature 1..20: note = CRISPR gRNA sequence
  source 1..20: mol_type = other DNA
atcagtattccagggactgt

SEQ ID NO: 4717 - DNA, 20 bp, synthetic construct
  misc_feature 1..20: note = CRISPR gRNA sequence
  source 1..20: mol_type = other DNA
cagggactgtcttcccctcc

SEQ ID NO: 4718 - DNA, 20 bp, synthetic construct
  misc_feature 1..20: note = CRISPR gRNA sequence
  source 1..20: mol_type = other DNA
tcttcccctccatttcctca

SEQ ID NO: 4719 - DNA, 20 bp, synthetic construct
  misc_feature 1..20: note = CRISPR gRNA sequence
  source 1..20: mol_type = other DNA
cccctccatttcctcagaga

SEQ ID NO: 4720 - DNA, 20 bp, synthetic construct
  misc_feature 1..20: note = CRISPR gRNA sequence
  source 1..20: mol_type = other DNA
ccctccatttcctcagagac

SEQ ID NO: 4721 - DNA, 20 bp, synthetic construct
  misc_feature 1..20: note = CRISPR gRNA sequence
  source 1..20: mol_type = other DNA
catttcctcagagacttcat

SEQ ID NO: 4722 - DNA, 20 bp, synthetic construct
  misc_feature 1..20: note = CRISPR gRNA sequence
  source 1..20: mol_type = other DNA
cctcagagacttcatccctt

SEQ ID NO: 4723 - DNA, 20 bp, synthetic construct
  misc_feature 1..20: note = CRISPR gRNA sequence
  source 1..20: mol_type = other DNA
ctcagagacttcatccctta

SEQ ID NO: 4724 - DNA, 20 bp, synthetic construct
  misc_feature 1..20: note = CRISPR gRNA sequence
  source 1..20: mol_type = other DNA
agagacttcatcccttaatt

SEQ ID NO: 4725 - DNA, 20 bp, synthetic construct
  misc_feature 1..20: note = CRISPR gRNA sequence
  source 1..20: mol_type = other DNA
catcccttaattgtcctaga

SEQ ID NO: 4726 - DNA, 20 bp, synthetic construct
  misc_feature 1..20: note = CRISPR gRNA sequence
  source 1..20: mol_type = other DNA
atcccttaattgtcctagag

SEQ ID NO: 4727 - DNA, 20 bp, synthetic construct
  misc_feature 1..20: note = CRISPR gRNA sequence
  source 1..20: mol_type = other DNA
aattgtcctagagagcagag

SEQ ID NO: 4728 - DNA, 20 bp, synthetic construct
  misc_feature 1..20: note = CRISPR gRNA sequence
  source 1..20: mol_type = other DNA
attgtcctagagagcagagg

SEQ ID NO: 4729 - DNA, 20 bp, synthetic construct
  misc_feature 1..20: note = CRISPR gRNA sequence
  source 1..20: mol_type = other DNA
tcctagagagcagagggggc

SEQ ID NO: 4730 - DNA, 20 bp, synthetic construct
  misc_feature 1..20: note = CRISPR gRNA sequence
  source 1..20: mol_type = other DNA
gagagcagagggggccctca

SEQ ID NO: 4731 - DNA, 20 bp, synthetic construct
  misc_feature 1..20: note = CRISPR gRNA sequence
  source 1..20: mol_type = other DNA
agaggaaactcaggaaaact

SEQ ID NO: 4732 - DNA, 20 bp, synthetic construct
  misc_feature 1..20: note = CRISPR gRNA sequence
  source 1..20: mol_type = other DNA
aggaaaactcatgccattct

SEQ ID NO: 4733 - DNA, 20 bp, synthetic construct
  misc_feature 1..20: note = CRISPR gRNA sequence
  source 1..20: mol_type = other DNA
atgccattctccattcaagg

SEQ ID NO: 4734 - DNA, 20 bp, synthetic construct
  misc_feature 1..20: note = CRISPR gRNA sequence
  source 1..20: mol_type = other DNA
tccattcaagggagggcgat

SEQ ID NO: 4735 - DNA, 20 bp, synthetic construct
  misc_feature 1..20: note = CRISPR gRNA sequence
  source 1..20: mol_type = other DNA
cattcaagggagggcgatat

SEQ ID NO: 4736 - DNA, 20 bp, synthetic construct
  misc_feature 1..20: note = CRISPR gRNA sequence
  source 1..20: mol_type = other DNA
aagggagggcgatattccag

SEQ ID NO: 4737 - DNA, 20 bp, synthetic construct
  misc_feature 1..20: note = CRISPR gRNA sequence
  source 1..20: mol_type = other DNA
cagtgctgatcccattttcc

SEQ ID NO: 4738 - DNA, 20 bp, synthetic construct
  misc_feature 1..20: note = CRISPR gRNA sequence
  source 1..20: mol_type = other DNA
atcccattttcctcccctcc

SEQ ID NO: 4739 - DNA, 20 bp, synthetic construct
  misc_feature 1..20: note = CRISPR gRNA sequence
  source 1..20: mol_type = other DNA
tcctcccctcctcgtgggag

SEQ ID NO: 4740 - DNA, 20 bp, synthetic construct
  misc_feature 1..20: note = CRISPR gRNA sequence
  source 1..20: mol_type = other DNA
cctcccctcctcgtgggagg

SEQ ID NO: 4741 - DNA, 20 bp, synthetic construct
  misc_feature 1..20: note = CRISPR gRNA sequence
  source 1..20: mol_type = other DNA
ctcccctcctcgtgggaggc

SEQ ID NO: 4742 - DNA, 20 bp, synthetic construct
  misc_feature 1..20: note = CRISPR gRNA sequence
  source 1..20: mol_type = other DNA
ccctcctcgtgggaggccat

SEQ ID NO: 4743 - DNA, 20 bp, synthetic construct
  misc_feature 1..20: note = CRISPR gRNA sequence
  source 1..20: mol_type = other DNA
ctcgtgggaggccatcccgg

SEQ ID NO: 4744 - DNA, 20 bp, synthetic construct
  misc_feature 1..20: note = CRISPR gRNA sequence
  source 1..20: mol_type = other DNA
gtgggaggccatcccgggag

SEQ ID NO: 4745 - DNA, 20 bp, synthetic construct
  misc_feature 1..20: note = CRISPR gRNA sequence
  source 1..20: mol_type = other DNA
taggagatggggaaggctcc

SEQ ID NO: 4746 - DNA, 20 bp, synthetic construct
  misc_feature 1..20: note = CRISPR gRNA sequence
  source 1..20: mol_type = other DNA
cccactgcccctggtacctg

SEQ ID NO: 4747 - DNA, 20 bp, synthetic construct
  misc_feature 1..20: note = CRISPR gRNA sequence
  source 1..20: mol_type = other DNA
cccctggtacctgcgcgctg

SEQ ID NO: 4748 - DNA, 20 bp, synthetic construct
  misc_feature 1..20: note = CRISPR gRNA sequence
  source 1..20: mol_type = other DNA
gtacctgcgcgctgcagcgt

SEQ ID NO: 4749 - DNA, 20 bp, synthetic construct
  misc_feature 1..20: note = CRISPR gRNA sequence
  source 1..20: mol_type = other DNA
cgcgctgcagcgtctccttc

SEQ ID NO: 4750 - DNA, 20 bp, synthetic construct
  misc_feature 1..20: note = CRISPR gRNA sequence
  source 1..20: mol_type = other DNA
cagcgtctccttcccgttct

SEQ ID NO: 4751 - DNA, 20 bp, synthetic construct
  misc_feature 1..20: note = CRISPR gRNA sequence
  source 1..20: mol_type = other DNA
cttcccgttctccaggtatc

SEQ ID NO: 4752 - DNA, 20 bp, synthetic construct
  misc_feature 1..20: note = CRISPR gRNA sequence
  source 1..20: mol_type = other DNA
cccgttctccaggtatctgc

SEQ ID NO: 4753 - DNA, 20 bp, synthetic construct
  misc_feature 1..20: note = CRISPR gRNA sequence
  source 1..20: mol_type = other DNA
ccgttctccaggtatctgcg

SEQ ID NO: 4754 - DNA, 20 bp, synthetic construct
  misc_feature 1..20: note = CRISPR gRNA sequence
  source 1..20: mol_type = other DNA
tccaggtatctgcggagcca

SEQ ID NO: 4755 - DNA, 20 bp, synthetic construct
  misc_feature 1..20: note = CRISPR gRNA sequence
  source 1..20: mol_type = other DNA
caggtatctgcggagccact

SEQ ID NO: 4756 - DNA, 20 bp, synthetic construct
  misc_feature 1..20: note = CRISPR gRNA sequence
  source 1..20: mol_type = other DNA
cggagccactccacgcacgt

SEQ ID NO: 4757 - DNA, 20 bp, synthetic construct
  misc_feature 1..20: note = CRISPR gRNA sequence
  source 1..20: mol_type = other DNA
cacgcacgtgccctccaggt

SEQ ID NO: 4758 - DNA, 20 bp, synthetic construct
  misc_feature 1..20: note = CRISPR gRNA sequence
  source 1..20: mol_type = other DNA
caggtaggctctcagctgct

SEQ ID NO: 4759 - DNA, 20 bp, synthetic construct
  misc_feature 1..20: note = CRISPR gRNA sequence
  source 1..20: mol_type = other DNA
tcagctgctccgccgcacgg

SEQ ID NO: 4760 - DNA, 20 bp, synthetic construct
  misc_feature 1..20: note = CRISPR gRNA sequence
  source 1..20: mol_type = other DNA
agctgctccgccgcacgggc

SEQ ID NO: 4761 - DNA, 20 bp, synthetic construct
  misc_feature 1..20: note = CRISPR gRNA sequence
  source 1..20: mol_type = other DNA
ctccgccgcacgggccgcct

SEQ ID NO: 4762 - DNA, 20 bp, synthetic construct
  misc_feature 1..20: note = CRISPR gRNA sequence
  source 1..20: mol_type = other DNA
cgccgcacgggccgcctcca

SEQ ID NO: 4763 - DNA, 20 bp, synthetic construct
  misc_feature 1..20: note = CRISPR gRNA sequence
  source 1..20: mol_type = other DNA
caacttgcgctgggtgatct

SEQ ID NO: 4764 - DNA, 20 bp, synthetic construct
  misc_feature 1..20: note = CRISPR gRNA sequence
  source 1..20: mol_type = other DNA
gcgctgggtgatctgagccg

SEQ ID NO: 4765 - DNA, 20 bp, synthetic construct
  misc_feature 1..20: note = CRISPR gRNA sequence
  source 1..20: mol_type = other DNA
cgctgggtgatctgagccgc

SEQ ID NO: 4766 - DNA, 20 bp, synthetic construct
  misc_feature 1..20: note = CRISPR gRNA sequence
  source 1..20: mol_type = other DNA
ggtgatctgagccgcggtgt

SEQ ID NO: 4767 - DNA, 20 bp, synthetic construct
  misc_feature 1..20: note = CRISPR gRNA sequence
  source 1..20: mol_type = other DNA
agccgcggtgtccgcggcgg

SEQ ID NO: 4768 - DNA, 20 bp, synthetic construct
  misc_feature 1..20: note = CRISPR gRNA sequence
  source 1..20: mol_type = other DNA
gttcagggcgatgtaatcct

SEQ ID NO: 4769 - DNA, 20 bp, synthetic construct
  misc_feature 1..20: note = CRISPR gRNA sequence
  source 1..20: mol_type = other DNA
agggcgatgtaatccttgcc

SEQ ID NO: 4770 - DNA, 20 bp, synthetic construct
  misc_feature 1..20: note = CRISPR gRNA sequence
  source 1..20: mol_type = other DNA
gccgtcgtaggcggactggt

SEQ ID NO: 4771 - DNA, 20 bp, synthetic construct
  misc_feature 1..20: note = CRISPR gRNA sequence
  source 1..20: mol_type = other DNA
ccgtcgtaggcggactggtc

SEQ ID NO: 4772 - DNA, 20 bp, synthetic construct
  misc_feature 1..20: note = CRISPR gRNA sequence
  source 1..20: mol_type = other DNA
gtcatacccgcggaggaggc

SEQ ID NO: 4773 - DNA, 20 bp, synthetic construct
  misc_feature 1..20: note = CRISPR gRNA sequence
  source 1..20: mol_type = other DNA
tggagggtgtgagaccctgg

SEQ ID NO: 4774 - DNA, 20 bp, synthetic construct
  misc_feature 1..20: note = CRISPR gRNA sequence
  source 1..20: mol_type = other DNA
gagggtgtgagaccctggcc

SEQ ID NO: 4775 - DNA, 20 bp, synthetic construct
  misc_feature 1..20: note = CRISPR gRNA sequence
  source 1..20: mol_type = other DNA
gccccgcccccgcggtcagc

SEQ ID NO: 4776 - DNA, 20 bp, synthetic construct
  misc_feature 1..20: note = CRISPR gRNA sequence
  source 1..20: mol_type = other DNA
tggcctaaaccgaaaatgaa

SEQ ID NO: 4777 - DNA, 20 bp, synthetic construct
  misc_feature 1..20: note = CRISPR gRNA sequence
  source 1..20: mol_type = other DNA
ggcctaaaccgaaaatgaaa

SEQ ID NO: 4778 - DNA, 20 bp, synthetic construct
  misc_feature 1..20: note = CRISPR gRNA sequence
  source 1..20: mol_type = other DNA
gcctaaaccgaaaatgaaac

SEQ ID NO: 4779 - DNA, 20 bp, synthetic construct
  misc_feature 1..20: note = CRISPR gRNA sequence
  source 1..20: mol_type = other DNA
aaccgaaaatgaaaccgggt

SEQ ID NO: 4780 - DNA, 20 bp, synthetic construct
  misc_feature 1..20: note = CRISPR gRNA sequence
  source 1..20: mol_type = other DNA
gggctctctccggtcgaggg

SEQ ID NO: 4781 - DNA, 20 bp, synthetic construct
  misc_feature 1..20: note = CRISPR gRNA sequence
  source 1..20: mol_type = other DNA
tctccggtcgagggtctggg

SEQ ID NO: 4782 - DNA, 20 bp, synthetic construct
  misc_feature 1..20: note = CRISPR gRNA sequence
  source 1..20: mol_type = other DNA
tccggtcgagggtctgggcg

SEQ ID NO: 4783 - DNA, 20 bp, synthetic construct
  misc_feature 1..20: note = CRISPR gRNA sequence
  source 1..20: mol_type = other DNA
cggtcgagggtctgggcggg

SEQ ID NO: 4784 - DNA, 20 bp, synthetic construct
  misc_feature 1..20: note = CRISPR gRNA sequence
  source 1..20: mol_type = other DNA
ggcgggttccgcagatccac

SEQ ID NO: 4785 - DNA, 20 bp, synthetic construct
  misc_feature 1..20: note = CRISPR gRNA sequence
  source 1..20: mol_type = other DNA
cgcagatccaccttggggtg

SEQ ID NO: 4786 - DNA, 20 bp, synthetic construct
  misc_feature 1..20: note = CRISPR gRNA sequence
  source 1..20: mol_type = other DNA
ggggtggatctcagacgggg

SEQ ID NO: 4787 - DNA, 20 bp, synthetic construct
  misc_feature 1..20: note = CRISPR gRNA sequence
  source 1..20: mol_type = other DNA
gggtggatctcagacgggga

SEQ ID NO: 4788 - DNA, 20 bp, synthetic construct
  misc_feature 1..20: note = CRISPR gRNA sequence
  source 1..20: mol_type = other DNA
agacggggagactcggggcg

SEQ ID NO: 4789 - DNA, 20 bp, synthetic construct
  misc_feature 1..20: note = CRISPR gRNA sequence
  source 1..20: mol_type = other DNA
ggggcgacccgggccgtccg

SEQ ID NO: 4790 - DNA, 20 bp, synthetic construct
  misc_feature 1..20: note = CRISPR gRNA sequence
  source 1..20: mol_type = other DNA
cgccccgggccggggtcact

SEQ ID NO: 4791 - DNA, 20 bp, synthetic construct
  misc_feature 1..20: note = CRISPR gRNA sequence
  source 1..20: mol_type = other DNA
accgtcctcgctctggttgt

SEQ ID NO: 4792 - DNA, 20 bp, synthetic construct
  misc_feature 1..20: note = CRISPR gRNA sequence
  source 1..20: mol_type = other DNA
gctctggttgtagtagccgc

SEQ ID NO: 4793 - DNA, 20 bp, synthetic construct
  misc_feature 1..20: note = CRISPR gRNA sequence
  source 1..20: mol_type = other DNA
tggttgtagtagccgcgcag

SEQ ID NO: 4794 - DNA, 20 bp, synthetic construct
  misc_feature 1..20: note = CRISPR gRNA sequence
  source 1..20: mol_type = other DNA
gttgtagtagccgcgcaggt

SEQ ID NO: 4795 - DNA, 20 bp, synthetic construct
  misc_feature 1..20: note = CRISPR gRNA sequence
  source 1..20: mol_type = other DNA
tagtagccgcgcaggttccg

SEQ ID NO: 4796 - DNA, 20 bp, synthetic construct
  misc_feature 1..20: note = CRISPR gRNA sequence
  source 1..20: mol_type = other DNA
cgcaggctcactcggtcagc

SEQ ID NO: 4797 - DNA, 20 bp, synthetic construct
  misc_feature 1..20: note = CRISPR gRNA sequence
  source 1..20: mol_type = other DNA
actcggtcagcctgtgcctg

SEQ ID NO: 4798 - DNA, 20 bp, synthetic construct
  misc_feature 1..20: note = CRISPR gRNA sequence
  source 1..20: mol_type = other DNA
ggtcagcctgtgcctggcgc

SEQ ID NO: 4799 - DNA, 20 bp, synthetic construct
  misc_feature 1..20: note = CRISPR gRNA sequence
  source 1..20: mol_type = other DNA
tgcctggcgcttgtagttct

SEQ ID NO: 4800 - DNA, 20 bp, synthetic construct
  misc_feature 1..20: note = CRISPR gRNA sequence
  source 1..20: mol_type = other DNA
gcgcttgtagttctgtgtct

SEQ ID NO: 4801 - DNA, 20 bp, synthetic construct
  misc_feature 1..20: note = CRISPR gRNA sequence
  source 1..20: mol_type = other DNA
gtagttctgtgtctcccggt

SEQ ID NO: 4802 - DNA, 20 bp, synthetic construct
  misc_feature 1..20: note = CRISPR gRNA sequence
  source 1..20: mol_type = other DNA
tagttctgtgtctcccggtc

SEQ ID NO: 4803 - DNA, 20 bp, synthetic construct
  misc_feature 1..20: note = CRISPR gRNA sequence
  source 1..20: mol_type = other DNA
tgtgtctcccggtcccaata

SEQ ID NO: 4804 - DNA, 20 bp, synthetic construct
  misc_feature 1..20: note = CRISPR gRNA sequence
  source 1..20: mol_type = other DNA
tgtctcccggtcccaatact

SEQ ID NO: 4805 - DNA, 20 bp, synthetic construct
  misc_feature 1..20: note = CRISPR gRNA sequence
  source 1..20: mol_type = other DNA
ccggtcccaatactccggcc

SEQ ID NO: 4806 - DNA, 20 bp, synthetic construct
  misc_feature 1..20: note = CRISPR gRNA sequence
  source 1..20: mol_type = other DNA
cggcccctcctgctccaccc

SEQ ID NO: 4807 - DNA, 20 bp, synthetic construct
  misc_feature 1..20: note = CRISPR gRNA sequence
  source 1..20: mol_type = other DNA
ctgctccacccacggcgccc

SEQ ID NO: 4808 - DNA, 20 bp, synthetic construct
  misc_feature 1..20: note = CRISPR gRNA sequence
  source 1..20: mol_type = other DNA
ctccacccacggcgcccgcg

SEQ ID NO: 4809 - DNA, 20 bp, synthetic construct
  misc_feature 1..20: note = CRISPR gRNA sequence
  source 1..20: mol_type = other DNA
cacccacggcgcccgcggct

SEQ ID NO: 4810 - DNA, 20 bp, synthetic construct
  misc_feature 1..20: note = CRISPR gRNA sequence
  source 1..20: mol_type = other DNA
ccctctcggactcgcggcgt

SEQ ID NO: 4811 - DNA, 20 bp, synthetic construct
  misc_feature 1..20: note = CRISPR gRNA sequence
  source 1..20: mol_type = other DNA
tcggactcgcggcgtcgctg

SEQ ID NO: 4812 - DNA, 20 bp, synthetic construct
  misc_feature 1..20: note = CRISPR gRNA sequence
  source 1..20: mol_type = other DNA
ggactcgcggcgtcgctgtc

SEQ ID NO: 4813 - DNA, 20 bp, synthetic construct
  misc_feature 1..20: note = CRISPR gRNA sequence
  source 1..20: mol_type = other DNA
gcggcgtcgctgtcgaaccg

SEQ ID NO: 4814 - DNA, 20 bp, synthetic construct
  misc_feature 1..20: note = CRISPR gRNA sequence
  source 1..20: mol_type = other DNA
tcgaaccgcacgaactgcgt

SEQ ID NO: 4815 - DNA, 20 bp, synthetic construct
  misc_feature 1..20: note = CRISPR gRNA sequence
  source 1..20: mol_type = other DNA
cgtgtcgtccacgtagccca

SEQ ID NO: 4816 - DNA, 20 bp, synthetic construct
  misc_feature 1..20: note = CRISPR gRNA sequence
  source 1..20: mol_type = other DNA
agatgaagcggggctctccg

SEQ ID NO: 4817 - DNA, 20 bp, synthetic construct
  misc_feature 1..20: note = CRISPR gRNA sequence
  source 1..20: mol_type = other DNA
tccgcggccgggccgggaca

SEQ ID NO: 4818 - DNA, 20 bp, synthetic construct
  misc_feature 1..20: note = CRISPR gRNA sequence
  source 1..20: mol_type = other DNA
cgcggccgggccgggacacg

SEQ ID NO: 4819 - DNA, 20 bp, synthetic construct
  misc_feature 1..20: note = CRISPR gRNA sequence
  source 1..20: mol_type = other DNA
atggagtgggagcctggggg

SEQ ID NO: 4820 - DNA, 20 bp, synthetic construct
  misc_feature 1..20: note = CRISPR gRNA sequence
  source 1..20: mol_type = other DNA
ggggcgaggaggggctgaga

SEQ ID NO: 4821 - DNA, 20 bp, synthetic construct
  misc_feature 1..20: note = CRISPR gRNA sequence
  source 1..20: mol_type = other DNA
agacccgcccgacccacctc

SEQ ID NO: 4822 - DNA, 20 bp, synthetic construct
  misc_feature 1..20: note = CRISPR gRNA sequence
  source 1..20: mol_type = other DNA
cctgcgcggctccccgggtc

SEQ ID NO: 4823 - DNA, 20 bp, synthetic construct
  misc_feature 1..20: note = CRISPR gRNA sequence
  source 1..20: mol_type = other DNA
cgcggctccccgggtcctgc

SEQ ID NO: 4824 - DNA, 20 bp, synthetic construct
  misc_feature 1..20: note = CRISPR gRNA sequence
  source 1..20: mol_type = other DNA
cccgggtcctgcgccctcgc

SEQ ID NO: 4825 - DNA, 20 bp, synthetic construct
  misc_feature 1..20: note = CRISPR gRNA sequence
  source 1..20: mol_type = other DNA
cgccctcgccgggcgggccc

SEQ ID NO: 4826 - DNA, 20 bp, synthetic construct
  misc_feature 1..20: note = CRISPR gRNA sequence
  source 1..20: mol_type = other DNA
gccgggcgggcccctcgctc

SEQ ID NO: 4827 - DNA, 20 bp, synthetic construct
  misc_feature 1..20: note = CRISPR gRNA sequence
  source 1..20: mol_type = other DNA
gctcctctccgcagaggccg

SEQ ID NO: 4828 - DNA, 20 bp, synthetic construct
  misc_feature 1..20: note = CRISPR gRNA sequence
  source 1..20: mol_type = other DNA
ctctccgcagaggccgcttc

SEQ ID NO: 4829 - DNA, 20 bp, synthetic construct
  misc_feature 1..20: note = CRISPR gRNA sequence
  source 1..20: mol_type = other DNA
tccgcagaggccgcttccct

SEQ ID NO: 4830 - DNA, 20 bp, synthetic construct
  misc_feature 1..20: note = CRISPR gRNA sequence
  source 1..20: mol_type = other DNA
cgcagaggccgcttccctcc

SEQ ID NO: 4831 - DNA, 20 bp, synthetic construct
  misc_feature 1..20: note = CRISPR gRNA sequence
  source 1..20: mol_type = other DNA
ccctcccaaccccgcactca

SEQ ID NO: 4832 - DNA, 20 bp, synthetic construct
  misc_feature 1..20: note = CRISPR gRNA sequence
  source 1..20: mol_type = other DNA
cctcccaaccccgcactcac

SEQ ID NO: 4833 - DNA, 20 bp, synthetic construct
  misc_feature 1..20: note = CRISPR gRNA sequence
  source 1..20: mol_type = other DNA
ccaaccccgcactcacaggc

SEQ ID NO: 4834 - DNA, 20 bp, synthetic construct
  misc_feature 1..20: note = CRISPR gRNA sequence
  source 1..20: mol_type = other DNA
acaggcccaggtctcggtca

SEQ ID NO: 4835 - DNA, 20 bp, synthetic construct
  misc_feature 1..20: note = CRISPR gRNA sequence
  source 1..20: mol_type = other DNA
ggtcagggccaggcctcccg

SEQ ID NO: 4836 - DNA, 20 bp, synthetic construct
  misc_feature 1..20: note = CRISPR gRNA sequence
  source 1..20: mol_type = other DNA
ccgagagcagcaggaggagg

SEQ ID NO: 4837 - DNA, 20 bp, synthetic construct
  misc_feature 1..20: note = CRISPR gRNA sequence
  source 1..20: mol_type = other DNA
ggggcgccatgacccgcatc

SEQ ID NO: 4838 - DNA, 20 bp, synthetic construct
  misc_feature 1..20: note = CRISPR gRNA sequence
  source 1..20: mol_type = other DNA
ggcctctggggagaatgtga

SEQ ID NO: 4839 - DNA, 20 bp, synthetic construct
  misc_feature 1..20: note = CRISPR gRNA sequence
  source 1..20: mol_type = other DNA
tggggagaatgtgagtccgg

SEQ ID NO: 4840 - DNA, 20 bp, synthetic construct
  misc_feature 1..20: note = CRISPR gRNA sequence
  source 1..20: mol_type = other DNA
gggagaatgtgagtccgggt

SEQ ID NO: 4841 - DNA, 20 bp, synthetic construct
  misc_feature 1..20: note = CRISPR gRNA sequence
  source 1..20: mol_type = other DNA
gggactttagaaccgggact

SEQ ID NO: 4842 - DNA, 20 bp, synthetic construct
  misc_feature 1..20: note = CRISPR gRNA sequence
  source 1..20: mol_type = other DNA
tagaaccgggactgcggaga

SEQ ID NO: 4843 - DNA, 20 bp, synthetic construct
  misc_feature 1..20: note = CRISPR gRNA sequence
  source 1..20: mol_type = other DNA
agaaccgggactgcggagac

SEQ ID NO: 4844 - DNA, 20 bp, synthetic construct
  misc_feature 1..20: note = CRISPR gRNA sequence
  source 1..20: mol_type = other DNA
gaaccgggactgcggagacg

SEQ ID NO: 4845 - DNA, 20 bp, synthetic construct
  misc_feature 1..20: note = CRISPR gRNA sequence
  source 1..20: mol_type = other DNA
cggagacgctgattggcttc

SEQ ID NO: 4846 - DNA, 20 bp, synthetic construct
  misc_feature 1..20: note = CRISPR gRNA sequence
  source 1..20: mol_type = other DNA
attggcttctctagaacccg

SEQ ID NO: 4847 - DNA, 20 bp, synthetic construct
  misc_feature 1..20: note = CRISPR gRNA sequence
  source 1..20: mol_type = other DNA
gcttctctagaacccgacac

SEQ ID NO: 4848 - DNA, 20 bp, synthetic construct
  misc_feature 1..20: note = CRISPR gRNA sequence
  source 1..20: mol_type = other DNA
ctctagaacccgacacccaa

SEQ ID NO: 4849 - DNA, 20 bp, synthetic construct
  misc_feature 1..20: note = CRISPR gRNA sequence
  source 1..20: mol_type = other DNA
ggtgtcgggttctagagaag

SEQ ID NO: 4850 - DNA, 20 bp, synthetic construct
  misc_feature 1..20: note = CRISPR gRNA sequence
  source 1..20: mol_type = other DNA
tagagaagccaatcagcgtc

SEQ ID NO: 4851 - DNA, 20 bp, synthetic construct
  misc_feature 1..20: note = CRISPR gRNA sequence
  source 1..20: mol_type = other DNA
gagaagccaatcagcgtctc

SEQ ID NO: 4852 - DNA, 20 bp, synthetic construct
  misc_feature 1..20: note = CRISPR gRNA sequence
  source 1..20: mol_type = other DNA
cgcagtcccggttctaaagt

SEQ ID NO: 4853 - DNA, 20 bp, synthetic construct
  misc_feature 1..20: note = CRISPR gRNA sequence
  source 1..20: mol_type = other DNA
taaagtccccagtcacccac

SEQ ID NO: 4854 - DNA, 20 bp, synthetic construct
  misc_feature 1..20: note = CRISPR gRNA sequence
  source 1..20: mol_type = other DNA
aagtccccagtcacccaccc

SEQ ID NO: 4855 - DNA, 20 bp, synthetic construct
  misc_feature 1..20: note = CRISPR gRNA sequence
  source 1..20: mol_type = other DNA
acattctccccagaggccga

SEQ ID NO: 4856 - DNA, 20 bp, synthetic construct
  misc_feature 1..20: note = CRISPR gRNA sequence
  source 1..20: mol_type = other DNA
tccccagaggccgagatgcg

SEQ ID NO: 4857 - DNA, 20 bp, synthetic construct
  misc_feature 1..20: note = CRISPR gRNA sequence
  source 1..20: mol_type = other DNA
cccagaggccgagatgcggg

SEQ ID NO: 4858 - DNA, 20 bp, synthetic construct
  misc_feature 1..20: note = CRISPR gRNA sequence
  source 1..20: mol_type = other DNA
ctcctgctgctctcgggagg

SEQ ID NO: 4859 - DNA, 20 bp, synthetic construct
  misc_feature 1..20: note = CRISPR gRNA sequence
  source 1..20: mol_type = other DNA
ctgctgctctcgggaggcct

SEQ ID NO: 4860 - DNA, 20 bp, synthetic construct
  misc_feature 1..20: note = CRISPR gRNA sequence
  source 1..20: mol_type = other DNA
ctgctctcgggaggcctggc

SEQ ID NO: 4861 - DNA, 20 bp, synthetic construct
  misc_feature 1..20: note = CRISPR gRNA sequence
  source 1..20: mol_type = other DNA
ctctcgggaggcctggccct

SEQ ID NO: 4862 - DNA, 20 bp, synthetic construct
  misc_feature 1..20: note = CRISPR gRNA sequence
  source 1..20: mol_type = other DNA
tcgggaggcctggccctgac

SEQ ID NO: 4863 - DNA, 20 bp, synthetic construct
  misc_feature 1..20: note = CRISPR gRNA sequence
  source 1..20: mol_type = other DNA
gggaggcctggccctgaccg

SEQ ID NO: 4864 - DNA, 20 bp, synthetic construct
  misc_feature 1..20: note = CRISPR gRNA sequence
  source 1..20: mol_type = other DNA
gccctgaccgagacctgggc

SEQ ID NO: 4865 - DNA, 20 bp, synthetic construct
  misc_feature 1..20: note = CRISPR gRNA sequence
  source 1..20: mol_type = other DNA
accgagacctgggcctgtga

SEQ ID NO: 4866 - DNA, 20 bp, synthetic construct
  misc_feature 1..20: note = CRISPR gRNA sequence
  source 1..20: mol_type = other DNA
ggcctgtgagtgcggggttg

SEQ ID NO: 4867 - DNA, 20 bp, synthetic construct
  misc_feature 1..20: note = CRISPR gRNA sequence
  source 1..20: mol_type = other DNA
tgagtgcggggttgggaggg

SEQ ID NO: 4868 - DNA, 20 bp, synthetic construct
  misc_feature 1..20: note = CRISPR gRNA sequence
  source 1..20: mol_type = other DNA
ggagggaagcggcctctgcg

SEQ ID NO: 4869 - DNA, 20 bp, synthetic construct
  misc_feature 1..20: note = CRISPR gRNA sequence
  source 1..20: mol_type = other DNA
tgcggagaggagcgaggggc

SEQ ID NO: 4870 - DNA, 20 bp, synthetic construct
  misc_feature 1..20: note = CRISPR gRNA sequence
  source 1..20: mol_type = other DNA
cggagaggagcgaggggccc

SEQ ID NO: 4871 - DNA, 20 bp, synthetic construct
  misc_feature 1..20: note = CRISPR gRNA sequence
  source 1..20: mol_type = other DNA
agcccctcctcgcccccagg

SEQ ID NO: 4872 - DNA, 20 bp, synthetic construct
  misc_feature 1..20: note = CRISPR gRNA sequence
  source 1..20: mol_type = other DNA
ctcgcccccaggctcccact

SEQ ID NO: 4873 - DNA, 20 bp, synthetic construct
  misc_feature 1..20: note = CRISPR gRNA sequence
  source 1..20: mol_type = other DNA
gcccccaggctcccactcca

SEQ ID NO: 4874 - DNA, 20 bp, synthetic construct
  misc_feature 1..20: note = CRISPR gRNA sequence
  source 1..20: mol_type = other DNA
ccactccatgaggtatttcg

SEQ ID NO: 4875 - DNA, 20 bp, synthetic construct
  misc_feature 1..20: note = CRISPR gRNA sequence
  source 1..20: mol_type = other DNA
catgaggtatttcgacaccg

SEQ ID NO: 4876 - DNA, 20 bp, synthetic construct
  misc_feature 1..20: note = CRISPR gRNA sequence
  source 1..20: mol_type = other DNA
cgacaccgccgtgtcccggc

SEQ ID NO: 4877 - DNA, 20 bp, synthetic construct
  misc_feature 1..20: note = CRISPR gRNA sequence
  source 1..20: mol_type = other DNA
gacaccgccgtgtcccggcc

SEQ ID NO: 4878 - DNA, 20 bp, synthetic construct
  misc_feature 1..20: note = CRISPR gRNA sequence
  source 1..20: mol_type = other DNA
catctcagtgggctacgtgg

SEQ ID NO: 4879 - DNA, 20 bp, synthetic construct
  misc_feature 1..20: note = CRISPR gRNA sequence
  source 1..20: mol_type = other DNA
atctcagtgggctacgtgga

SEQ ID NO: 4880 - DNA, 20 bp, synthetic construct
  misc_feature 1..20: note = CRISPR gRNA sequence
  source 1..20: mol_type = other DNA
agtgggctacgtggacgaca

SEQ ID NO: 4881 - DNA, 20 bp, synthetic construct
  misc_feature 1..20: note = CRISPR gRNA sequence
  source 1..20: mol_type = other DNA
cgtggacgacacgcagttcg

SEQ ID NO: 4882 - DNA, 20 bp, synthetic construct
  misc_feature 1..20: note = CRISPR gRNA sequence
  source 1..20: mol_type = other DNA
gtgcggttcgacagcgacgc

SEQ ID NO: 4883 - DNA, 20 bp, synthetic construct
  misc_feature 1..20: note = CRISPR gRNA sequence
  source 1..20: mol_type = other DNA
gacagcgacgccgcgagtcc

SEQ ID NO: 4884 - DNA, 20 bp, synthetic construct
  misc_feature 1..20: note = CRISPR gRNA sequence
  source 1..20: mol_type = other DNA
ggaccgggagacacagaact

SEQ ID NO: 4885 - DNA, 20 bp, synthetic construct
  misc_feature 1..20: note = CRISPR gRNA sequence
  source 1..20: mol_type = other DNA
caagcgccaggcacaggctg

SEQ ID NO: 4886 - DNA, 20 bp, synthetic construct
  misc_feature 1..20: note = CRISPR gRNA sequence
  source 1..20: mol_type = other DNA
accgagtgagcctgcggaac

SEQ ID NO: 4887 - DNA, 20 bp, synthetic construct
  misc_feature 1..20: note = CRISPR gRNA sequence
  source 1..20: mol_type = other DNA
cggaacctgcgcggctacta

SEQ ID NO: 4888 - DNA, 20 bp, synthetic construct
  misc_feature 1..20: note = CRISPR gRNA sequence
  source 1..20: mol_type = other DNA
cgcggctactacaaccagag

SEQ ID NO: 4889 - DNA, 20 bp, synthetic construct
  misc_feature 1..20: note = CRISPR gRNA sequence
  source 1..20: mol_type = other DNA
ctacaaccagagcgaggacg

SEQ ID NO: 4890 - DNA, 20 bp, synthetic construct
  misc_feature 1..20: note = CRISPR gRNA sequence
  source 1..20: mol_type = other DNA
caaccagagcgaggacggtg

SEQ ID NO: 4891 - DNA, 20 bp, synthetic construct
  misc_feature 1..20: note = CRISPR gRNA sequence
  source 1..20: mol_type = other DNA
cccatcccccacggacggcc

SEQ ID NO: 4892 - DNA, 20 bp, synthetic construct
  misc_feature 1..20: note = CRISPR gRNA sequence
  source 1..20: mol_type = other DNA
cccgtctgagatccacccca

SEQ ID NO: 4893 - DNA, 20 bp, synthetic construct
  misc_feature 1..20: note = CRISPR gRNA sequence
  source 1..20: mol_type = other DNA
agatccaccccaaggtggat

SEQ ID NO: 4894 - DNA, 20 bp, synthetic construct
  misc_feature 1..20: note = CRISPR gRNA sequence
  source 1..20: mol_type = other DNA
cggaacccgcccagaccctc

SEQ ID NO: 4895 - DNA, 20 bp, synthetic construct
  misc_feature 1..20: note = CRISPR gRNA sequence
  source 1..20: mol_type = other DNA
gaccggagagagccccagtc

SEQ ID NO: 4896 - DNA, 20 bp, synthetic construct
  misc_feature 1..20: note = CRISPR gRNA sequence
  source 1..20: mol_type = other DNA
tacccggtttcattttcggt

SEQ ID NO: 4897 - DNA, 20 bp, synthetic construct
  misc_feature 1..20: note = CRISPR gRNA sequence
  source 1..20: mol_type = other DNA
acccggtttcattttcggtt

SEQ ID NO: 4898 - DNA, 20 bp, synthetic construct
  misc_feature 1..20: note = CRISPR gRNA sequence
  source 1..20: mol_type = other DNA
cccggtttcattttcggttt

SEQ ID NO: 4899 - DNA, 20 bp, synthetic construct
  misc_feature 1..20: note = CRISPR gRNA sequence
  source 1..20: mol_type = other DNA
cattttcggtttaggccaaa

SEQ ID NO: 4900 - DNA, 20 bp, synthetic construct
  misc_feature 1..20: note = CRISPR gRNA sequence
  source 1..20: mol_type = other DNA
attttcggtttaggccaaaa

SEQ ID NO: 4901 - DNA, 20 bp, synthetic construct
  misc_feature 1..20: note = CRISPR gRNA sequence
  source 1..20: mol_type = other DNA
tcggtttaggccaaaatccc

SEQ ID NO: 4902 - DNA, 20 bp, synthetic construct
  misc_feature 1..20: note = CRISPR gRNA sequence
  source 1..20: mol_type = other DNA
cggtttaggccaaaatcccc

SEQ ID NO: 4903 - DNA, 20 bp, synthetic construct
  misc_feature 1..20: note = CRISPR gRNA sequence
  source 1..20: mol_type = other DNA
ggtttaggccaaaatccccg

SEQ ID NO: 4904 - DNA, 20 bp, synthetic construct
  misc_feature 1..20: note = CRISPR gRNA sequence
  source 1..20: mol_type = other DNA
aggccaaaatccccgcgggt

SEQ ID NO: 4905 - DNA, 20 bp, synthetic construct
  misc_feature 1..20: note = CRISPR gRNA sequence
  source 1..20: mol_type = other DNA
ggccaaaatccccgcgggtt

SEQ ID NO: 4906 - DNA, 20 bp, synthetic construct
  misc_feature 1..20: note = CRISPR gRNA sequence
  source 1..20: mol_type = other DNA
gtcggggcggggcggggctc

SEQ ID NO: 4907 - DNA, 20 bp, synthetic construct
  misc_feature 1..20: note = CRISPR gRNA sequence
  source 1..20: mol_type = other DNA
gggggactgggctgaccgcg

SEQ ID NO: 4908 - DNA, 20 bp, synthetic construct
  misc_feature 1..20: note = CRISPR gRNA sequence
  source 1..20: mol_type = other DNA
ggctgaccgcgggggcgggg

SEQ ID NO: 4909 - DNA, 20 bp, synthetic construct
  misc_feature 1..20: note = CRISPR gRNA sequence
  source 1..20: mol_type = other DNA
accgcgggggcggggccagg

SEQ ID NO: 4910 - DNA, 20 bp, synthetic construct
  misc_feature 1..20: note = CRISPR gRNA sequence
  source 1..20: mol_type = other DNA
acaccctccagaggatgtat

SEQ ID NO: 4911 - DNA, 20 bp, synthetic construct
  misc_feature 1..20: note = CRISPR gRNA sequence
  source 1..20: mol_type = other DNA
cagaggatgtatggctgcga

SEQ ID NO: 4912 - DNA, 20 bp, synthetic construct
  misc_feature 1..20: note = CRISPR gRNA sequence
  source 1..20: mol_type = other DNA
cgacctggggcccgacgggc

SEQ ID NO: 4913 - DNA, 20 bp, synthetic construct
  misc_feature 1..20: note = CRISPR gRNA sequence
  source 1..20: mol_type = other DNA
gggcccgacgggcgcctcct

SEQ ID NO: 4914 - DNA, 20 bp, synthetic construct
  misc_feature 1..20: note = CRISPR gRNA sequence
  source 1..20: mol_type = other DNA
ctccgcgggtatgaccagtc

SEQ ID NO: 4915 - DNA, 20 bp, synthetic construct
  misc_feature 1..20: note = CRISPR gRNA sequence
  source 1..20: mol_type = other DNA
cgcgggtatgaccagtccgc

SEQ ID NO: 4916 - DNA, 20 bp, synthetic construct
  misc_feature 1..20: note = CRISPR gRNA sequence
  source 1..20: mol_type = other DNA
cgacggcaaggattacatcg

SEQ ID NO: 4917 - DNA, 20 bp, synthetic construct
  misc_feature 1..20: note = CRISPR gRNA sequence
  source 1..20: mol_type = other DNA
catcgccctgaacgaggacc

SEQ ID NO: 4918 - DNA, 20 bp, synthetic construct
  misc_feature 1..20: note = CRISPR gRNA sequence
  source 1..20: mol_type = other DNA
aacgaggacctgcgctcctg

SEQ ID NO: 4919 - DNA, 20 bp, synthetic construct
  misc_feature 1..20: note = CRISPR gRNA sequence
  source 1..20: mol_type = other DNA
cgctcctggaccgccgcgga

SEQ ID NO: 4920 - DNA, 20 bp, synthetic construct
  misc_feature 1..20: note = CRISPR gRNA sequence
  source 1..20: mol_type = other DNA
ctggaccgccgcggacaccg

SEQ ID NO: 4921 - DNA, 20 bp, synthetic construct
  misc_feature 1..20: note = CRISPR gRNA sequence
  source 1..20: mol_type = other DNA
gaccgccgcggacaccgcgg

SEQ ID NO: 4922 - DNA, 20 bp, synthetic construct
  misc_feature 1..20: note = CRISPR gRNA sequence
  source 1..20: mol_type = other DNA
agatcacccagcgcaagttg

SEQ ID NO: 4923 - DNA, 20 bp, synthetic construct
  misc_feature 1..20: note = CRISPR gRNA sequence
  source 1..20: mol_type = other DNA
gaggcggcccgtgcggcgga

SEQ ID NO: 4924 - DNA, 20 bp, synthetic construct
  misc_feature 1..20: note = CRISPR gRNA sequence
  source 1..20: mol_type = other DNA
agagcctacctggagggcac

SEQ ID NO: 4925 - DNA, 20 bp, synthetic construct
  misc_feature 1..20: note = CRISPR gRNA sequence
  source 1..20: mol_type = other DNA
cctggagggcacgtgcgtgg

SEQ ID NO: 4926 - DNA, 20 bp, synthetic construct
  misc_feature 1..20: note = CRISPR gRNA sequence
  source 1..20: mol_type = other DNA
gagggcacgtgcgtggagtg

SEQ ID NO: 4927 - DNA, 20 bp, synthetic construct
  misc_feature 1..20: note = CRISPR gRNA sequence
  source 1..20: mol_type = other DNA
cgcagatacctggagaacgg

SEQ ID NO: 4928 - DNA, 20 bp, synthetic construct
  misc_feature 1..20: note = CRISPR gRNA sequence
  source 1..20: mol_type = other DNA
gagaacgggaaggagacgct

SEQ ID NO: 4929 - DNA, 20 bp, synthetic construct
  misc_feature 1..20: note = CRISPR gRNA sequence
  source 1..20: mol_type = other DNA
cagcgcgcaggtaccagggg

SEQ ID NO: 4930 - DNA, 20 bp, synthetic construct
  misc_feature 1..20: note = CRISPR gRNA sequence
  source 1..20: mol_type = other DNA
ccccatctcctatagatctc

SEQ ID NO: 4931 - DNA, 20 bp, synthetic construct
  misc_feature 1..20: note = CRISPR gRNA sequence
  source 1..20: mol_type = other DNA
cccatctcctatagatctcc

SEQ ID NO: 4932 - DNA, 20 bp, synthetic construct
  misc_feature 1..20: note = CRISPR gRNA sequence
  source 1..20: mol_type = other DNA
ctatagatctcccgggatgg

SEQ ID NO: 4933 - DNA, 20 bp, synthetic construct
  misc_feature 1..20: note = CRISPR gRNA sequence
  source 1..20: mol_type = other DNA
tagatctcccgggatggcct

SEQ ID NO: 4934 - DNA, 20 bp, synthetic construct
  misc_feature 1..20: note = CRISPR gRNA sequence
  source 1..20: mol_type = other DNA
ccgggatggcctcccacgag

SEQ ID NO: 4935 - DNA, 20 bp, synthetic construct
  misc_feature 1..20: note = CRISPR gRNA sequence
  source 1..20: mol_type = other DNA
ccacgaggaggggaggaaaa

SEQ ID NO: 4936 - DNA, 20 bp, synthetic construct
  misc_feature 1..20: note = CRISPR gRNA sequence
  source 1..20: mol_type = other DNA
gaatatcgccctcccttgaa

SEQ ID NO: 4937 - DNA, 20 bp, synthetic construct
  misc_feature 1..20: note = CRISPR gRNA sequence
  source 1..20: mol_type = other DNA
ccttgaatggagaatggcat

SEQ ID NO: 4938 - DNA, 20 bp, synthetic construct
  misc_feature 1..20: note = CRISPR gRNA sequence
  source 1..20: mol_type = other DNA
gaatggagaatggcatgagt

SEQ ID NO: 4939 - DNA, 20 bp, synthetic construct
  misc_feature 1..20: note = CRISPR gRNA sequence
  source 1..20: mol_type = other DNA
aatggagaatggcatgagtt

SEQ ID NO: 4940 - DNA, 20 bp, synthetic construct
  misc_feature 1..20: note = CRISPR gRNA sequence
  source 1..20: mol_type = other DNA
tcctgagtttcctctgaggg

SEQ ID NO: 4941 - DNA, 20 bp, synthetic construct
  misc_feature 1..20: note = CRISPR gRNA sequence
  source 1..20: mol_type = other DNA
cctgagtttcctctgagggc

SEQ ID NO: 4942 - DNA, 20 bp, synthetic construct
  misc_feature 1..20: note = CRISPR gRNA sequence
  source 1..20: mol_type = other DNA
ctgagtttcctctgagggcc

SEQ ID NO: 4943 - DNA, 20 bp, synthetic construct
  misc_feature 1..20: note = CRISPR gRNA sequence
  source 1..20: mol_type = other DNA
agtttcctctgagggccccc

SEQ ID NO: 4944 - DNA, 20 bp, synthetic construct
  misc_feature 1..20: note = CRISPR gRNA sequence
  source 1..20: mol_type = other DNA
cctctgagggccccctctgc

SEQ ID NO: 4945 - DNA, 20 bp, synthetic construct
  misc_feature 1..20: note = CRISPR gRNA sequence
  source 1..20: mol_type = other DNA
ctctgagggccccctctgct

SEQ ID NO: 4946 - DNA, 20 bp, synthetic construct
  misc_feature 1..20: note = CRISPR gRNA sequence
  source 1..20: mol_type = other DNA
tgagggccccctctgctctc

SEQ ID NO: 4947 - DNA, 20 bp, synthetic construct
  misc_feature 1..20: note = CRISPR gRNA sequence
  source 1..20: mol_type = other DNA
agggccccctctgctctcta

SEQ ID NO: 4948 - DNA, 20 bp, synthetic construct
  misc_feature 1..20: note = CRISPR gRNA sequence
  source 1..20: mol_type = other DNA
tgctctctaggacaattaag

SEQ ID NO: 4949 - DNA, 20 bp, synthetic construct
  misc_feature 1..20: note = CRISPR gRNA sequence
  source 1..20: mol_type = other DNA
ctctctaggacaattaaggg

SEQ ID NO: 4950 - DNA, 20 bp, synthetic construct
  misc_feature 1..20: note = CRISPR gRNA sequence
  source 1..20: mol_type = other DNA
tctaggacaattaagggatg

SEQ ID NO: 4951 - DNA, 20 bp, synthetic construct
  misc_feature 1..20: note = CRISPR gRNA sequence
  source 1..20: mol_type = other DNA
taggacaattaagggatgaa

SEQ ID NO: 4952 - DNA, 20 bp, synthetic construct
  misc_feature 1..20: note = CRISPR gRNA sequence
  source 1..20: mol_type = other DNA
ggacaattaagggatgaagt

SEQ ID NO: 4953 - DNA, 20 bp, synthetic construct
  misc_feature 1..20: note = CRISPR gRNA sequence
  source 1..20: mol_type = other DNA
agggatgaagtctctgagga

SEQ ID NO: 4954 - DNA, 20 bp, synthetic construct
  misc_feature 1..20: note = CRISPR gRNA sequence
  source 1..20: mol_type = other DNA
tgaggaaatggaggggaaga

SEQ ID NO: 4955 - DNA, 20 bp, synthetic construct
  misc_feature 1..20: note = CRISPR gRNA sequence
  source 1..20: mol_type = other DNA
aggaaatggaggggaagaca

SEQ ID NO: 4956 - DNA, 20 bp, synthetic construct
  misc_feature 1..20: note = CRISPR gRNA sequence
  source 1..20: mol_type = other DNA
gaatactgatcaggggtctc

SEQ ID NO: 4957 - DNA, 20 bp, synthetic construct
  misc_feature 1..20: note = CRISPR gRNA sequence
  source 1..20: mol_type = other DNA
atcaggggtctcctttgacc

SEQ ID NO: 4958 - DNA, 20 bp, synthetic construct
  misc_feature 1..20: note = CRISPR gRNA sequence
  source 1..20: mol_type = other DNA
ctttgaccactttgaccact

SEQ ID NO: 4959 - DNA, 20 bp, synthetic construct
  misc_feature 1..20: note = CRISPR gRNA sequence
  source 1..20: mol_type = other DNA
tgaccactttgaccactgca

SEQ ID NO: 4960 - DNA, 20 bp, synthetic construct
  misc_feature 1..20: note = CRISPR gRNA sequence
  source 1..20: mol_type = other DNA
gaccactttgaccactgcag

SEQ ID NO: 4961 - DNA, 20 bp, synthetic construct
  misc_feature 1..20: note = CRISPR gRNA sequence
  source 1..20: mol_type = other DNA
accactttgaccactgcagc

SEQ ID NO: 4962 - DNA, 20 bp, synthetic construct
  misc_feature 1..20: note = CRISPR gRNA sequence
  source 1..20: mol_type = other DNA
tgaccactgcagcagctgtg

SEQ ID NO: 4963 - DNA, 20 bp, synthetic construct
  misc_feature 1..20: note = CRISPR gRNA sequence
  source 1..20: mol_type = other DNA
gaccactgcagcagctgtgg

SEQ ID NO: 4964 - DNA, 20 bp, synthetic construct
  misc_feature 1..20: note = CRISPR gRNA sequence
  source 1..20: mol_type = other DNA
accactgcagcagctgtggt

SEQ ID NO: 4965 - DNA, 20 bp, synthetic construct
  misc_feature 1..20: note = CRISPR gRNA sequence
  source 1..20: mol_type = other DNA
cagcagctgtggtcaggctg

SEQ ID NO: 4966 - DNA, 20 bp, synthetic construct
  misc_feature 1..20: note = CRISPR gRNA sequence
  source 1..20: mol_type = other DNA
tggtcaggctgctgaccttt

SEQ ID NO: 4967 - DNA, 20 bp, synthetic construct
  misc_feature 1..20: note = CRISPR gRNA sequence
  source 1..20: mol_type = other DNA
ctgacctttctctcaggcct

SEQ ID NO: 4968 - DNA, 20 bp, synthetic construct
  misc_feature 1..20: note = CRISPR gRNA sequence
  source 1..20: mol_type = other DNA
acctttctctcaggccttgt

SEQ ID NO: 4969 - DNA, 20 bp, synthetic construct
  misc_feature 1..20: note = CRISPR gRNA sequence
  source 1..20: mol_type = other DNA
tctctcaggccttgttctct

SEQ ID NO: 4970 - DNA, 20 bp, synthetic construct
  misc_feature 1..20: note = CRISPR gRNA sequence
  source 1..20: mol_type = other DNA
ctctcaggccttgttctctg

SEQ ID NO: 4971 - DNA, 20 bp, synthetic construct
  misc_feature 1..20: note = CRISPR gRNA sequence
  source 1..20: mol_type = other DNA
tctcaggccttgttctctgc

SEQ ID NO: 4972 - DNA, 20 bp, synthetic construct
  misc_feature 1..20: note = CRISPR gRNA sequence
  source 1..20: mol_type = other DNA
tcaggccttgttctctgcct

SEQ ID NO: 4973 - DNA, 20 bp, synthetic construct
  misc_feature 1..20: note = CRISPR gRNA sequence
  source 1..20: mol_type = other DNA
aggccttgttctctgcctca

SEQ ID NO: 4974 - DNA, 20 bp, synthetic construct
  misc_feature 1..20: note = CRISPR gRNA sequence
  source 1..20: mol_type = other DNA
gttctctgcctcacactcaa

SEQ ID NO: 4975 - DNA, 20 bp, synthetic construct
  misc_feature 1..20: note = CRISPR gRNA sequence
  source 1..20: mol_type = other DNA
ttctctgcctcacactcaat

SEQ ID NO: 4976 - DNA, 20 bp, synthetic construct
  misc_feature 1..20: note = CRISPR gRNA sequence
  source 1..20: mol_type = other DNA
tctgcctcacactcaatgtg

SEQ ID NO: 4977 - DNA, 20 bp, synthetic construct
  misc_feature 1..20: note = CRISPR gRNA sequence
  source 1..20: mol_type = other DNA
tgcctcacactcaatgtgtc

SEQ ID NO: 4978 - DNA, 20 bp, synthetic construct
  misc_feature 1..20: note = CRISPR gRNA sequence
  source 1..20: mol_type = other DNA
cctcacactcaatgtgtctg

SEQ ID NO: 4979 - DNA, 20 bp, synthetic construct
  misc_feature 1..20: note = CRISPR gRNA sequence
  source 1..20: mol_type = other DNA
acactcaatgtgtctgaagg

SEQ ID NO: 4980 - DNA, 20 bp, synthetic construct
  misc_feature 1..20: note = CRISPR gRNA sequence
  source 1..20: mol_type = other DNA
aatgtgtctgaaggtttgat

SEQ ID NO: 4981 - DNA, 20 bp, synthetic construct
  misc_feature 1..20: note = CRISPR gRNA sequence
  source 1..20: mol_type = other DNA
aaggtttgattccagctttt

SEQ ID NO: 4982 - DNA, 20 bp, synthetic construct
  misc_feature 1..20: note = CRISPR gRNA sequence
  source 1..20: mol_type = other DNA
gattccagcttttctgagtc

SEQ ID NO: 4983 - DNA, 20 bp, synthetic construct
  misc_feature 1..20: note = CRISPR gRNA sequence
  source 1..20: mol_type = other DNA
attccagcttttctgagtcc

SEQ ID NO: 4984 - DNA, 20 bp, synthetic construct
  misc_feature 1..20: note = CRISPR gRNA sequence
  source 1..20: mol_type = other DNA
cagcttttctgagtcctgca

SEQ ID NO: 4985 - DNA, 20 bp, synthetic construct
  misc_feature 1..20: note = CRISPR gRNA sequence
  source 1..20: mol_type = other DNA
ttctgagtcctgcagcctcc

SEQ ID NO: 4986 - DNA, 20 bp, synthetic construct
  misc_feature 1..20: note = CRISPR gRNA sequence
  source 1..20: mol_type = other DNA
tctgagtcctgcagcctcca

SEQ ID NO: 4987 - DNA, 20 bp, synthetic construct
  misc_feature 1..20: note = CRISPR gRNA sequence
  source 1..20: mol_type = other DNA
ctgagtcctgcagcctccac

SEQ ID NO: 4988 - DNA, 20 bp, synthetic construct
  misc_feature 1..20: note = CRISPR gRNA sequence
  source 1..20: mol_type = other DNA
tgagtcctgcagcctccact

SEQ ID NO: 4989 - DNA, 20 bp, synthetic construct
  misc_feature 1..20: note = CRISPR gRNA sequence
  source 1..20: mol_type = other DNA
agtcctgcagcctccactca

SEQ ID NO: 4990 - DNA, 20 bp, synthetic construct
  misc_feature 1..20: note = CRISPR gRNA sequence
  source 1..20: mol_type = other DNA
cagcctccactcaggtcagg

SEQ ID NO: 4991 - DNA, 20 bp, synthetic construct
  misc_feature 1..20: note = CRISPR gRNA sequence
  source 1..20: mol_type = other DNA
cactcaggtcaggaccagaa

SEQ ID NO: 4992 - DNA, 20 bp, synthetic construct
  misc_feature 1..20: note = CRISPR gRNA sequence
  source 1..20: mol_type = other DNA
aggtcaggaccagaagtcgc

SEQ ID NO: 4993 - DNA, 20 bp, synthetic construct
  misc_feature 1..20: note = CRISPR gRNA sequence
  source 1..20: mol_type = other DNA
ttcctccctcagagactaga

SEQ ID NO: 4994 - DNA, 20 bp, synthetic construct
  misc_feature 1..20: note = CRISPR gRNA sequence
  source 1..20: mol_type = other DNA
ctccctcagagactagaact

SEQ ID NO: 4995 - DNA, 20 bp, synthetic construct
  misc_feature 1..20: note = CRISPR gRNA sequence
  source 1..20: mol_type = other DNA
cctcagagactagaactttc

SEQ ID NO: 4996 - DNA, 20 bp, synthetic construct
  misc_feature 1..20: note = CRISPR gRNA sequence
  source 1..20: mol_type = other DNA
agagactagaactttccaat

SEQ ID NO: 4997 - DNA, 20 bp, synthetic construct
  misc_feature 1..20: note = CRISPR gRNA sequence
  source 1..20: mol_type = other DNA
gaactttccaatgaatagga

SEQ ID NO: 4998 - DNA, 20 bp, synthetic construct
  misc_feature 1..20: note = CRISPR gRNA sequence
  source 1..20: mol_type = other DNA
tccaatgaataggagattat

SEQ ID NO: 4999 - DNA, 20 bp, synthetic construct
  misc_feature 1..20: note = CRISPR gRNA sequence
  source 1..20: mol_type = other DNA
ccaatgaataggagattatc

SEQ ID NO: 5000 - DNA, 20 bp, synthetic construct
  misc_feature 1..20: note = CRISPR gRNA sequence
  source 1..20: mol_type = other DNA
caatgaataggagattatcc

SEQ ID NO: 5001 - DNA, 20 bp, synthetic construct
  misc_feature 1..20: note = CRISPR gRNA sequence
  source 1..20: mol_type = other DNA
tcccaggtgcctgtgtccag

SEQ ID NO: 5002 - DNA, 20 bp, synthetic construct
  misc_feature 1..20: note = CRISPR gRNA sequence
  source 1..20: mol_type = other DNA
tgtccaggctggcgtctggg

SEQ ID NO: 5003 - DNA, 20 bp, synthetic construct
  misc_feature 1..20: note = CRISPR gRNA sequence
  source 1..20: mol_type = other DNA
gcgtctgggttctgtgccgc

SEQ ID NO: 5004 - DNA, 20 bp, synthetic construct
  misc_feature 1..20: note = CRISPR gRNA sequence
  source 1..20: mol_type = other DNA
ggttctgtgccgccttcccc

SEQ ID NO: 5005 - DNA, 20 bp, synthetic construct
  misc_feature 1..20: note = CRISPR gRNA sequence
  source 1..20: mol_type = other DNA
tgtgccgccttccccacccc

SEQ ID NO: 5006 - DNA, 20 bp, synthetic construct
  misc_feature 1..20: note = CRISPR gRNA sequence
  source 1..20: mol_type = other DNA
tgccgccttccccaccccag

SEQ ID NO: 5007 - DNA, 20 bp, synthetic construct
  misc_feature 1..20: note = CRISPR gRNA sequence
  source 1..20: mol_type = other DNA
ccccaccccaggtgtcctgt

SEQ ID NO: 5008 - DNA, 20 bp, synthetic construct
  misc_feature 1..20: note = CRISPR gRNA sequence
  source 1..20: mol_type = other DNA
cccaccccaggtgtcctgtc

SEQ ID NO: 5009 - DNA, 20 bp, synthetic construct
  misc_feature 1..20: note = CRISPR gRNA sequence
  source 1..20: mol_type = other DNA
tccattctcaggatggtcac

SEQ ID NO: 5010 - DNA, 20 bp, synthetic construct
  misc_feature 1..20: note = CRISPR gRNA sequence
  source 1..20: mol_type = other DNA
tcaggatggtcacatgggcg

SEQ ID NO: 5011 - DNA, 20 bp, synthetic construct
  misc_feature 1..20: note = CRISPR gRNA sequence
  source 1..20: mol_type = other DNA
aggatggtcacatgggcgct

SEQ ID NO: 5012 - DNA, 20 bp, synthetic construct
  misc_feature 1..20: note = CRISPR gRNA sequence
  source 1..20: mol_type = other DNA
ctggagtgtcccaagagaga

SEQ ID NO: 5013 - DNA, 20 bp, synthetic construct
  misc_feature 1..20: note = CRISPR gRNA sequence
  source 1..20: mol_type = other DNA
gagtgtcccaagagagatgc

SEQ ID NO: 5014 - DNA, 20 bp, synthetic construct
  misc_feature 1..20: note = CRISPR gRNA sequence
  source 1..20: mol_type = other DNA
aattttctgactcttcccgt

SEQ ID NO: 5015 - DNA, 20 bp, synthetic construct
  misc_feature 1..20: note = CRISPR gRNA sequence
  source 1..20: mol_type = other DNA
tctgactcttcccgtcagaa

SEQ ID NO: 5016 - DNA, 20 bp, synthetic construct
  misc_feature 1..20: note = CRISPR gRNA sequence
  source 1..20: mol_type = other DNA
ctgactcttcccgtcagaac

SEQ ID NO: 5017 - DNA, 20 bp, synthetic construct
  misc_feature 1..20: note = CRISPR gRNA sequence
  source 1..20: mol_type = other DNA
tgactcttcccgtcagaacc

SEQ ID NO: 5018 - DNA, 20 bp, synthetic construct
  misc_feature 1..20: note = CRISPR gRNA sequence
  source 1..20: mol_type = other DNA
actcttcccgtcagaacccc

SEQ ID NO: 5019 - DNA, 20 bp, synthetic construct
  misc_feature 1..20: note = CRISPR gRNA sequence
  source 1..20: mol_type = other DNA
ttcccgtcagaacccccaaa

SEQ ID NO: 5020 - DNA, 20 bp, synthetic construct
  misc_feature 1..20: note = CRISPR gRNA sequence
  source 1..20: mol_type = other DNA
cccgtcagaacccccaaaga

SEQ ID NO: 5021 - DNA, 20 bp, synthetic construct
  misc_feature 1..20: note = CRISPR gRNA sequence
  source 1..20: mol_type = other DNA
ccgtcagaacccccaaagac

SEQ ID NO: 5022 - DNA, 20 bp, synthetic construct
  misc_feature 1..20: note = CRISPR gRNA sequence
  source 1..20: mol_type = other DNA
tctgaccatgaggccaccct

SEQ ID NO: 5023 - DNA, 20 bp, synthetic construct
  misc_feature 1..20: note = CRISPR gRNA sequence
  source 1..20: mol_type = other DNA
tgaccatgaggccaccctga

SEQ ID NO: 5024 - DNA, 20 bp, synthetic construct
  misc_feature 1..20: note = CRISPR gRNA sequence
  source 1..20: mol_type = other DNA
accatgaggccaccctgagg

SEQ ID NO: 5025 - DNA, 20 bp, synthetic construct
  misc_feature 1..20: note = CRISPR gRNA sequence
  source 1..20: mol_type = other DNA
aggtgctgggccctgggctt

SEQ ID NO: 5026 - DNA, 20 bp, synthetic construct
  misc_feature 1..20: note = CRISPR gRNA sequence
  source 1..20: mol_type = other DNA
ggccctgggcttctaccctg

SEQ ID NO: 5027 - DNA, 20 bp, synthetic construct
  misc_feature 1..20: note = CRISPR gRNA sequence
  source 1..20: mol_type = other DNA
ggcttctaccctgcggagat

SEQ ID NO: 5028 - DNA, 20 bp, synthetic construct
  misc_feature 1..20: note = CRISPR gRNA sequence
  source 1..20: mol_type = other DNA
ctaccctgcggagatcacac

SEQ ID NO: 5029 - DNA, 20 bp, synthetic construct
  misc_feature 1..20: note = CRISPR gRNA sequence
  source 1..20: mol_type = other DNA
taccctgcggagatcacact

SEQ ID NO: 5030 - DNA, 20 bp, synthetic construct
  misc_feature 1..20: note = CRISPR gRNA sequence
  source 1..20: mol_type = other DNA
ccctgcggagatcacactga

SEQ ID NO: 5031 - DNA, 20 bp, synthetic construct
  misc_feature 1..20: note = CRISPR gRNA sequence
  source 1..20: mol_type = other DNA
cggagatcacactgacctgg

SEQ ID NO: 5032 - DNA, 20 bp, synthetic construct
  misc_feature 1..20: note = CRISPR gRNA sequence
  source 1..20: mol_type = other DNA
acctggcagcgggatgggga

SEQ ID NO: 5033 - DNA, 20 bp, synthetic construct
  misc_feature 1..20: note = CRISPR gRNA sequence
  source 1..20: mol_type = other DNA
gcagcgggatggggaggacc

SEQ ID NO: 5034 - DNA, 20 bp, synthetic construct
  misc_feature 1..20: note = CRISPR gRNA sequence
  source 1..20: mol_type = other DNA
gtggagaccaggccagcagg

SEQ ID NO: 5035 - DNA, 20 bp, synthetic construct
  misc_feature 1..20: note = CRISPR gRNA sequence
  source 1..20: mol_type = other DNA
tggagaccaggccagcagga

SEQ ID NO: 5036 - DNA, 20 bp, synthetic construct
  misc_feature 1..20: note = CRISPR gRNA sequence
  source 1..20: mol_type = other DNA
ccagaagtgggcagctgtgg

SEQ ID NO: 5037 - DNA, 20 bp, synthetic construct
  misc_feature 1..20: note = CRISPR gRNA sequence
  source 1..20: mol_type = other DNA
cagaagtgggcagctgtggt

SEQ ID NO: 5038 - DNA, 20 bp, synthetic construct
  misc_feature 1..20: note = CRISPR gRNA sequence
  source 1..20: mol_type = other DNA
tggtggtgccttctggacaa

SEQ ID NO: 5039 - DNA, 20 bp, synthetic construct
  misc_feature 1..20: note = CRISPR gRNA sequence
  source 1..20: mol_type = other DNA
ctggacaagagcagagatac

SEQ ID NO: 5040 - DNA, 20 bp, synthetic construct
  misc_feature 1..20: note = CRISPR gRNA sequence
  source 1..20: mol_type = other DNA
tggacaagagcagagataca

SEQ ID NO: 5041 - DNA, 20 bp, synthetic construct
  misc_feature 1..20: note = CRISPR gRNA sequence
  source 1..20: mol_type = other DNA
gacaagagcagagatacacg

SEQ ID NO: 5042 - DNA, 20 bp, synthetic construct
  misc_feature 1..20: note = CRISPR gRNA sequence
  source 1..20: mol_type = other DNA
caagagcccctcaccctgag

SEQ ID NO: 5043 - DNA, 20 bp, synthetic construct
  misc_feature 1..20: note = CRISPR gRNA sequence
  source 1..20: mol_type = other DNA
accctgagctggggtaagga

SEQ ID NO: 5044 - DNA, 20 bp, synthetic construct
  misc_feature 1..20: note = CRISPR gRNA sequence
  source 1..20: mol_type = other DNA
agctggggtaaggaggggaa

SEQ ID NO: 5045 - DNA, 20 bp, synthetic construct
  misc_feature 1..20: note = CRISPR gRNA sequence
  source 1..20: mol_type = other DNA
gggtaaggaggggaatgggg

SEQ ID NO: 5046 - DNA, 20 bp, synthetic construct
  misc_feature 1..20: note = CRISPR gRNA sequence
  source 1..20: mol_type = other DNA
ttatcagagaaagcagaagt

SEQ ID NO: 5047 - DNA, 20 bp, synthetic construct
  misc_feature 1..20: note = CRISPR gRNA sequence
  source 1..20: mol_type = other DNA
atcagagaaagcagaagtcc

SEQ ID NO: 5048 - DNA, 20 bp, synthetic construct
  misc_feature 1..20: note = CRISPR gRNA sequence
  source 1..20: mol_type = other DNA
tcagagaaagcagaagtcct

SEQ ID NO: 5049 - DNA, 20 bp, synthetic construct
  misc_feature 1..20: note = CRISPR gRNA sequence
  source 1..20: mol_type = other DNA
ctggagcccttcagccgggt

SEQ ID NO: 5050 - DNA, 20 bp, synthetic construct
  misc_feature 1..20: note = CRISPR gRNA sequence
  source 1..20: mol_type = other DNA
tggagcccttcagccgggtc

SEQ ID NO: 5051 - DNA, 20 bp, synthetic construct
  misc_feature 1..20: note = CRISPR gRNA sequence
  source 1..20: mol_type = other DNA
gagcccttcagccgggtcag

SEQ ID NO: 5052 - DNA, 20 bp, synthetic construct
  misc_feature 1..20: note = CRISPR gRNA sequence
  source 1..20: mol_type = other DNA
cagccgggtcagggctgagg

SEQ ID NO: 5053 - DNA, 20 bp, synthetic construct
  misc_feature 1..20: note = CRISPR gRNA sequence
  source 1..20: mol_type = other DNA
agccgggtcagggctgaggc

SEQ ID NO: 5054 - DNA, 20 bp, synthetic construct
  misc_feature 1..20: note = CRISPR gRNA sequence
  source 1..20: mol_type = other DNA
aggcttgggggtcagggccc

SEQ ID NO: 5055 - DNA, 20 bp, synthetic construct
  misc_feature 1..20: note = CRISPR gRNA sequence
  source 1..20: mol_type = other DNA
gggggtcagggcccctcacc

SEQ ID NO: 5056 - DNA, 20 bp, synthetic construct
  misc_feature 1..20: note = CRISPR gRNA sequence
  source 1..20: mol_type = other DNA
ggggtcagggcccctcacct

SEQ ID NO: 5057 - DNA, 20 bp, synthetic construct
  misc_feature 1..20: note = CRISPR gRNA sequence
  source 1..20: mol_type = other DNA
accttctcctcctttcccag

SEQ ID NO: 5058 - DNA, 20 bp, synthetic construct
  misc_feature 1..20: note = CRISPR gRNA sequence
  source 1..20: mol_type = other DNA
ctcctcctttcccagagcca

SEQ ID NO: 5059 - DNA, 20 bp, synthetic construct
  misc_feature 1..20: note = CRISPR gRNA sequence
  source 1..20: mol_type = other DNA
tcctcctttcccagagccat

SEQ ID NO: 5060 - DNA, 20 bp, synthetic construct
  misc_feature 1..20: note = CRISPR gRNA sequence
  source 1..20: mol_type = other DNA
ctcctttcccagagccatct

SEQ ID NO: 5061 - DNA, 20 bp, synthetic construct
  misc_feature 1..20: note = CRISPR gRNA sequence
  source 1..20: mol_type = other DNA
ctttcccagagccatcttcc

SEQ ID NO: 5062 - DNA, 20 bp, synthetic construct
  misc_feature 1..20: note = CRISPR gRNA sequence
  source 1..20: mol_type = other DNA
tcccagagccatcttcccag

SEQ ID NO: 5063 - DNA, 20 bp, synthetic construct
  misc_feature 1..20: note = CRISPR gRNA sequence
  source 1..20: mol_type = other DNA
cccagagccatcttcccagc

SEQ ID NO: 5064 - DNA, 20 bp, synthetic construct
  misc_feature 1..20: note = CRISPR gRNA sequence
  source 1..20: mol_type = other DNA
ccagagccatcttcccagcc

SEQ ID NO: 5065 - DNA, 20 bp, synthetic construct
  misc_feature 1..20: note = CRISPR gRNA sequence
  source 1..20: mol_type = other DNA
cccagcccaccatccccatc

SEQ ID NO: 5066 - DNA, 20 bp, synthetic construct
  misc_feature 1..20: note = CRISPR gRNA sequence
  source 1..20: mol_type = other DNA
ccagcccaccatccccatca

SEQ ID NO: 5067 - DNA, 20 bp, synthetic construct
  misc_feature 1..20: note = CRISPR gRNA sequence
  source 1..20: mol_type = other DNA
ctggcctggctgtcctggtt

SEQ ID NO: 5068 - DNA, 20 bp, synthetic construct
  misc_feature 1..20: note = CRISPR gRNA sequence
  source 1..20: mol_type = other DNA
gcctggctgtcctggttgtc

SEQ ID NO: 5069 - DNA, 20 bp, synthetic construct
  misc_feature 1..20: note = CRISPR gRNA sequence
  source 1..20: mol_type = other DNA
gctgtcctggttgtcctagc

SEQ ID NO: 5070 - DNA, 20 bp, synthetic construct
  misc_feature 1..20: note = CRISPR gRNA sequence
  source 1..20: mol_type = other DNA
tcctggttgtcctagctgtc

SEQ ID NO: 5071 - DNA, 20 bp, synthetic construct
  misc_feature 1..20: note = CRISPR gRNA sequence
  source 1..20: mol_type = other DNA
gttgtcctagctgtccttgg

SEQ ID NO: 5072 - DNA, 20 bp, synthetic construct
  misc_feature 1..20: note = CRISPR gRNA sequence
  source 1..20: mol_type = other DNA
tcctagctgtccttggagct

SEQ ID NO: 5073 - DNA, 20 bp, synthetic construct
  misc_feature 1..20: note = CRISPR gRNA sequence
  source 1..20: mol_type = other DNA
gctgtccttggagctgtggt

SEQ ID NO: 5074 - DNA, 20 bp, synthetic construct
  misc_feature 1..20: note = CRISPR gRNA sequence
  source 1..20: mol_type = other DNA
tccttggagctgtggtcacc

SEQ ID NO: 5075 - DNA, 20 bp, synthetic construct
  misc_feature 1..20: note = CRISPR gRNA sequence
  source 1..20: mol_type = other DNA
ggagctgtggtcaccgctat

SEQ ID NO: 5076 - DNA, 20 bp, synthetic construct
  misc_feature 1..20: note = CRISPR gRNA sequence
  source 1..20: mol_type = other DNA
gagctgtggtcaccgctatg

SEQ ID NO: 5077 - DNA, 20 bp, synthetic construct
  misc_feature 1..20: note = CRISPR gRNA sequence
  source 1..20: mol_type = other DNA
tggtcaccgctatgatgtgt

SEQ ID NO: 5078 - DNA, 20 bp, synthetic construct
  misc_feature 1..20: note = CRISPR gRNA sequence
  source 1..20: mol_type = other DNA
tgatgtgtaggaggaagagc

SEQ ID NO: 5079 - DNA, 20 bp, synthetic construct
  misc_feature 1..20: note = CRISPR gRNA sequence
  source 1..20: mol_type = other DNA
aggtagggaaggggtgaaga

SEQ ID NO: 5080 - DNA, 20 bp, synthetic construct
  misc_feature 1..20: note = CRISPR gRNA sequence
  source 1..20: mol_type = other DNA
ggttttcttgtcccactggg

SEQ ID NO: 5081 - DNA, 20 bp, synthetic construct
  misc_feature 1..20: note = CRISPR gRNA sequence
  source 1..20: mol_type = other DNA
tcttgtcccactgggagttt

SEQ ID NO: 5082 - DNA, 20 bp, synthetic construct
  misc_feature 1..20: note = CRISPR gRNA sequence
  source 1..20: mol_type = other DNA
cttgtcccactgggagtttc

SEQ ID NO: 5083 - DNA, 20 bp, synthetic construct
  misc_feature 1..20: note = CRISPR gRNA sequence
  source 1..20: mol_type = other DNA
ttgtcccactgggagtttca

SEQ ID NO: 5084 - DNA, 20 bp, synthetic construct
  misc_feature 1..20: note = CRISPR gRNA sequence
  source 1..20: mol_type = other DNA
gtcccactgggagtttcaag

SEQ ID NO: 5085 - DNA, 20 bp, synthetic construct
  misc_feature 1..20: note = CRISPR gRNA sequence
  source 1..20: mol_type = other DNA
tcccactgggagtttcaagc

SEQ ID NO: 5086 - DNA, 20 bp, synthetic construct
  misc_feature 1..20: note = CRISPR gRNA sequence
  source 1..20: mol_type = other DNA
ggagtttcaagccccaggta

SEQ ID NO: 5087 - DNA, 20 bp, synthetic construct
  misc_feature 1..20: note = CRISPR gRNA sequence
  source 1..20: mol_type = other DNA
caagccccaggtagaagtgt

SEQ ID NO: 5088 - DNA, 20 bp, synthetic construct
  misc_feature 1..20: note = CRISPR gRNA sequence
  source 1..20: mol_type = other DNA
aagccccaggtagaagtgtg

SEQ ID NO: 5089 - DNA, 20 bp, synthetic construct
  misc_feature 1..20: note = CRISPR gRNA sequence
  source 1..20: mol_type = other DNA
gttactggaagcaccatcca

SEQ ID NO: 5090 - DNA, 20 bp, synthetic construct
  misc_feature 1..20: note = CRISPR gRNA sequence
  source 1..20: mol_type = other DNA
ttactggaagcaccatccac

SEQ ID NO: 5091 - DNA, 20 bp, synthetic construct
  misc_feature 1..20: note = CRISPR gRNA sequence
  source 1..20: mol_type = other DNA
ctggaagcaccatccacaca

SEQ ID NO: 5092 - DNA, 20 bp, synthetic construct
  misc_feature 1..20: note = CRISPR gRNA sequence
  source 1..20: mol_type = other DNA
gaagcaccatccacacatgg

SEQ ID NO: 5093 - DNA, 20 bp, synthetic construct
  misc_feature 1..20: note = CRISPR gRNA sequence
  source 1..20: mol_type = other DNA
ggaccctgtgtgccagcact

SEQ ID NO: 5094 - DNA, 20 bp, synthetic construct
  misc_feature 1..20: note = CRISPR gRNA sequence
  source 1..20: mol_type = other DNA
tgtgccagcacttactcttt

SEQ ID NO: 5095 - DNA, 20 bp, synthetic construct
  misc_feature 1..20: note = CRISPR gRNA sequence
  source 1..20: mol_type = other DNA
actcttttgtgaagcacatg

SEQ ID NO: 5096 - DNA, 20 bp, synthetic construct
  misc_feature 1..20: note = CRISPR gRNA sequence
  source 1..20: mol_type = other DNA
ctcttttgtgaagcacatgt

SEQ ID NO: 5097 - DNA, 20 bp, synthetic construct
  misc_feature 1..20: note = CRISPR gRNA sequence
  source 1..20: mol_type = other DNA
ttttgtgaagcacatgtgac

SEQ ID NO: 5098 - DNA, 20 bp, synthetic construct
  misc_feature 1..20: note = CRISPR gRNA sequence
  source 1..20: mol_type = other DNA
ttgtgaagcacatgtgacaa

SEQ ID NO: 5099 - DNA, 20 bp, synthetic construct
  misc_feature 1..20: note = CRISPR gRNA sequence
  source 1..20: mol_type = other DNA
tgtgaagcacatgtgacaat

SEQ ID NO: 5100 - DNA, 20 bp, synthetic construct
  misc_feature 1..20: note = CRISPR gRNA sequence
  source 1..20: mol_type = other DNA
gtgaagcacatgtgacaatg

SEQ ID NO: 5101 - DNA, 20 bp, synthetic construct
  misc_feature 1..20: note = CRISPR gRNA sequence
  source 1..20: mol_type = other DNA
tgaagcacatgtgacaatga

SEQ ID NO: 5102 - DNA, 20 bp, synthetic construct
  misc_feature 1..20: note = CRISPR gRNA sequence
  source 1..20: mol_type = other DNA
gatgattatggtgttggggt

SEQ ID NO: 5103 - DNA, 20 bp, synthetic construct
  misc_feature 1..20: note = CRISPR gRNA sequence
  source 1..20: mol_type = other DNA
atgattatggtgttggggtc

SEQ ID NO: 5104 - DNA, 20 bp, synthetic construct
  misc_feature 1..20: note = CRISPR gRNA sequence
  source 1..20: mol_type = other DNA
tggtgttggggtcctgattc

SEQ ID NO: 5105 - DNA, 20 bp, synthetic construct
  misc_feature 1..20: note = CRISPR gRNA sequence
  source 1..20: mol_type = other DNA
gggtcctgattccagcattc

SEQ ID NO: 5106 - DNA, 20 bp, synthetic construct
  misc_feature 1..20: note = CRISPR gRNA sequence
  source 1..20: mol_type = other DNA
attccagcattcatgagtca

SEQ ID NO: 5107 - DNA, 20 bp, synthetic construct
  misc_feature 1..20: note = CRISPR gRNA sequence
  source 1..20: mol_type = other DNA
cagcattcatgagtcagggg

SEQ ID NO: 5108 - DNA, 20 bp, synthetic construct
  misc_feature 1..20: note = CRISPR gRNA sequence
  source 1..20: mol_type = other DNA
atgagtcaggggaaggtccc

SEQ ID NO: 5109 - DNA, 20 bp, synthetic construct
  misc_feature 1..20: note = CRISPR gRNA sequence
  source 1..20: mol_type = other DNA
ctaaggacagaccttaggag

SEQ ID NO: 5110 - DNA, 20 bp, synthetic construct
  misc_feature 1..20: note = CRISPR gRNA sequence
  source 1..20: mol_type = other DNA
aggacagaccttaggagggc

SEQ ID NO: 5111 - DNA, 20 bp, synthetic construct
  misc_feature 1..20: note = CRISPR gRNA sequence
  source 1..20: mol_type = other DNA
aggagggcagttggtccaga

SEQ ID NO: 5112 - DNA, 20 bp, synthetic construct
  misc_feature 1..20: note = CRISPR gRNA sequence
  source 1..20: mol_type = other DNA
ggagggcagttggtccagaa

SEQ ID NO: 5113 - DNA, 20 bp, synthetic construct
  misc_feature 1..20: note = CRISPR gRNA sequence
  source 1..20: mol_type = other DNA
gtccagaacccacaactgct

SEQ ID NO: 5114 - DNA, 20 bp, synthetic construct
  misc_feature 1..20: note = CRISPR gRNA sequence
  source 1..20: mol_type = other DNA
ctttccccatgtttcctgat

SEQ ID NO: 5115 - DNA, 20 bp, synthetic construct
  misc_feature 1..20: note = CRISPR gRNA sequence
  source 1..20: mol_type = other DNA
tccccatgtttcctgatcct

SEQ ID NO: 5116 - DNA, 20 bp, synthetic construct
  misc_feature 1..20: note = CRISPR gRNA sequence
  source 1..20: mol_type = other DNA
ccccatgtttcctgatcctg

SEQ ID NO: 5117 - DNA, 20 bp, synthetic construct
  misc_feature 1..20: note = CRISPR gRNA sequence
  source 1..20: mol_type = other DNA
cccatgtttcctgatcctgc

SEQ ID NO: 5118 - DNA, 20 bp, synthetic construct
  misc_feature 1..20: note = CRISPR gRNA sequence
  source 1..20: mol_type = other DNA
cctgatcctgccctgggtct

SEQ ID NO: 5119 - DNA, 20 bp, synthetic construct
  misc_feature 1..20: note = CRISPR gRNA sequence
  source 1..20: mol_type = other DNA
ctgatcctgccctgggtctg

SEQ ID NO: 5120 - DNA, 20 bp, synthetic construct
  misc_feature 1..20: note = CRISPR gRNA sequence
  source 1..20: mol_type = other DNA
atcctgccctgggtctgcag

SEQ ID NO: 5121 - DNA, 20 bp, synthetic construct
  misc_feature 1..20: note = CRISPR gRNA sequence
  source 1..20: mol_type = other DNA
ccctgggtctgcagtcgtag

SEQ ID NO: 5122 - DNA, 20 bp, synthetic construct
  misc_feature 1..20: note = CRISPR gRNA sequence
  source 1..20: mol_type = other DNA
ggtctgcagtcgtagttctg

SEQ ID NO: 5123 - DNA, 20 bp, synthetic construct
  misc_feature 1..20: note = CRISPR gRNA sequence
  source 1..20: mol_type = other DNA
cagtcgtagttctggaaact

SEQ ID NO: 5124 - DNA, 20 bp, synthetic construct
  misc_feature 1..20: note = CRISPR gRNA sequence
  source 1..20: mol_type = other DNA
tggaaacttctcttgggtcc

SEQ ID NO: 5125 - DNA, 20 bp, synthetic construct
  misc_feature 1..20: note = CRISPR gRNA sequence
  source 1..20: mol_type = other DNA
gaaacttctcttgggtccaa

SEQ ID NO: 5126 - DNA, 20 bp, synthetic construct
  misc_feature 1..20: note = CRISPR gRNA sequence
  source 1..20: mol_type = other DNA
ctcttgggtccaagactagg

SEQ ID NO: 5127 - DNA, 20 bp, synthetic construct
  misc_feature 1..20: note = CRISPR gRNA sequence
  source 1..20: mol_type = other DNA
tcttgggtccaagactagga

SEQ ID NO: 5128 - DNA, 20 bp, synthetic construct
  misc_feature 1..20: note = CRISPR gRNA sequence
  source 1..20: mol_type = other DNA
ttgggtccaagactaggagg

SEQ ID NO: 5129 - DNA, 20 bp, synthetic construct
  misc_feature 1..20: note = CRISPR gRNA sequence
  source 1..20: mol_type = other DNA
gggtccaagactaggaggtt

SEQ ID NO: 5130 - DNA, 20 bp, synthetic construct
  misc_feature 1..20: note = CRISPR gRNA sequence
  source 1..20: mol_type = other DNA
ggtccaagactaggaggttc

SEQ ID NO: 5131 - DNA, 20 bp, synthetic construct
  misc_feature 1..20: note = CRISPR gRNA sequence
  source 1..20: mol_type = other DNA
ggaggttcccctaagatcac

SEQ ID NO: 5132 - DNA, 20 bp, synthetic construct
  misc_feature 1..20: note = CRISPR gRNA sequence
  source 1..20: mol_type = other DNA
ccctaagatcacatggccct

SEQ ID NO: 5133 - DNA, 20 bp, synthetic construct
  misc_feature 1..20: note = CRISPR gRNA sequence
  source 1..20: mol_type = other DNA
agatcacatggccctgcctc

SEQ ID NO: 5134 - DNA, 20 bp, synthetic construct
  misc_feature 1..20: note = CRISPR gRNA sequence
  source 1..20: mol_type = other DNA
cctcctcccagtcccctcat

SEQ ID NO: 5135 - DNA, 20 bp, synthetic construct
  misc_feature 1..20: note = CRISPR gRNA sequence
  source 1..20: mol_type = other DNA
ctcccagtcccctcataggg

SEQ ID NO: 5136 - DNA, 20 bp, synthetic construct
  misc_feature 1..20: note = CRISPR gRNA sequence
  source 1..20: mol_type = other DNA
ccagtcccctcatagggcat

SEQ ID NO: 5137 - DNA, 20 bp, synthetic construct
  misc_feature 1..20: note = CRISPR gRNA sequence
  source 1..20: mol_type = other DNA
atagggcattttcttcccac

SEQ ID NO: 5138 - DNA, 20 bp, synthetic construct
  misc_feature 1..20: note = CRISPR gRNA sequence
  source 1..20: mol_type = other DNA
tcttcccacaggtggaaaag

SEQ ID NO: 5139 - DNA, 20 bp, synthetic construct
  misc_feature 1..20: note = CRISPR gRNA sequence
  source 1..20: mol_type = other DNA
cttcccacaggtggaaaagg

SEQ ID NO: 5140 - DNA, 20 bp, synthetic construct
  misc_feature 1..20: note = CRISPR gRNA sequence
  source 1..20: mol_type = other DNA
ttcccacaggtggaaaagga

SEQ ID NO: 5141 - DNA, 20 bp, synthetic construct
  misc_feature 1..20: note = CRISPR gRNA sequence
  source 1..20: mol_type = other DNA
cccacaggtggaaaaggagg

SEQ ID NO: 5142 - DNA, 20 bp, synthetic construct
  misc_feature 1..20: note = CRISPR gRNA sequence
  source 1..20: mol_type = other DNA
ccacaggtggaaaaggaggg

SEQ ID NO: 5143 - DNA, 20 bp, synthetic construct
  misc_feature 1..20: note = CRISPR gRNA sequence
  source 1..20: mol_type = other DNA
ctctcaggctgcgtgtaagt

SEQ ID NO: 5144 - DNA, 20 bp, synthetic construct
  misc_feature 1..20: note = CRISPR gRNA sequence
  source 1..20: mol_type = other DNA
tcaggctgcgtgtaagtgat

SEQ ID NO: 5145 - DNA, 20 bp, synthetic construct
  misc_feature 1..20: note = CRISPR gRNA sequence
  source 1..20: mol_type = other DNA
aggctgcgtgtaagtgatgg

SEQ ID NO: 5146 - DNA, 20 bp, synthetic construct
  misc_feature 1..20: note = CRISPR gRNA sequence
  source 1..20: mol_type = other DNA
cgtgtaagtgatggcggcgg

SEQ ID NO: 5147 - DNA, 20 bp, synthetic construct
  misc_feature 1..20: note = CRISPR gRNA sequence
  source 1..20: mol_type = other DNA
acctactccataattcctct

SEQ ID NO: 5148 - DNA, 20 bp, synthetic construct
  misc_feature 1..20: note = CRISPR gRNA sequence
  source 1..20: mol_type = other DNA
ctccataattcctcttgtcc

SEQ ID NO: 5149 - DNA, 20 bp, synthetic construct
  misc_feature 1..20: note = CRISPR gRNA sequence
  source 1..20: mol_type = other DNA
cataattcctcttgtcccac

SEQ ID NO: 5150 - DNA, 20 bp, synthetic construct
  misc_feature 1..20: note = CRISPR gRNA sequence
  source 1..20: mol_type = other DNA
ctcttgtcccacatctcctg

SEQ ID NO: 5151 - DNA, 20 bp, synthetic construct
  misc_feature 1..20: note = CRISPR gRNA sequence
  source 1..20: mol_type = other DNA
ttgtcccacatctcctgcgg

SEQ ID NO: 5152 - DNA, 20 bp, synthetic construct
  misc_feature 1..20: note = CRISPR gRNA sequence
  source 1..20: mol_type = other DNA
gtcccacatctcctgcgggc

SEQ ID NO: 5153 - DNA, 20 bp, synthetic construct
  misc_feature 1..20: note = CRISPR gRNA sequence
  source 1..20: mol_type = other DNA
tcccacatctcctgcgggct

SEQ ID NO: 5154 - DNA, 20 bp, synthetic construct
  misc_feature 1..20: note = CRISPR gRNA sequence
  source 1..20: mol_type = other DNA
ctgcgggctctgaccaggtc

SEQ ID NO: 5155 - DNA, 20 bp, synthetic construct
  misc_feature 1..20: note = CRISPR gRNA sequence
  source 1..20: mol_type = other DNA
cgggctctgaccaggtcttt

SEQ ID NO: 5156 - DNA, 20 bp, synthetic construct
  misc_feature 1..20: note = CRISPR gRNA sequence
  source 1..20: mol_type = other DNA
tgaccaggtctttttttttg

SEQ ID NO: 5157 - DNA, 20 bp, synthetic construct
  misc_feature 1..20: note = CRISPR gRNA sequence
  source 1..20: mol_type = other DNA
accaggtctttttttttgtt

SEQ ID NO: 5158 - DNA, 20 bp, synthetic construct
  misc_feature 1..20: note = CRISPR gRNA sequence
  source 1..20: mol_type = other DNA
tttttttgttctaccccagg

SEQ ID NO: 5159 - DNA, 20 bp, synthetic construct
  misc_feature 1..20: note = CRISPR gRNA sequence
  source 1..20: mol_type = other DNA
ttttttgttctaccccaggc

SEQ ID NO: 5160 - DNA, 20 bp, synthetic construct
  misc_feature 1..20: note = CRISPR gRNA sequence
  source 1..20: mol_type = other DNA
tttttgttctaccccaggca

SEQ ID NO: 5161 - DNA, 20 bp, synthetic construct
  misc_feature 1..20: note = CRISPR gRNA sequence
  source 1..20: mol_type = other DNA
ttttgttctaccccaggcag

SEQ ID NO: 5162 - DNA, 20 bp, synthetic construct
  misc_feature 1..20: note = CRISPR gRNA sequence
  source 1..20: mol_type = other DNA
tttgttctaccccaggcagc

SEQ ID NO: 5163 - DNA, 20 bp, synthetic construct
  misc_feature 1..20: note = CRISPR gRNA sequence
  source 1..20: mol_type = other DNA
ttgttctaccccaggcagca

SEQ ID NO: 5164 - DNA, 20 bp, synthetic construct
  misc_feature 1..20: note = CRISPR gRNA sequence
  source 1..20: mol_type = other DNA
tgttctaccccaggcagcaa

SEQ ID NO: 5165 - DNA, 20 bp, synthetic construct
  misc_feature 1..20: note = CRISPR gRNA sequence
  source 1..20: mol_type = other DNA
gttctaccccaggcagcaac

SEQ ID NO: 5166 - DNA, 20 bp, synthetic construct
  misc_feature 1..20: note = CRISPR gRNA sequence
  source 1..20: mol_type = other DNA
ttctaccccaggcagcaaca

SEQ ID NO: 5167 - DNA, 20 bp, synthetic construct
  misc_feature 1..20: note = CRISPR gRNA sequence
  source 1..20: mol_type = other DNA
taccccaggcagcaacagtg

SEQ ID NO: 5168 - DNA, 20 bp, synthetic construct
  misc_feature 1..20: note = CRISPR gRNA sequence
  source 1..20: mol_type = other DNA
ccccaggcagcaacagtgcc

SEQ ID NO: 5169 - DNA, 20 bp, synthetic construct
  misc_feature 1..20: note = CRISPR gRNA sequence
  source 1..20: mol_type = other DNA
tgatgagtctctcatcactt

SEQ ID NO: 5170 - DNA, 20 bp, synthetic construct
  misc_feature 1..20: note = CRISPR gRNA sequence
  source 1..20: mol_type = other DNA
atgagtctctcatcacttgt

SEQ ID NO: 5171 - DNA, 20 bp, synthetic construct
  misc_feature 1..20: note = CRISPR gRNA sequence
  source 1..20: mol_type = other DNA
tcatcacttgtaaaggtgag

SEQ ID NO: 5172 - DNA, 20 bp, synthetic construct
  misc_feature 1..20: note = CRISPR gRNA sequence
  source 1..20: mol_type = other DNA
atcacttgtaaaggtgagat

SEQ ID NO: 5173 - DNA, 20 bp, synthetic construct
  misc_feature 1..20: note = CRISPR gRNA sequence
  source 1..20: mol_type = other DNA
gtaaaggtgagattctgggg

SEQ ID NO: 5174 - DNA, 20 bp, synthetic construct
  misc_feature 1..20: note = CRISPR gRNA sequence
  source 1..20: mol_type = other DNA
taaaggtgagattctgggga

SEQ ID NO: 5175 - DNA, 20 bp, synthetic construct
  misc_feature 1..20: note = CRISPR gRNA sequence
  source 1..20: mol_type = other DNA
tggggagctgaagtggtcgg

SEQ ID NO: 5176 - DNA, 20 bp, synthetic construct
  misc_feature 1..20: note = CRISPR gRNA sequence
  source 1..20: mol_type = other DNA
gggagctgaagtggtcgggg

SEQ ID NO: 5177 - DNA, 20 bp, synthetic construct
  misc_feature 1..20: note = CRISPR gRNA sequence
  source 1..20: mol_type = other DNA
aagtggtcgggggtggggca

SEQ ID NO: 5178 - DNA, 20 bp, synthetic construct
  misc_feature 1..20: note = CRISPR gRNA sequence
  source 1..20: mol_type = other DNA
ggtaatggggattctttgat

SEQ ID NO: 5179 - DNA, 20 bp, synthetic construct
  misc_feature 1..20: note = CRISPR gRNA sequence
  source 1..20: mol_type = other DNA
tttgattgggacgtttcgag

SEQ ID NO: 5180 - DNA, 20 bp, synthetic construct
  misc_feature 1..20: note = CRISPR gRNA sequence
  source 1..20: mol_type = other DNA
tgattgggacgtttcgagtg

SEQ ID NO: 5181 - DNA, 20 bp, synthetic construct
  misc_feature 1..20: note = CRISPR gRNA sequence
  source 1..20: mol_type = other DNA
gattgggacgtttcgagtgt

SEQ ID NO: 5182 - DNA, 20 bp, synthetic construct
  misc_feature 1..20: note = CRISPR gRNA sequence
  source 1..20: mol_type = other DNA
attgggacgtttcgagtgtg

SEQ ID NO: 5183 - DNA, 20 bp, synthetic construct
  misc_feature 1..20: note = CRISPR gRNA sequence
  source 1..20: mol_type = other DNA
ggacgtttcgagtgtgtggt

SEQ ID NO: 5184 - DNA, 20 bp, synthetic construct
  misc_feature 1..20: note = CRISPR gRNA sequence
  source 1..20: mol_type = other DNA
cttctgagctgggcatccga

SEQ ID NO: 5185 - DNA, 20 bp, synthetic construct
  misc_feature 1..20: note = CRISPR gRNA sequence
  source 1..20: mol_type = other DNA
tgggcatccgaaggcatcct

SEQ ID NO: 5186 - DNA, 20 bp, synthetic construct
  misc_feature 1..20: note = CRISPR gRNA sequence
  source 1..20: mol_type = other DNA
gggcatccgaaggcatcctt

SEQ ID NO: 5187 - DNA, 20 bp, synthetic construct
  misc_feature 1..20: note = CRISPR gRNA sequence
  source 1..20: mol_type = other DNA
ggcatccgaaggcatccttg

SEQ ID NO: 5188 - DNA, 20 bp, synthetic construct
  misc_feature 1..20: note = CRISPR gRNA sequence
  source 1..20: mol_type = other DNA
atccgaaggcatccttgggg

SEQ ID NO: 5189 - DNA, 20 bp, synthetic construct
  misc_feature 1..20: note = CRISPR gRNA sequence
  source 1..20: mol_type = other DNA
aaggcatccttggggaagct

SEQ ID NO: 5190 - DNA, 20 bp, synthetic construct
  misc_feature 1..20: note = CRISPR gRNA sequence
  source 1..20: mol_type = other DNA
aggcatccttggggaagctg

SEQ ID NO: 5191 - DNA, 20 bp, synthetic construct
  misc_feature 1..20: note = CRISPR gRNA sequence
  source 1..20: mol_type = other DNA
ggcatccttggggaagctga

SEQ ID NO: 5192 - DNA, 20 bp, synthetic construct
  misc_feature 1..20: note = CRISPR gRNA sequence
  source 1..20: mol_type = other DNA
cttggggaagctgagggcac

SEQ ID NO: 5193 - DNA, 20 bp, synthetic construct
  misc_feature 1..20: note = CRISPR gRNA sequence
  source 1..20: mol_type = other DNA
ttggggaagctgagggcacg

SEQ ID NO: 5194 - DNA, 20 bp, synthetic construct
  misc_feature 1..20: note = CRISPR gRNA sequence
  source 1..20: mol_type = other DNA
ggggaagctgagggcacgag

SEQ ID NO: 5195 - DNA, 20 bp, synthetic construct
  misc_feature 1..20: note = CRISPR gRNA sequence
  source 1..20: mol_type = other DNA
gggaagctgagggcacgagg

SEQ ID NO: 5196 - DNA, 20 bp, synthetic construct
  misc_feature 1..20: note = CRISPR gRNA sequence
  source 1..20: mol_type = other DNA
ggaagctgagggcacgagga

SEQ ID NO: 5197 - DNA, 20 bp, synthetic construct
  misc_feature 1..20: note = CRISPR gRNA sequence
  source 1..20: mol_type = other DNA
gaagctgagggcacgaggag

SEQ ID NO: 5198 - DNA, 20 bp, synthetic construct
  misc_feature 1..20: note = CRISPR gRNA sequence
  source 1..20: mol_type = other DNA
agggcacgaggaggggctgc

SEQ ID NO: 5199 - DNA, 20 bp, synthetic construct
  misc_feature 1..20: note = CRISPR gRNA sequence
  source 1..20: mol_type = other DNA
gaggaggggctgccagactc

SEQ ID NO: 5200 - DNA, 20 bp, synthetic construct
  misc_feature 1..20: note = CRISPR gRNA sequence
  source 1..20: mol_type = other DNA
aggaggggctgccagactcc

SEQ ID NO: 5201 - DNA, 20 bp, synthetic construct
  misc_feature 1..20: note = CRISPR gRNA sequence
  source 1..20: mol_type = other DNA
gaggggctgccagactccgg

SEQ ID NO: 5202 - DNA, 20 bp, synthetic construct
  misc_feature 1..20: note = CRISPR gRNA sequence
  source 1..20: mol_type = other DNA
agactccgggagctgctgcc

SEQ ID NO: 5203 - DNA, 20 bp, synthetic construct
  misc_feature 1..20: note = CRISPR gRNA sequence
  source 1..20: mol_type = other DNA
tccgggagctgctgcctggc

SEQ ID NO: 5204 - DNA, 20 bp, synthetic construct
  misc_feature 1..20: note = CRISPR gRNA sequence
  source 1..20: mol_type = other DNA
ccgggagctgctgcctggct

SEQ ID NO: 5205 - DNA, 20 bp, synthetic construct
  misc_feature 1..20: note = CRISPR gRNA sequence
  source 1..20: mol_type = other DNA
ttcctacacaatgcgttgcc

SEQ ID NO: 5206 - DNA, 20 bp, synthetic construct
  misc_feature 1..20: note = CRISPR gRNA sequence
  source 1..20: mol_type = other DNA
tgcctggctccacgccctgc

SEQ ID NO: 5207 - DNA, 20 bp, synthetic construct
  misc_feature 1..20: note = CRISPR gRNA sequence
  source 1..20: mol_type = other DNA
gcctggctccacgccctgct

SEQ ID NO: 5208 - DNA, 20 bp, synthetic construct
  misc_feature 1..20: note = CRISPR gRNA sequence
  source 1..20: mol_type = other DNA
ccctgctgggtcctacctgt

SEQ ID NO: 5209 - DNA, 20 bp, synthetic construct
  misc_feature 1..20: note = CRISPR gRNA sequence
  source 1..20: mol_type = other DNA
ctgctgggtcctacctgtca

SEQ ID NO: 5210 - DNA, 20 bp, synthetic construct
  misc_feature 1..20: note = CRISPR gRNA sequence
  source 1..20: mol_type = other DNA
gtcctacctgtcagagcccc

SEQ ID NO: 5211 - DNA, 20 bp, synthetic construct
  misc_feature 1..20: note = CRISPR gRNA sequence
  source 1..20: mol_type = other DNA
tcctacctgtcagagcccca

SEQ ID NO: 5212 - DNA, 20 bp, synthetic construct
  misc_feature 1..20: note = CRISPR gRNA sequence
  source 1..20: mol_type = other DNA
tgtcagagccccaaggtaaa

SEQ ID NO: 5213 - DNA, 20 bp, synthetic construct
  misc_feature 1..20: note = CRISPR gRNA sequence
  source 1..20: mol_type = other DNA
gtcagagccccaaggtaaaa

SEQ ID NO: 5214 - DNA, 20 bp, synthetic construct
  misc_feature 1..20: note = CRISPR gRNA sequence
  source 1..20: mol_type = other DNA
gagccccaaggtaaaaaggc

SEQ ID NO: 5215 - DNA, 20 bp, synthetic construct
  misc_feature 1..20: note = CRISPR gRNA sequence
  source 1..20: mol_type = other DNA
agccccaaggtaaaaaggcc

SEQ ID NO: 5216 - DNA, 20 bp, synthetic construct
  misc_feature 1..20: note = CRISPR gRNA sequence
  source 1..20: mol_type = other DNA
ccaaggtaaaaaggccggga

SEQ ID NO: 5217 - DNA, 20 bp, synthetic construct
  misc_feature 1..20: note = CRISPR gRNA sequence
  source 1..20: mol_type = other DNA
gccgggaaagcatcttaatt

SEQ ID NO: 5218 - DNA, 20 bp, synthetic construct
  misc_feature 1..20: note = CRISPR gRNA sequence
  source 1..20: mol_type = other DNA
aagcatcttaatttagcgtg

SEQ ID NO: 5219 - DNA, 20 bp, synthetic construct
  misc_feature 1..20: note = CRISPR gRNA sequence
  source 1..20: mol_type = other DNA
cttaatttagcgtgcagtct

SEQ ID NO: 5220 - DNA, 20 bp, synthetic construct
  misc_feature 1..20: note = CRISPR gRNA sequence
  source 1..20: mol_type = other DNA
atttagcgtgcagtctcagc

SEQ ID NO: 5221 - DNA, 20 bp, synthetic construct
  misc_feature 1..20: note = CRISPR gRNA sequence
  source 1..20: mol_type = other DNA
ctcagctggtcctgccattc

SEQ ID NO: 5222 - DNA, 20 bp, synthetic construct
  misc_feature 1..20: note = CRISPR gRNA sequence
  source 1..20: mol_type = other DNA
gtcctgccattccagataaa

SEQ ID NO: 5223 - DNA, 20 bp, synthetic construct
  misc_feature 1..20: note = CRISPR gRNA sequence
  source 1..20: mol_type = other DNA
cctgccattccagataaaca

SEQ ID NO: 5224 - DNA, 20 bp, synthetic construct
  misc_feature 1..20: note = CRISPR gRNA sequence
  source 1..20: mol_type = other DNA
acagagaaaccattctgaat

SEQ ID NO: 5225 - DNA, 20 bp, synthetic construct
  misc_feature 1..20: note = CRISPR gRNA sequence
  source 1..20: mol_type = other DNA
cagagaaaccattctgaatt

SEQ ID NO: 5226 - DNA, 20 bp, synthetic construct
  misc_feature 1..20: note = CRISPR gRNA sequence
  source 1..20: mol_type = other DNA
agagaaaccattctgaattg

SEQ ID NO: 5227 - DNA, 20 bp, synthetic construct
  misc_feature 1..20: note = CRISPR gRNA sequence
  source 1..20: mol_type = other DNA
aaaccattctgaattgggga

SEQ ID NO: 5228 - DNA, 20 bp, synthetic construct
  misc_feature 1..20: note = CRISPR gRNA sequence
  source 1..20: mol_type = other DNA
aaccattctgaattggggat

SEQ ID NO: 5229 - DNA, 20 bp, synthetic construct
  misc_feature 1..20: note = CRISPR gRNA sequence
  source 1..20: mol_type = other DNA
accattctgaattggggatg

SEQ ID NO: 5230 - DNA, 20 bp, synthetic construct
  misc_feature 1..20: note = CRISPR gRNA sequence
  source 1..20: mol_type = other DNA
ccattctgaattggggatgg

SEQ ID NO: 5231 - DNA, 20 bp, synthetic construct
  misc_feature 1..20: note = CRISPR gRNA sequence
  source 1..20: mol_type = other DNA
tctgaattggggatgggggt

SEQ ID NO: 5232 - DNA, 20 bp, synthetic construct
  misc_feature 1..20: note = CRISPR gRNA sequence
  source 1..20: mol_type = other DNA
ctgaattggggatgggggtg

SEQ ID NO: 5233 - DNA, 20 bp, synthetic construct
  misc_feature 1..20: note = CRISPR gRNA sequence
  source 1..20: mol_type = other DNA
attggggatgggggtgagga

SEQ ID NO: 5234 - DNA, 20 bp, synthetic construct
  misc_feature 1..20: note = CRISPR gRNA sequence
  source 1..20: mol_type = other DNA
ttggggatgggggtgaggat

SEQ ID NO: 5235 - DNA, 20 bp, synthetic construct
  misc_feature 1..20: note = CRISPR gRNA sequence
  source 1..20: mol_type = other DNA
gatgggggtgaggatgggaa

SEQ ID NO: 5236 - DNA, 20 bp, synthetic construct
  misc_feature 1..20: note = CRISPR gRNA sequence
  source 1..20: mol_type = other DNA
atgggggtgaggatgggaac

SEQ ID NO: 5237 - DNA, 20 bp, synthetic construct
  misc_feature 1..20: note = CRISPR gRNA sequence
  source 1..20: mol_type = other DNA
gggggtgaggatgggaacag

SEQ ID NO: 5238 - DNA, 20 bp, synthetic construct
  misc_feature 1..20: note = CRISPR gRNA sequence
  source 1..20: mol_type = other DNA
aacaggagtctgtgtcctgc

SEQ ID NO: 5239 - DNA, 20 bp, synthetic construct
  misc_feature 1..20: note = CRISPR gRNA sequence
  source 1..20: mol_type = other DNA
acaggagtctgtgtcctgct

SEQ ID NO: 5240 - DNA, 20 bp, synthetic construct
  misc_feature 1..20: note = CRISPR gRNA sequence
  source 1..20: mol_type = other DNA
caggagtctgtgtcctgctg

SEQ ID NO: 5241 - DNA, 20 bp, synthetic construct
  misc_feature 1..20: note = CRISPR gRNA sequence
  source 1..20: mol_type = other DNA
gagtctgtgtcctgctgggg

SEQ ID NO: 5242 - DNA, 20 bp, synthetic construct
  misc_feature 1..20: note = CRISPR gRNA sequence
  source 1..20: mol_type = other DNA
agtctgtgtcctgctggggc

SEQ ID NO: 5243 - DNA, 20 bp, synthetic construct
  misc_feature 1..20: note = CRISPR gRNA sequence
  source 1..20: mol_type = other DNA
gtcctgctggggcaggccat

SEQ ID NO: 5244 - DNA, 20 bp, synthetic construct
  misc_feature 1..20: note = CRISPR gRNA sequence
  source 1..20: mol_type = other DNA
ctgctggggcaggccattgg

SEQ ID NO: 5245 - DNA, 20 bp, synthetic construct
  misc_feature 1..20: note = CRISPR gRNA sequence
  source 1..20: mol_type = other DNA
caggccattggaagatgtga

SEQ ID NO: 5246 - DNA, 20 bp, synthetic construct
  misc_feature 1..20: note = CRISPR gRNA sequence
  source 1..20: mol_type = other DNA
ggccattggaagatgtgaaa

SEQ ID NO: 5247 - DNA, 20 bp, synthetic construct
  misc_feature 1..20: note = CRISPR gRNA sequence
  source 1..20: mol_type = other DNA
agttgtctatttccttccac

SEQ ID NO: 5248 - DNA, 20 bp, synthetic construct
  misc_feature 1..20: note = CRISPR gRNA sequence
  source 1..20: mol_type = other DNA
ttgtctatttccttccaccg

SEQ ID NO: 5249 - DNA, 20 bp, synthetic construct
  misc_feature 1..20: note = CRISPR gRNA sequence
  source 1..20: mol_type = other DNA
tgtctatttccttccaccgg

SEQ ID NO: 5250 - DNA, 20 bp, synthetic construct
  misc_feature 1..20: note = CRISPR gRNA sequence
  source 1..20: mol_type = other DNA
gtctatttccttccaccgga

SEQ ID NO: 5251 - DNA, 20 bp, synthetic construct
  misc_feature 1..20: note = CRISPR gRNA sequence
  source 1..20: mol_type = other DNA
ctatttccttccaccggagg

SEQ ID NO: 5252 - DNA, 20 bp, synthetic construct
  misc_feature 1..20: note = CRISPR gRNA sequence
  source 1..20: mol_type = other DNA
cttccaccggagggagactt

SEQ ID NO: 5253 - DNA, 20 bp, synthetic construct
  misc_feature 1..20: note = CRISPR gRNA sequence
  source 1..20: mol_type = other DNA
ttccaccggagggagacttc

SEQ ID NO: 5254 - DNA, 20 bp, synthetic construct
  misc_feature 1..20: note = CRISPR gRNA sequence
  source 1..20: mol_type = other DNA
accggagggagacttcaggt

SEQ ID NO: 5255 - DNA, 20 bp, synthetic construct
  misc_feature 1..20: note = CRISPR gRNA sequence
  source 1..20: mol_type = other DNA
gagggagacttcaggtcagc

SEQ ID NO: 5256 - DNA, 20 bp, synthetic construct
  misc_feature 1..20: note = CRISPR gRNA sequence
  source 1..20: mol_type = other DNA
agggagacttcaggtcagcc

SEQ ID NO: 5257 - DNA, 20 bp, synthetic construct
  misc_feature 1..20: note = CRISPR gRNA sequence
  source 1..20: mol_type = other DNA
cttcaggtcagccaggtgtc

SEQ ID NO: 5258 - DNA, 20 bp, synthetic construct
  misc_feature 1..20: note = CRISPR gRNA sequence
  source 1..20: mol_type = other DNA
tcaggtcagccaggtgtctg

SEQ ID NO: 5259 - DNA, 20 bp, synthetic construct
  misc_feature 1..20: note = CRISPR gRNA sequence
  source 1..20: mol_type = other DNA
ctggagtatgaaccatgtat

SEQ ID NO: 5260 - DNA, 20 bp, synthetic construct
  misc_feature 1..20: note = CRISPR gRNA sequence
  source 1..20: mol_type = other DNA
gaaccatgtatcagcaccga

SEQ ID NO: 5261 - DNA, 20 bp, synthetic construct
  misc_feature 1..20: note = CRISPR gRNA sequence
  source 1..20: mol_type = other DNA
aaccatgtatcagcaccgaa

SEQ ID NO: 5262 - DNA, 20 bp, synthetic construct
  misc_feature 1..20: note = CRISPR gRNA sequence
  source 1..20: mol_type = other DNA
gtatcagcaccgaaaggttc

SEQ ID NO: 5263 - DNA, 20 bp, synthetic construct
  misc_feature 1..20: note = CRISPR gRNA sequence
  source 1..20: mol_type = other DNA
tcagcaccgaaaggttctag

SEQ ID NO: 5264 - DNA, 20 bp, synthetic construct
  misc_feature 1..20: note = CRISPR gRNA sequence
  source 1..20: mol_type = other DNA
caccgaaaggttctagaagt

SEQ ID NO: 5265 - DNA, 20 bp, synthetic construct
  misc_feature 1..20: note = CRISPR gRNA sequence
  source 1..20: mol_type = other DNA
ggttctagaagtcagacttt

SEQ ID NO: 5266 - DNA, 20 bp, synthetic construct
  misc_feature 1..20: note = CRISPR gRNA sequence
  source 1..20: mol_type = other DNA
gttctagaagtcagactttc

SEQ ID NO: 5267 - DNA, 20 bp, synthetic construct
  misc_feature 1..20: note = CRISPR gRNA sequence
  source 1..20: mol_type = other DNA
ctagaagtcagactttcggg

SEQ ID NO: 5268 - DNA, 20 bp, synthetic construct
  misc_feature 1..20: note = CRISPR gRNA sequence
  source 1..20: mol_type = other DNA
ggcagtgtgtcactaactct

SEQ ID NO: 5269 - DNA, 20 bp, synthetic construct
  misc_feature 1..20: note = CRISPR gRNA sequence
  source 1..20: mol_type = other DNA
gtcactaactctcagcatgc

SEQ ID NO: 5270 - DNA, 20 bp, synthetic construct
  misc_feature 1..20: note = CRISPR gRNA sequence
  source 1..20: mol_type = other DNA
taactctcagcatgctggcc

SEQ ID NO: 5271 - DNA, 20 bp, synthetic construct
  misc_feature 1..20: note = CRISPR gRNA sequence
  source 1..20: mol_type = other DNA
ctcagcatgctggcctggct

SEQ ID NO: 5272 - DNA, 20 bp, synthetic construct
  misc_feature 1..20: note = CRISPR gRNA sequence
  source 1..20: mol_type = other DNA
tgctggcctggctcggccca

SEQ ID NO: 5273 - DNA, 20 bp, synthetic construct
  misc_feature 1..20: note = CRISPR gRNA sequence
  source 1..20: mol_type = other DNA
ggcctggctcggcccacagc

SEQ ID NO: 5274 - DNA, 20 bp, synthetic construct
  misc_feature 1..20: note = CRISPR gRNA sequence
  source 1..20: mol_type = other DNA
gcctggctcggcccacagca

SEQ ID NO: 5275 - DNA, 20 bp, synthetic construct
  misc_feature 1..20: note = CRISPR gRNA sequence
  source 1..20: mol_type = other DNA
aaggtcttctcgcctccctt

SEQ ID NO: 5276 - DNA, 20 bp, synthetic construct
  misc_feature 1..20: note = CRISPR gRNA sequence
  source 1..20: mol_type = other DNA
aggtcttctcgcctcccttt

SEQ ID NO: 5277 - DNA, 20 bp, synthetic construct
  misc_feature 1..20: note = CRISPR gRNA sequence
  source 1..20: mol_type = other DNA
cctccctttgggtaaatact

SEQ ID NO: 5278 - DNA, 20 bp, synthetic construct
  misc_feature 1..20: note = CRISPR gRNA sequence
  source 1..20: mol_type = other DNA
ctccctttgggtaaatactg

SEQ ID NO: 5279 - DNA, 20 bp, synthetic construct
  misc_feature 1..20: note = CRISPR gRNA sequence
  source 1..20: mol_type = other DNA
tccctttgggtaaatactga

SEQ ID NO: 5280 - DNA, 20 bp, synthetic construct
  misc_feature 1..20: note = CRISPR gRNA sequence
  source 1..20: mol_type = other DNA
ccctttgggtaaatactgag

SEQ ID NO: 5281 - DNA, 20 bp, synthetic construct
  misc_feature 1..20: note = CRISPR gRNA sequence
  source 1..20: mol_type = other DNA
aatactgaggggtgcctctg

SEQ ID NO: 5282 - DNA, 20 bp, synthetic construct
  misc_feature 1..20: note = CRISPR gRNA sequence
  source 1..20: mol_type = other DNA
atactgaggggtgcctctgc

SEQ ID NO: 5283 - DNA, 20 bp, synthetic construct
  misc_feature 1..20: note = CRISPR gRNA sequence
  source 1..20: mol_type = other DNA
tgaggggtgcctctgcagga

SEQ ID NO: 5284 - DNA, 20 bp, synthetic construct
  misc_feature 1..20: note = CRISPR gRNA sequence
  source 1..20: mol_type = other DNA
gaggggtgcctctgcaggac

SEQ ID NO: 5285 - DNA, 20 bp, synthetic construct
  misc_feature 1..20: note = CRISPR gRNA sequence
  source 1..20: mol_type = other DNA
ctgcaggacgggacctctgc

SEQ ID NO: 5286 - DNA, 20 bp, synthetic construct
  misc_feature 1..20: note = CRISPR gRNA sequence
  source 1..20: mol_type = other DNA
gccagactccactccatacc

SEQ ID NO: 5287 - DNA, 20 bp, synthetic construct
  misc_feature 1..20: note = CRISPR gRNA sequence
  source 1..20: mol_type = other DNA
cagactccactccataccca

SEQ ID NO: 5288 - DNA, 20 bp, synthetic construct
  misc_feature 1..20: note = CRISPR gRNA sequence
  source 1..20: mol_type = other DNA
actccactccatacccagag

SEQ ID NO: 5289 - DNA, 20 bp, synthetic construct
  misc_feature 1..20: note = CRISPR gRNA sequence
  source 1..20: mol_type = other DNA
ccactccatacccagagaag

SEQ ID NO: 5290 - DNA, 20 bp, synthetic construct
  misc_feature 1..20: note = CRISPR gRNA sequence
  source 1..20: mol_type = other DNA
cactccatacccagagaagc

SEQ ID NO: 5291 - DNA, 20 bp, synthetic construct
  misc_feature 1..20: note = CRISPR gRNA sequence
  source 1..20: mol_type = other DNA
actccatacccagagaagca

SEQ ID NO: 5292 - DNA, 20 bp, synthetic construct
  misc_feature 1..20: note = CRISPR gRNA sequence
  source 1..20: mol_type = other DNA
agaagcagggaaaccaaaat

SEQ ID NO: 5293 - DNA, 20 bp, synthetic construct
  misc_feature 1..20: note = CRISPR gRNA sequence
  source 1..20: mol_type = other DNA
aagcagggaaaccaaaattg

SEQ ID NO: 5294 - DNA, 20 bp, synthetic construct
  misc_feature 1..20: note = CRISPR gRNA sequence
  source 1..20: mol_type = other DNA
agggaaaccaaaattggagt

SEQ ID NO: 5295 - DNA, 20 bp, synthetic construct
  misc_feature 1..20: note = CRISPR gRNA sequence
  source 1..20: mol_type = other DNA
ccaaaattggagtcagcctt

SEQ ID NO: 5296 - DNA, 20 bp, synthetic construct
  misc_feature 1..20: note = CRISPR gRNA sequence
  source 1..20: mol_type = other DNA
caaaattggagtcagccttg

SEQ ID NO: 5297 - DNA, 20 bp, synthetic construct
  misc_feature 1..20: note = CRISPR gRNA sequence
  source 1..20: mol_type = other DNA
ttggagtcagccttgaggtg

SEQ ID NO: 5298 - DNA, 20 bp, synthetic construct
  misc_feature 1..20: note = CRISPR gRNA sequence
  source 1..20: mol_type = other DNA
agccttgaggtgtagctgtt

SEQ ID NO: 5299 - DNA, 20 bp, synthetic construct
  misc_feature 1..20: note = CRISPR gRNA sequence
  source 1..20: mol_type = other DNA
aggtgtagctgttgagccct

SEQ ID NO: 5300 - DNA, 20 bp, synthetic construct
  misc_feature 1..20: note = CRISPR gRNA sequence
  source 1..20: mol_type = other DNA
tgtagctgttgagccctcag

SEQ ID NO: 5301 - DNA, 20 bp, synthetic construct
  misc_feature 1..20: note = CRISPR gRNA sequence
  source 1..20: mol_type = other DNA
gctgttgagccctcagcagc

SEQ ID NO: 5302 - DNA, 20 bp, synthetic construct
  misc_feature 1..20: note = CRISPR gRNA sequence
  source 1..20: mol_type = other DNA
ctgttgagccctcagcagct

SEQ ID NO: 5303 - DNA, 20 bp, synthetic construct
  misc_feature 1..20: note = CRISPR gRNA sequence
  source 1..20: mol_type = other DNA
tgttgagccctcagcagctg

SEQ ID NO: 5304 - DNA, 20 bp, synthetic construct
  misc_feature 1..20: note = CRISPR gRNA sequence
  source 1..20: mol_type = other DNA
ttgagccctcagcagctggg

SEQ ID NO: 5305 - DNA, 20 bp, synthetic construct
  misc_feature 1..20: note = CRISPR gRNA sequence
  source 1..20: mol_type = other DNA
gagccctcagcagctgggga

SEQ ID NO: 5306 - DNA, 20 bp, synthetic construct
  misc_feature 1..20: note = CRISPR gRNA sequence
  source 1..20: mol_type = other DNA
cctcagcagctggggagagc

SEQ ID NO: 5307 - DNA, 20 bp, synthetic construct
  misc_feature 1..20: note = CRISPR gRNA sequence
  source 1..20: mol_type = other DNA
cagcagctggggagagctgg

SEQ ID NO: 5308 - DNA, 20 bp, synthetic construct
  misc_feature 1..20: note = CRISPR gRNA sequence
  source 1..20: mol_type = other DNA
ggcggatgctgccctccccc

SEQ ID NO: 5309 - DNA, 20 bp, synthetic construct
  misc_feature 1..20: note = CRISPR gRNA sequence
  source 1..20: mol_type = other DNA
ccctccccccagtttcctaa

SEQ ID NO: 5310 - DNA, 20 bp, synthetic construct
  misc_feature 1..20: note = CRISPR gRNA sequence
  source 1..20: mol_type = other DNA
tcctaatggtgttgtttaaa

SEQ ID NO: 5311 - DNA, 20 bp, synthetic construct
  misc_feature 1..20: note = CRISPR gRNA sequence
  source 1..20: mol_type = other DNA
cctaatggtgttgtttaaaa

SEQ ID NO: 5312 - DNA, 20 bp, synthetic construct
  misc_feature 1..20: note = CRISPR gRNA sequence
  source 1..20: mol_type = other DNA
ctaatggtgttgtttaaaaa

SEQ ID NO: 5313 - DNA, 20 bp, synthetic construct
  misc_feature 1..20: note = CRISPR gRNA sequence
  source 1..20: mol_type = other DNA
tggtgttgtttaaaaagggt

SEQ ID NO: 5314 - DNA, 20 bp, synthetic construct
  misc_feature 1..20: note = CRISPR gRNA sequence
  source 1..20: mol_type = other DNA
ggtgttgtttaaaaagggtc

SEQ ID NO: 5315 - DNA, 20 bp, synthetic construct
  misc_feature 1..20: note = CRISPR gRNA sequence
  source 1..20: mol_type = other DNA
gtgttgtttaaaaagggtca

SEQ ID NO: 5316 - DNA, 20 bp, synthetic construct
  misc_feature 1..20: note = CRISPR gRNA sequence
  source 1..20: mol_type = other DNA
tgttgtttaaaaagggtcag

SEQ ID NO: 5317 - DNA, 20 bp, synthetic construct
  misc_feature 1..20: note = CRISPR gRNA sequence
  source 1..20: mol_type = other DNA
gtttaaaaagggtcagggga

SEQ ID NO: 5318 - DNA, 20 bp, synthetic construct
  misc_feature 1..20: note = CRISPR gRNA sequence
  source 1..20: mol_type = other DNA
tttaaaaagggtcaggggac

SEQ ID NO: 5319 - DNA, 20 bp, synthetic construct
  misc_feature 1..20: note = CRISPR gRNA sequence
  source 1..20: mol_type = other DNA
ttaaaaagggtcaggggacg

SEQ ID NO: 5320 - DNA, 20 bp, synthetic construct
  misc_feature 1..20: note = CRISPR gRNA sequence
  source 1..20: mol_type = other DNA
taaaaagggtcaggggacgg

SEQ ID NO: 5321 - DNA, 20 bp, synthetic construct
  misc_feature 1..20: note = CRISPR gRNA sequence
  source 1..20: mol_type = other DNA
agggtcaggggacgggggaa

SEQ ID NO: 5322 - DNA, 20 bp, synthetic construct
  misc_feature 1..20: note = CRISPR gRNA sequence
  source 1..20: mol_type = other DNA
tcaggggacgggggaacaga

SEQ ID NO: 5323 - DNA, 20 bp, synthetic construct
  misc_feature 1..20: note = CRISPR gRNA sequence
  source 1..20: mol_type = other DNA
ggggacgggggaacagatgg

SEQ ID NO: 5324 - DNA, 20 bp, synthetic construct
  misc_feature 1..20: note = CRISPR gRNA sequence
  source 1..20: mol_type = other DNA
gggacgggggaacagatggt

SEQ ID NO: 5325 - DNA, 20 bp, synthetic construct
  misc_feature 1..20: note = CRISPR gRNA sequence
  source 1..20: mol_type = other DNA
acgggggaacagatggtggg

SEQ ID NO: 5326 - DNA, 20 bp, synthetic construct
  misc_feature 1..20: note = CRISPR gRNA sequence
  source 1..20: mol_type = other DNA
gggggaacagatggtgggaa

SEQ ID NO: 5327 - DNA, 20 bp, synthetic construct
  misc_feature 1..20: note = CRISPR gRNA sequence
  source 1..20: mol_type = other DNA
aacagatggtgggaagagca

SEQ ID NO: 5328 - DNA, 20 bp, synthetic construct
  misc_feature 1..20: note = CRISPR gRNA sequence
  source 1..20: mol_type = other DNA
atggtgggaagagcacagtg

SEQ ID NO: 5329 - DNA, 20 bp, synthetic construct
  misc_feature 1..20: note = CRISPR gRNA sequence
  source 1..20: mol_type = other DNA
aagagcacagtgcagacacc

SEQ ID NO: 5330 - DNA, 20 bp, synthetic construct
  misc_feature 1..20: note = CRISPR gRNA sequence
  source 1..20: mol_type = other DNA
acagtgcagacacctggcac

SEQ ID NO: 5331 - DNA, 20 bp, synthetic construct
  misc_feature 1..20: note = CRISPR gRNA sequence
  source 1..20: mol_type = other DNA
gacacctggcaccggctctg

SEQ ID NO: 5332 - DNA, 20 bp, synthetic construct
  misc_feature 1..20: note = CRISPR gRNA sequence
  source 1..20: mol_type = other DNA
acacctggcaccggctctga

SEQ ID NO: 5333 - DNA, 20 bp, synthetic construct
  misc_feature 1..20: note = CRISPR gRNA sequence
  source 1..20: mol_type = other DNA
cctggcaccggctctgaagg

SEQ ID NO: 5334 - DNA, 20 bp, synthetic construct
  misc_feature 1..20: note = CRISPR gRNA sequence
  source 1..20: mol_type = other DNA
caccggctctgaaggcagca

SEQ ID NO: 5335 - DNA, 20 bp, synthetic construct
  misc_feature 1..20: note = CRISPR gRNA sequence
  source 1..20: mol_type = other DNA
cggctctgaaggcagcatgg

SEQ ID NO: 5336 - DNA, 20 bp, synthetic construct
  misc_feature 1..20: note = CRISPR gRNA sequence
  source 1..20: mol_type = other DNA
cagcatggcagctacaccgt

SEQ ID NO: 5337 - DNA, 20 bp, synthetic construct
  misc_feature 1..20: note = CRISPR gRNA sequence
  source 1..20: mol_type = other DNA
atggcagctacaccgttggc

SEQ ID NO: 5338 - DNA, 20 bp, synthetic construct
  misc_feature 1..20: note = CRISPR gRNA sequence
  source 1..20: mol_type = other DNA
tggcagctacaccgttggct

SEQ ID NO: 5339 - DNA, 20 bp, synthetic construct
  misc_feature 1..20: note = CRISPR gRNA sequence
  source 1..20: mol_type = other DNA
cagctacaccgttggctggg

SEQ ID NO: 5340 - DNA, 20 bp, synthetic construct
  misc_feature 1..20: note = CRISPR gRNA sequence
  source 1..20: mol_type = other DNA
agctacaccgttggctggga

SEQ ID NO: 5341 - DNA, 20 bp, synthetic construct
  misc_feature 1..20: note = CRISPR gRNA sequence
  source 1..20: mol_type = other DNA
gctacaccgttggctgggaa

SEQ ID NO: 5342 - DNA, 20 bp, synthetic construct
  misc_feature 1..20: note = CRISPR gRNA sequence
  source 1..20: mol_type = other DNA
ctgggaagggtgtgcccctg

SEQ ID NO: 5343 - DNA, 20 bp, synthetic construct
  misc_feature 1..20: note = CRISPR gRNA sequence
  source 1..20: mol_type = other DNA
ggaagggtgtgcccctgaag

SEQ ID NO: 5344 - DNA, 20 bp, synthetic construct
  misc_feature 1..20: note = CRISPR gRNA sequence
  source 1..20: mol_type = other DNA
aagaagtcgtttacattctc

SEQ ID NO: 5345 - DNA, 20 bp, synthetic construct
  misc_feature 1..20: note = CRISPR gRNA sequence
  source 1..20: mol_type = other DNA
cattctcgagtcaattttcc

SEQ ID NO: 5346 - DNA, 20 bp, synthetic construct
  misc_feature 1..20: note = CRISPR gRNA sequence
  source 1..20: mol_type = other DNA
ttctcgagtcaattttcctg

SEQ ID NO: 5347 - DNA, 20 bp, synthetic construct
  misc_feature 1..20: note = CRISPR gRNA sequence
  source 1..20: mol_type = other DNA
aattttcctggagtgtacaa

SEQ ID NO: 5348 - DNA, 20 bp, synthetic construct
  misc_feature 1..20: note = CRISPR gRNA sequence
  source 1..20: mol_type = other DNA
tggagtgtacaatggacctg

SEQ ID NO: 5349 - DNA, 20 bp, synthetic construct
  misc_feature 1..20: note = CRISPR gRNA sequence
  source 1..20: mol_type = other DNA
ggagtgtacaatggacctgt

SEQ ID NO: 5350 - DNA, 20 bp, synthetic construct
  misc_feature 1..20: note = CRISPR gRNA sequence
  source 1..20: mol_type = other DNA
tgtacaatggacctgtggga

SEQ ID NO: 5351 - DNA, 20 bp, synthetic construct
  misc_feature 1..20: note = CRISPR gRNA sequence
  source 1..20: mol_type = other DNA
ctgtgggaaagcctgtatga

SEQ ID NO: 5352 - DNA, 20 bp, synthetic construct
  misc_feature 1..20: note = CRISPR gRNA sequence
  source 1..20: mol_type = other DNA
tgtgggaaagcctgtatgaa

SEQ ID NO: 5353 - DNA, 20 bp, synthetic construct
  misc_feature 1..20: note = CRISPR gRNA sequence
  source 1..20: mol_type = other DNA
gtgggaaagcctgtatgaaa

SEQ ID NO: 5354 - DNA, 20 bp, synthetic construct
  misc_feature 1..20: note = CRISPR gRNA sequence
  source 1..20: mol_type = other DNA
ctgtatgaaagggtaatgat

SEQ ID NO: 5355 - DNA, 20 bp, synthetic construct
  misc_feature 1..20: note = CRISPR gRNA sequence
  source 1..20: mol_type = other DNA
tgtatgaaagggtaatgatg

SEQ ID NO: 5356 - DNA, 20 bp, synthetic construct
  misc_feature 1..20: note = CRISPR gRNA sequence
  source 1..20: mol_type = other DNA
gtatgaaagggtaatgatga

SEQ ID NO: 5357 - DNA, 20 bp, synthetic construct
  misc_feature 1..20: note = CRISPR gRNA sequence
  source 1..20: mol_type = other DNA
aagggtaatgatgagggacc

SEQ ID NO: 5358 - DNA, 20 bp, synthetic construct
  misc_feature 1..20: note = CRISPR gRNA sequence
  source 1..20: mol_type = other DNA
taatgatgagggacctagca

SEQ ID NO: 5359 - DNA, 20 bp, synthetic construct
  misc_feature 1..20: note = CRISPR gRNA sequence
  source 1..20: mol_type = other DNA
gcacagtgtccaatatttta

SEQ ID NO: 5360 - DNA, 20 bp, synthetic construct
  misc_feature 1..20: note = CRISPR gRNA sequence
  source 1..20: mol_type = other DNA
cacagtgtccaatattttat

SEQ ID NO: 5361 - DNA, 20 bp, synthetic construct
  misc_feature 1..20: note = CRISPR gRNA sequence
  source 1..20: mol_type = other DNA
gtccaatattttataggaac

SEQ ID NO: 5362 - DNA, 20 bp, synthetic construct
  misc_feature 1..20: note = CRISPR gRNA sequence
  source 1..20: mol_type = other DNA
attttataggaactggaatt

SEQ ID NO: 5363 - DNA, 20 bp, synthetic construct
  misc_feature 1..20: note = CRISPR gRNA sequence
  source 1..20: mol_type = other DNA
aggaactggaattgagctca

SEQ ID NO: 5364 - DNA, 20 bp, synthetic construct
  misc_feature 1..20: note = CRISPR gRNA sequence
  source 1..20: mol_type = other DNA
ggaactggaattgagctcat

SEQ ID NO: 5365 - DNA, 20 bp, synthetic construct
  misc_feature 1..20: note = CRISPR gRNA sequence
  source 1..20: mol_type = other DNA
aactggaattgagctcatag

SEQ ID NO: 5366 - DNA, 20 bp, synthetic construct
  misc_feature 1..20: note = CRISPR gRNA sequence
  source 1..20: mol_type = other DNA
tcataggagctcaattttat

SEQ ID NO: 5367 - DNA, 20 bp, synthetic construct
  misc_feature 1..20: note = CRISPR gRNA sequence
  source 1..20: mol_type = other DNA
tttattggcattgctgttgt

SEQ ID NO: 5368 - DNA, 20 bp, synthetic construct
  misc_feature 1..20: note = CRISPR gRNA sequence
  source 1..20: mol_type = other DNA
ttggcattgctgttgttgga

SEQ ID NO: 5369 - DNA, 20 bp, synthetic construct
  misc_feature 1..20: note = CRISPR gRNA sequence
  source 1..20: mol_type = other DNA
ttgctgttgttggatggtta

SEQ ID NO: 5370 - DNA, 20 bp, synthetic construct
  misc_feature 1..20: note = CRISPR gRNA sequence
  source 1..20: mol_type = other DNA
tgctgttgttggatggttaa

SEQ ID NO: 5371 - DNA, 20 bp, synthetic construct
  misc_feature 1..20: note = CRISPR gRNA sequence
  source 1..20: mol_type = other DNA
gctgttgttggatggttaaa

SEQ ID NO: 5372 - DNA, 20 bp, synthetic construct
  misc_feature 1..20: note = CRISPR gRNA sequence
  source 1..20: mol_type = other DNA
ctgttgttggatggttaaag

SEQ ID NO: 5373 - DNA, 20 bp, synthetic construct
  misc_feature 1..20: note = CRISPR gRNA sequence
  source 1..20: mol_type = other DNA
ttgttggatggttaaagggg

SEQ ID NO: 5374 - DNA, 20 bp, synthetic construct
  misc_feature 1..20: note = CRISPR gRNA sequence
  source 1..20: mol_type = other DNA
aggggtggtatcccttttct

SEQ ID NO: 5375 - DNA, 20 bp, synthetic construct
  misc_feature 1..20: note = CRISPR gRNA sequence
  source 1..20: mol_type = other DNA
tcagactcccctgaaatgta

SEQ ID NO: 5376 - DNA, 20 bp, synthetic construct
  misc_feature 1..20: note = CRISPR gRNA sequence
  source 1..20: mol_type = other DNA
tgtatggtttgctttgaacc

SEQ ID NO: 5377 - DNA, 20 bp, synthetic construct
  misc_feature 1..20: note = CRISPR gRNA sequence
  source 1..20: mol_type = other DNA
tatggtttgctttgaaccca

SEQ ID NO: 5378 - DNA, 20 bp, synthetic construct
  misc_feature 1..20: note = CRISPR gRNA sequence
  source 1..20: mol_type = other DNA
ttgaacccagagactgatga

SEQ ID NO: 5379 - DNA, 20 bp, synthetic construct
  misc_feature 1..20: note = CRISPR gRNA sequence
  source 1..20: mol_type = other DNA
tgaacccagagactgatgac

SEQ ID NO: 5380 - DNA, 20 bp, synthetic construct
  misc_feature 1..20: note = CRISPR gRNA sequence
  source 1..20: mol_type = other DNA
gagactgatgacaggtctgc

SEQ ID NO: 5381 - DNA, 20 bp, synthetic construct
  misc_feature 1..20: note = CRISPR gRNA sequence
  source 1..20: mol_type = other DNA
tgatgacaggtctgccggtg

SEQ ID NO: 5382 - DNA, 20 bp, synthetic construct
  misc_feature 1..20: note = CRISPR gRNA sequence
  source 1..20: mol_type = other DNA
gacaggtctgccggtgtggt

SEQ ID NO: 5383 - DNA, 20 bp, synthetic construct
  misc_feature 1..20: note = CRISPR gRNA sequence
  source 1..20: mol_type = other DNA
acaggtctgccggtgtggtt

SEQ ID NO: 5384 - DNA, 20 bp, synthetic construct
  misc_feature 1..20: note = CRISPR gRNA sequence
  source 1..20: mol_type = other DNA
tctgccggtgtggttgggtg

SEQ ID NO: 5385 - DNA, 20 bp, synthetic construct
  misc_feature 1..20: note = CRISPR gRNA sequence
  source 1..20: mol_type = other DNA
gtgtggttgggtgcagcctt

SEQ ID NO: 5386 - DNA, 20 bp, synthetic construct
  misc_feature 1..20: note = CRISPR gRNA sequence
  source 1..20: mol_type = other DNA
ggtgcagccttaagttgcta

SEQ ID NO: 5387 - DNA, 20 bp, synthetic construct
  misc_feature 1..20: note = CRISPR gRNA sequence
  source 1..20: mol_type = other DNA
gtgcagccttaagttgctac

SEQ ID NO: 5388 - DNA, 20 bp, synthetic construct
  misc_feature 1..20: note = CRISPR gRNA sequence
  source 1..20: mol_type = other DNA
agccttaagttgctacggga

SEQ ID NO: 5389 - DNA, 20 bp, synthetic construct
  misc_feature 1..20: note = CRISPR gRNA sequence
  source 1..20: mol_type = other DNA
aagttgctacgggaaagtgt

SEQ ID NO: 5390 - DNA, 20 bp, synthetic construct
  misc_feature 1..20: note = CRISPR gRNA sequence
  source 1..20: mol_type = other DNA
gttgctacgggaaagtgttg

SEQ ID NO: 5391 - DNA, 20 bp, synthetic construct
  misc_feature 1..20: note = CRISPR gRNA sequence
  source 1..20: mol_type = other DNA
ttgctacgggaaagtgttgg

SEQ ID NO: 5392 - DNA, 20 bp, synthetic construct
  misc_feature 1..20: note = CRISPR gRNA sequence
  source 1..20: mol_type = other DNA
tgctacgggaaagtgttgga

SEQ ID NO: 5393 - DNA, 20 bp, synthetic construct
  misc_feature 1..20: note = CRISPR gRNA sequence
  source 1..20: mol_type = other DNA
gctacgggaaagtgttggag

SEQ ID NO: 5394 - DNA, 20 bp, synthetic construct
  misc_feature 1..20: note = CRISPR gRNA sequence
  source 1..20: mol_type = other DNA
ctacgggaaagtgttggagg

SEQ ID NO: 5395 - DNA, 20 bp, synthetic construct
  misc_feature 1..20: note = CRISPR gRNA sequence
  source 1..20: mol_type = other DNA
acgggaaagtgttggagggg

SEQ ID NO: 5396 - DNA, 20 bp, synthetic construct
  misc_feature 1..20: note = CRISPR gRNA sequence
  source 1..20: mol_type = other DNA
ggaaagtgttggagggggag

SEQ ID NO: 5397 - DNA, 20 bp, synthetic construct
  misc_feature 1..20: note = CRISPR gRNA sequence
  source 1..20: mol_type = other DNA
agtgttggagggggagaagt

SEQ ID NO: 5398 - DNA, 20 bp, synthetic construct
  misc_feature 1..20: note = CRISPR gRNA sequence
  source 1..20: mol_type = other DNA
tgttggagggggagaagtca

SEQ ID NO: 5399 - DNA, 20 bp, synthetic construct
  misc_feature 1..20: note = CRISPR gRNA sequence
  source 1..20: mol_type = other DNA
gttggagggggagaagtcag

SEQ ID NO: 5400 - DNA, 20 bp, synthetic construct
  misc_feature 1..20: note = CRISPR gRNA sequence
  source 1..20: mol_type = other DNA
cttgccccctccctcaattc

SEQ ID NO: 5401 - DNA, 20 bp, synthetic construct
  misc_feature 1..20: note = CRISPR gRNA sequence
  source 1..20: mol_type = other DNA
cccctccctcaattccagat

SEQ ID NO: 5402 - DNA, 20 bp, synthetic construct
  misc_feature 1..20: note = CRISPR gRNA sequence
  source 1..20: mol_type = other DNA
ccctccctcaattccagatg

SEQ ID NO: 5403 - DNA, 20 bp, synthetic construct
  misc_feature 1..20: note = CRISPR gRNA sequence
  source 1..20: mol_type = other DNA
caattccagatgaggaaatt

SEQ ID NO: 5404 - DNA, 20 bp, synthetic construct
  misc_feature 1..20: note = CRISPR gRNA sequence
  source 1..20: mol_type = other DNA
aattccagatgaggaaattc

SEQ ID NO: 5405 - DNA, 20 bp, synthetic construct
  misc_feature 1..20: note = CRISPR gRNA sequence
  source 1..20: mol_type = other DNA
tgaggaaattcaggcctgaa

SEQ ID NO: 5406 - DNA, 20 bp, synthetic construct
  misc_feature 1..20: note = CRISPR gRNA sequence
  source 1..20: mol_type = other DNA
gaggaaattcaggcctgaaa

SEQ ID NO: 5407 - DNA, 20 bp, synthetic construct
  misc_feature 1..20: note = CRISPR gRNA sequence
  source 1..20: mol_type = other DNA
aggaaattcaggcctgaaaa

SEQ ID NO: 5408 - DNA, 20 bp, synthetic construct
  misc_feature 1..20: note = CRISPR gRNA sequence
  source 1..20: mol_type = other DNA
aattcaggcctgaaaaggga

SEQ ID NO: 5409 - DNA, 20 bp, synthetic construct
  misc_feature 1..20: note = CRISPR gRNA sequence
  source 1..20: mol_type = other DNA
aagggaaagtgaccacctca

SEQ ID NO: 5410 - DNA, 20 bp, synthetic construct
  misc_feature 1..20: note = CRISPR gRNA sequence
  source 1..20: mol_type = other DNA
cacctcaaagtctcatgcct

SEQ ID NO: 5411 - DNA, 20 bp, synthetic construct
  misc_feature 1..20: note = CRISPR gRNA sequence
  source 1..20: mol_type = other DNA
cctcaaagtctcatgccttg

SEQ ID NO: 5412 - DNA, 20 bp, synthetic construct
  misc_feature 1..20: note = CRISPR gRNA sequence
  source 1..20: mol_type = other DNA
ctcaaagtctcatgccttgg

SEQ ID NO: 5413 - DNA, 20 bp, synthetic construct
  misc_feature 1..20: note = CRISPR gRNA sequence
  source 1..20: mol_type = other DNA
gtctcatgccttggaggacc

SEQ ID NO: 5414 - DNA, 20 bp, synthetic construct
  misc_feature 1..20: note = CRISPR gRNA sequence
  source 1..20: mol_type = other DNA
tcatgccttggaggacccag

SEQ ID NO: 5415 - DNA, 20 bp, synthetic construct
  misc_feature 1..20: note = CRISPR gRNA sequence
  source 1..20: mol_type = other DNA
catgccttggaggacccagc

SEQ ID NO: 5416 - DNA, 20 bp, synthetic construct
  misc_feature 1..20: note = CRISPR gRNA sequence
  source 1..20: mol_type = other DNA
ggaggacccagcaggaatcc

SEQ ID NO: 5417 - DNA, 20 bp, synthetic construct
  misc_feature 1..20: note = CRISPR gRNA sequence
  source 1..20: mol_type = other DNA
aggaatccaagacctctgaa

SEQ ID NO: 5418 - DNA, 20 bp, synthetic construct
  misc_feature 1..20: note = CRISPR gRNA sequence
  source 1..20: mol_type = other DNA
ggaatccaagacctctgaaa

SEQ ID NO: 5419 - DNA, 20 bp, synthetic construct
  misc_feature 1..20: note = CRISPR gRNA sequence
  source 1..20: mol_type = other DNA
ccaagacctctgaaaaggac

SEQ ID NO: 5420 - DNA, 20 bp, synthetic construct
  misc_feature 1..20: note = CRISPR gRNA sequence
  source 1..20: mol_type = other DNA
agacctctgaaaaggaccgg

SEQ ID NO: 5421 - DNA, 20 bp, synthetic construct
  misc_feature 1..20: note = CRISPR gRNA sequence
  source 1..20: mol_type = other DNA
gacctctgaaaaggaccggc

SEQ ID NO: 5422 - DNA, 20 bp, synthetic construct
  misc_feature 1..20: note = CRISPR gRNA sequence
  source 1..20: mol_type = other DNA
acctctgaaaaggaccggca

SEQ ID NO: 5423 - DNA, 20 bp, synthetic construct
  misc_feature 1..20: note = CRISPR gRNA sequence
  source 1..20: mol_type = other DNA
gaccggcagggctcttgcca

SEQ ID NO: 5424 - DNA, 20 bp, synthetic construct
  misc_feature 1..20: note = CRISPR gRNA sequence
  source 1..20: mol_type = other DNA
ggcagggctcttgccacggc

SEQ ID NO: 5425 - DNA, 20 bp, synthetic construct
  misc_feature 1..20: note = CRISPR gRNA sequence
  source 1..20: mol_type = other DNA
gcagggctcttgccacggct

SEQ ID NO: 5426 - DNA, 20 bp, synthetic construct
  misc_feature 1..20: note = CRISPR gRNA sequence
  source 1..20: mol_type = other DNA
cagggctcttgccacggctg

SEQ ID NO: 5427 - DNA, 20 bp, synthetic construct
  misc_feature 1..20: note = CRISPR gRNA sequence
  source 1..20: mol_type = other DNA
agggctcttgccacggctgg

SEQ ID NO: 5428 - DNA, 20 bp, synthetic construct
  misc_feature 1..20: note = CRISPR gRNA sequence
  source 1..20: mol_type = other DNA
tcttgccacggctgggggtg

SEQ ID NO: 5429 - DNA, 20 bp, synthetic construct
  misc_feature 1..20: note = CRISPR gRNA sequence
  source 1..20: mol_type = other DNA
cacggctgggggtgtggtca

SEQ ID NO: 5430 - DNA, 20 bp, synthetic construct
  misc_feature 1..20: note = CRISPR gRNA sequence
  source 1..20: mol_type = other DNA
ggggtgtggtcatggtaaca

SEQ ID NO: 5431 - DNA, 20 bp, synthetic construct
  misc_feature 1..20: note = CRISPR gRNA sequence
  source 1..20: mol_type = other DNA
gggtgtggtcatggtaacac

SEQ ID NO: 5432 - DNA, 20 bp, synthetic construct
  misc_feature 1..20: note = CRISPR gRNA sequence
  source 1..20: mol_type = other DNA
taacacaggttttccatcca

SEQ ID NO: 5433 - DNA, 20 bp, synthetic construct
  misc_feature 1..20: note = CRISPR gRNA sequence
  source 1..20: mol_type = other DNA
cacaggttttccatccatgg

SEQ ID NO: 5434 - DNA, 20 bp, synthetic construct
  misc_feature 1..20: note = CRISPR gRNA sequence
  source 1..20: mol_type = other DNA
acaggttttccatccatgga

SEQ ID NO: 5435 - DNA, 20 bp, synthetic construct
  misc_feature 1..20: note = CRISPR gRNA sequence
  source 1..20: mol_type = other DNA
tccatccatggaaggtacct

SEQ ID NO: 5436 - DNA, 20 bp, synthetic construct
  misc_feature 1..20: note = CRISPR gRNA sequence
  source 1..20: mol_type = other DNA
ccatccatggaaggtacctg

SEQ ID NO: 5437 - DNA, 20 bp, synthetic construct
  misc_feature 1..20: note = CRISPR gRNA sequence
  source 1..20: mol_type = other DNA
catccatggaaggtacctga

SEQ ID NO: 5438 - DNA, 20 bp, synthetic construct
  misc_feature 1..20: note = CRISPR gRNA sequence
  source 1..20: mol_type = other DNA
agggattttctcttcctccc

SEQ ID NO: 5439 - DNA, 20 bp, synthetic construct
  misc_feature 1..20: note = CRISPR gRNA sequence
  source 1..20: mol_type = other DNA
gggattttctcttcctccct

SEQ ID NO: 5440 - DNA, 20 bp, synthetic construct
  misc_feature 1..20: note = CRISPR gRNA sequence
  source 1..20: mol_type = other DNA
ggattttctcttcctcccta

SEQ ID NO: 5441 - DNA, 20 bp, synthetic construct
  misc_feature 1..20: note = CRISPR gRNA sequence
  source 1..20: mol_type = other DNA
tttctcttcctccctagggc

SEQ ID NO: 5442 - DNA, 20 bp, synthetic construct
  misc_feature 1..20: note = CRISPR gRNA sequence
  source 1..20: mol_type = other DNA
ttcctccctagggccagcat

SEQ ID NO: 5443 - DNA, 20 bp, synthetic construct
  misc_feature 1..20: note = CRISPR gRNA sequence
  source 1..20: mol_type = other DNA
cctccctagggccagcatca

SEQ ID NO: 5444 - DNA, 20 bp, synthetic construct
  misc_feature 1..20: note = CRISPR gRNA sequence
  source 1..20: mol_type = other DNA
ctccctagggccagcatcag

SEQ ID NO: 5445 - DNA, 20 bp, synthetic construct
  misc_feature 1..20: note = CRISPR gRNA sequence
  source 1..20: mol_type = other DNA
ccctagggccagcatcagag

SEQ ID NO: 5446 - DNA, 20 bp, synthetic construct
  misc_feature 1..20: note = CRISPR gRNA sequence
  source 1..20: mol_type = other DNA
gccagcatcagaggagtgaa

SEQ ID NO: 5447 - DNA, 20 bp, synthetic construct
  misc_feature 1..20: note = CRISPR gRNA sequence
  source 1..20: mol_type = other DNA
catcagaggagtgaatagct

SEQ ID NO: 5448 - DNA, 20 bp, synthetic construct
  misc_feature 1..20: note = CRISPR gRNA sequence
  source 1..20: mol_type = other DNA
agaggagtgaatagctcagt

SEQ ID NO: 5449 - DNA, 20 bp, synthetic construct
  misc_feature 1..20: note = CRISPR gRNA sequence
  source 1..20: mol_type = other DNA
atagctcagttagctcatct

SEQ ID NO: 5450 - DNA, 20 bp, synthetic construct
  misc_feature 1..20: note = CRISPR gRNA sequence
  source 1..20: mol_type = other DNA
tagctcagttagctcatctc

SEQ ID NO: 5451 - DNA, 20 bp, synthetic construct
  misc_feature 1..20: note = CRISPR gRNA sequence
  source 1..20: mol_type = other DNA
agctcagttagctcatctca

SEQ ID NO: 5452 - DNA, 20 bp, synthetic construct
  misc_feature 1..20: note = CRISPR gRNA sequence
  source 1..20: mol_type = other DNA
gctcagttagctcatctcag

SEQ ID NO: 5453 - DNA, 20 bp, synthetic construct
  misc_feature 1..20: note = CRISPR gRNA sequence
  source 1..20: mol_type = other DNA
tctcaggggccatgtgccct

SEQ ID NO: 5454 - DNA, 20 bp, synthetic construct
  misc_feature 1..20: note = CRISPR gRNA sequence
  source 1..20: mol_type = other DNA
tcaggggccatgtgccctcg

SEQ ID NO: 5455 - DNA, 20 bp, synthetic construct
  misc_feature 1..20: note = CRISPR gRNA sequence
  source 1..20: mol_type = other DNA
caggggccatgtgccctcgg

SEQ ID NO: 5456 - DNA, 20 bp, synthetic construct
  misc_feature 1..20: note = CRISPR gRNA sequence
  source 1..20: mol_type = other DNA
gggccatgtgccctcggagg

SEQ ID NO: 5457 - DNA, 20 bp, synthetic construct
  misc_feature 1..20: note = CRISPR gRNA sequence
  source 1..20: mol_type = other DNA
gaggtggtttgccactttca

SEQ ID NO: 5458 - DNA, 20 bp, synthetic construct
  misc_feature 1..20: note = CRISPR gRNA sequence
  source 1..20: mol_type = other DNA
tggtttgccactttcacggt

SEQ ID NO: 5459 - DNA, 20 bp, synthetic construct
  misc_feature 1..20: note = CRISPR gRNA sequence
  source 1..20: mol_type = other DNA
gccactttcacggttggact

SEQ ID NO: 5460 - DNA, 20 bp, synthetic construct
  misc_feature 1..20: note = CRISPR gRNA sequence
  source 1..20: mol_type = other DNA
ctttcacggttggactgagt

SEQ ID NO: 5461 - DNA, 20 bp, synthetic construct
  misc_feature 1..20: note = CRISPR gRNA sequence
  source 1..20: mol_type = other DNA
ttcacggttggactgagttg

SEQ ID NO: 5462 - DNA, 20 bp, synthetic construct
  misc_feature 1..20: note = CRISPR gRNA sequence
  source 1..20: mol_type = other DNA
cacggttggactgagttgga

SEQ ID NO: 5463 - DNA, 20 bp, synthetic construct
  misc_feature 1..20: note = CRISPR gRNA sequence
  source 1..20: mol_type = other DNA
tggactgagttggagagaaa

SEQ ID NO: 5464 - DNA, 20 bp, synthetic construct
  misc_feature 1..20: note = CRISPR gRNA sequence
  source 1..20: mol_type = other DNA
gactgagttggagagaaaca

SEQ ID NO: 5465 - DNA, 20 bp, synthetic construct
  misc_feature 1..20: note = CRISPR gRNA sequence
  source 1..20: mol_type = other DNA
gagagaaacagagacccacc

SEQ ID NO: 5466 - DNA, 20 bp, synthetic construct
  misc_feature 1..20: note = CRISPR gRNA sequence
  source 1..20: mol_type = other DNA
agagaaacagagacccaccc

SEQ ID NO: 5467 - DNA, 20 bp, synthetic construct
  misc_feature 1..20: note = CRISPR gRNA sequence
  source 1..20: mol_type = other DNA
gagaaacagagacccaccca

SEQ ID NO: 5468 - DNA, 20 bp, synthetic construct
  misc_feature 1..20: note = CRISPR gRNA sequence
  source 1..20: mol_type = other DNA
agaaacagagacccacccag

SEQ ID NO: 5469 - DNA, 20 bp, synthetic construct
  misc_feature 1..20: note = CRISPR gRNA sequence
  source 1..20: mol_type = other DNA
aacagagacccacccagggg

SEQ ID NO: 5470 - DNA, 20 bp, synthetic construct
  misc_feature 1..20: note = CRISPR gRNA sequence
  source 1..20: mol_type = other DNA
acagagacccacccaggggt

SEQ ID NO: 5471 - DNA, 20 bp, synthetic construct
  misc_feature 1..20: note = CRISPR gRNA sequence
  source 1..20: mol_type = other DNA
cagagacccacccaggggtg

SEQ ID NO: 5472 - DNA, 20 bp, synthetic construct
  misc_feature 1..20: note = CRISPR gRNA sequence
  source 1..20: mol_type = other DNA
acccacccaggggtggggac

SEQ ID NO: 5473 - DNA, 20 bp, synthetic construct
  misc_feature 1..20: note = CRISPR gRNA sequence
  source 1..20: mol_type = other DNA
gggacaagctccctgcaact

SEQ ID NO: 5474 - DNA, 20 bp, synthetic construct
  misc_feature 1..20: note = CRISPR gRNA sequence
  source 1..20: mol_type = other DNA
ggacaagctccctgcaactc

SEQ ID NO: 5475 - DNA, 20 bp, synthetic construct
  misc_feature 1..20: note = CRISPR gRNA sequence
  source 1..20: mol_type = other DNA
tccctgcaactcaggacttg

SEQ ID NO: 5476 - DNA, 20 bp, synthetic construct
  misc_feature 1..20: note = CRISPR gRNA sequence
  source 1..20: mol_type = other DNA
gacttgcagatcacttgccc

SEQ ID NO: 5477 - DNA, 20 bp, synthetic construct
  misc_feature 1..20: note = CRISPR gRNA sequence
  source 1..20: mol_type = other DNA
ttgcagatcacttgcccaag

SEQ ID NO: 5478 - DNA, 20 bp, synthetic construct
  misc_feature 1..20: note = CRISPR gRNA sequence
  source 1..20: mol_type = other DNA
cacttgcccaagtggctccc

SEQ ID NO: 5479 - DNA, 20 bp, synthetic construct
  misc_feature 1..20: note = CRISPR gRNA sequence
  source 1..20: mol_type = other DNA
ccaagtggctccctagctcc

SEQ ID NO: 5480 - DNA, 20 bp, synthetic construct
  misc_feature 1..20: note = CRISPR gRNA sequence
  source 1..20: mol_type = other DNA
gctccctagctcctggctcc

SEQ ID NO: 5481 - DNA, 20 bp, synthetic construct
  misc_feature 1..20: note = CRISPR gRNA sequence
  source 1..20: mol_type = other DNA
ctagctcctggctcctggcc

SEQ ID NO: 5482 - DNA, 20 bp, synthetic construct
  misc_feature 1..20: note = CRISPR gRNA sequence
  source 1..20: mol_type = other DNA
tagctcctggctcctggccc

SEQ ID NO: 5483 - DNA, 20 bp, synthetic construct
  misc_feature 1..20: note = CRISPR gRNA sequence
  source 1..20: mol_type = other DNA
agctcctggctcctggcccg

SEQ ID NO: 5484 - DNA, 20 bp, synthetic construct
  misc_feature 1..20: note = CRISPR gRNA sequence
  source 1..20: mol_type = other DNA
ctggctcctggcccggggcc

SEQ ID NO: 5485 - DNA, 20 bp, synthetic construct
  misc_feature 1..20: note = CRISPR gRNA sequence
  source 1..20: mol_type = other DNA
tggctcctggcccggggcct

SEQ ID NO: 5486 - DNA, 20 bp, synthetic construct
  misc_feature 1..20: note = CRISPR gRNA sequence
  source 1..20: mol_type = other DNA
ggggcctgggactctccccg

SEQ ID NO: 5487 - DNA, 20 bp, synthetic construct
  misc_feature 1..20: note = CRISPR gRNA sequence
  source 1..20: mol_type = other DNA
gcctgggactctccccgaag

SEQ ID NO: 5488 - DNA, 20 bp, synthetic construct
  misc_feature 1..20: note = CRISPR gRNA sequence
  source 1..20: mol_type = other DNA
cctgggactctccccgaagt

SEQ ID NO: 5489 - DNA, 20 bp, synthetic construct
  misc_feature 1..20: note = CRISPR gRNA sequence
  source 1..20: mol_type = other DNA
ctgggactctccccgaagtg

SEQ ID NO: 5490 - DNA, 20 bp, synthetic construct
  misc_feature 1..20: note = CRISPR gRNA sequence
  source 1..20: mol_type = other DNA
gactctccccgaagtggggc

SEQ ID NO: 5491 - DNA, 20 bp, synthetic construct
  misc_feature 1..20: note = CRISPR gRNA sequence
  source 1..20: mol_type = other DNA
gaagtggggctggccactgt

SEQ ID NO: 5492 - DNA, 20 bp, synthetic construct
  misc_feature 1..20: note = CRISPR gRNA sequence
  source 1..20: mol_type = other DNA
aagtggggctggccactgtg

SEQ ID NO: 5493 - DNA, 20 bp, synthetic construct
  misc_feature 1..20: note = CRISPR gRNA sequence
  source 1..20: mol_type = other DNA
ggccactgtgaggaaccgac

SEQ ID NO: 5494 - DNA, 20 bp, synthetic construct
  misc_feature 1..20: note = CRISPR gRNA sequence
  source 1..20: mol_type = other DNA
ccactgtgaggaaccgactg

SEQ ID NO: 5495 - DNA, 20 bp, synthetic construct
  misc_feature 1..20: note = CRISPR gRNA sequence
  source 1..20: mol_type = other DNA
cactgtgaggaaccgactgg

SEQ ID NO: 5496 - DNA, 20 bp, synthetic construct
  misc_feature 1..20: note = CRISPR gRNA sequence
  source 1..20: mol_type = other DNA
tgtgaggaaccgactggagg

SEQ ID NO: 5497 - DNA, 20 bp, synthetic construct
  misc_feature 1..20: note = CRISPR gRNA sequence
  source 1..20: mol_type = other DNA
gtgaggaaccgactggaggc

SEQ ID NO: 5498 - DNA, 20 bp, synthetic construct
  misc_feature 1..20: note = CRISPR gRNA sequence
  source 1..20: mol_type = other DNA
tgaggaaccgactggaggca

SEQ ID NO: 5499 - DNA, 20 bp, synthetic construct
  misc_feature 1..20: note = CRISPR gRNA sequence
  source 1..20: mol_type = other DNA
gactggaggcagggacctct

SEQ ID NO: 5500 - DNA, 20 bp, synthetic construct
  misc_feature 1..20: note = CRISPR gRNA sequence
  source 1..20: mol_type = other DNA
cagggacctcttggatgccc

SEQ ID NO: 5501 - DNA, 20 bp, synthetic construct
  misc_feature 1..20: note = CRISPR gRNA sequence
  source 1..20: mol_type = other DNA
agggacctcttggatgcccc

SEQ ID NO: 5502 - DNA, 20 bp, synthetic construct
  misc_feature 1..20: note = CRISPR gRNA sequence
  source 1..20: mol_type = other DNA
gacctcttggatgccccagg

SEQ ID NO: 5503 - DNA, 20 bp, synthetic construct
  misc_feature 1..20: note = CRISPR gRNA sequence
  source 1..20: mol_type = other DNA
tcttggatgccccaggcagt

SEQ ID NO: 5504 - DNA, 20 bp, synthetic construct
  misc_feature 1..20: note = CRISPR gRNA sequence
  source 1..20: mol_type = other DNA
cttggatgccccaggcagtt

SEQ ID NO: 5505 - DNA, 20 bp, synthetic construct
  misc_feature 1..20: note = CRISPR gRNA sequence
  source 1..20: mol_type = other DNA
ttgggatgccacttctgata

SEQ ID NO: 5506 - DNA, 20 bp, synthetic construct
  misc_feature 1..20: note = CRISPR gRNA sequence
  source 1..20: mol_type = other DNA
gccacttctgataaagcacg

SEQ ID NO: 5507 - DNA, 20 bp, synthetic construct
  misc_feature 1..20: note = CRISPR gRNA sequence
  source 1..20: mol_type = other DNA
acttctgataaagcacgtgg

SEQ ID NO: 5508 - DNA, 20 bp, synthetic construct
  misc_feature 1..20: note = CRISPR gRNA sequence
  source 1..20: mol_type = other DNA
gataaagcacgtggtggcca

SEQ ID NO: 5509 - DNA, 20 bp, synthetic construct
  misc_feature 1..20: note = CRISPR gRNA sequence
  source 1..20: mol_type = other DNA
aaagcacgtggtggccacag

SEQ ID NO: 5510 - DNA, 20 bp, synthetic construct
  misc_feature 1..20: note = CRISPR gRNA sequence
  source 1..20: mol_type = other DNA
aagcacgtggtggccacagt

SEQ ID NO: 5511 - DNA, 20 bp, synthetic construct
  misc_feature 1..20: note = CRISPR gRNA sequence
  source 1..20: mol_type = other DNA
tggtggccacagtaggtgct

SEQ ID NO: 5512 - DNA, 20 bp, synthetic construct
  misc_feature 1..20: note = CRISPR gRNA sequence
  source 1..20: mol_type = other DNA
gtaggtgcttggttgctcca

SEQ ID NO: 5513 - DNA, 20 bp, synthetic construct
  misc_feature 1..20: note = CRISPR gRNA sequence
  source 1..20: mol_type = other DNA
tgcttggttgctccacagcc

SEQ ID NO: 5514 - DNA, 20 bp, synthetic construct
  misc_feature 1..20: note = CRISPR gRNA sequence
  source 1..20: mol_type = other DNA
gttgctccacagcctggccc

SEQ ID NO: 5515 - DNA, 20 bp, synthetic construct
  misc_feature 1..20: note = CRISPR gRNA sequence
  source 1..20: mol_type = other DNA
tccacagcctggcccgagct

SEQ ID NO: 5516 - DNA, 20 bp, synthetic construct
  misc_feature 1..20: note = CRISPR gRNA sequence
  source 1..20: mol_type = other DNA
ctggcccgagctcagcgctg

SEQ ID NO: 5517 - DNA, 20 bp, synthetic construct
  misc_feature 1..20: note = CRISPR gRNA sequence
  source 1..20: mol_type = other DNA
cccgagctcagcgctgcaga

SEQ ID NO: 5518 - DNA, 20 bp, synthetic construct
  misc_feature 1..20: note = CRISPR gRNA sequence
  source 1..20: mol_type = other DNA
agctcagcgctgcagaaaga

SEQ ID NO: 5519 - DNA, 20 bp, synthetic construct
  misc_feature 1..20: note = CRISPR gRNA sequence
  source 1..20: mol_type = other DNA
gcgctgcagaaagaaagtga

SEQ ID NO: 5520 - DNA, 20 bp, synthetic construct
  misc_feature 1..20: note = CRISPR gRNA sequence
  source 1..20: mol_type = other DNA
cgctgcagaaagaaagtgaa

SEQ ID NO: 5521 - DNA, 20 bp, synthetic construct
  misc_feature 1..20: note = CRISPR gRNA sequence
  source 1..20: mol_type = other DNA
gctgcagaaagaaagtgaaa

SEQ ID NO: 5522 - DNA, 20 bp, synthetic construct
  misc_feature 1..20: note = CRISPR gRNA sequence
  source 1..20: mol_type = other DNA
gaaagaaagtgaaagggaaa

SEQ ID NO: 5523 - DNA, 20 bp, synthetic construct
  misc_feature 1..20: note = CRISPR gRNA sequence
  source 1..20: mol_type = other DNA
gtgaaagggaaaaagaactg

SEQ ID NO: 5524 - DNA, 20 bp, synthetic construct
  misc_feature 1..20: note = CRISPR gRNA sequence
  source 1..20: mol_type = other DNA
tgaaagggaaaaagaactgc

SEQ ID NO: 5525 - DNA, 20 bp, synthetic construct
  misc_feature 1..20: note = CRISPR gRNA sequence
  source 1..20: mol_type = other DNA
gaaagggaaaaagaactgcg

SEQ ID NO: 5526 - DNA, 20 bp, synthetic construct
  misc_feature 1..20: note = CRISPR gRNA sequence
  source 1..20: mol_type = other DNA
aagggaaaaagaactgcggg

SEQ ID NO: 5527 - DNA, 20 bp, synthetic construct
  misc_feature 1..20: note = CRISPR gRNA sequence
  source 1..20: mol_type = other DNA
agggaaaaagaactgcgggg

SEQ ID NO: 5528 - DNA, 20 bp, synthetic construct
  misc_feature 1..20: note = CRISPR gRNA sequence
  source 1..20: mol_type = other DNA
gaaaaagaactgcggggagg

SEQ ID NO: 5529 - DNA, 20 bp, synthetic construct
  misc_feature 1..20: note = CRISPR gRNA sequence
  source 1..20: mol_type = other DNA
aaaaagaactgcggggaggc

SEQ ID NO: 5530 - DNA, 20 bp, synthetic construct
  misc_feature 1..20: note = CRISPR gRNA sequence
  source 1..20: mol_type = other DNA
aaaagaactgcggggaggcg

SEQ ID NO: 5531 - DNA, 20 bp, synthetic construct
  misc_feature 1..20: note = CRISPR gRNA sequence
  source 1..20: mol_type = other DNA
aagaactgcggggaggcggg

SEQ ID NO: 5532 - DNA, 20 bp, synthetic construct
  misc_feature 1..20: note = CRISPR gRNA sequence
  source 1..20: mol_type = other DNA
agaactgcggggaggcgggg

SEQ ID NO: 5533 - DNA, 20 bp, synthetic construct
  misc_feature 1..20: note = CRISPR gRNA sequence
  source 1..20: mol_type = other DNA
actgcggggaggcggggagg

SEQ ID NO: 5534 - DNA, 20 bp, synthetic construct
  misc_feature 1..20: note = CRISPR gRNA sequence
  source 1..20: mol_type = other DNA
ctgcggggaggcggggaggt

SEQ ID NO: 5535 - DNA, 20 bp, synthetic construct
  misc_feature 1..20: note = CRISPR gRNA sequence
  source 1..20: mol_type = other DNA
aggcggggaggtaggatgac

SEQ ID NO: 5536 - DNA, 20 bp, synthetic construct
  misc_feature 1..20: note = CRISPR gRNA sequence
  source 1..20: mol_type = other DNA
cggggaggtaggatgaccag

SEQ ID NO: 5537 - DNA, 20 bp, synthetic construct
  misc_feature 1..20: note = CRISPR gRNA sequence
  source 1..20: mol_type = other DNA
aggtaggatgaccagcggac

SEQ ID NO: 5538 - DNA, 20 bp, synthetic construct
  misc_feature 1..20: note = CRISPR gRNA sequence
  source 1..20: mol_type = other DNA
gaccagcggacgagctgcca

SEQ ID NO: 5539 - DNA, 20 bp, synthetic construct
  misc_feature 1..20: note = CRISPR gRNA sequence
  source 1..20: mol_type = other DNA
gagctgccacagacttgccg

SEQ ID NO: 5540 - DNA, 20 bp, synthetic construct
  misc_feature 1..20: note = CRISPR gRNA sequence
  source 1..20: mol_type = other DNA
ccacagacttgccgcggccc

SEQ ID NO: 5541 - DNA, 20 bp, synthetic construct
  misc_feature 1..20: note = CRISPR gRNA sequence
  source 1..20: mol_type = other DNA
acagacttgccgcggcccca

SEQ ID NO: 5542 - DNA, 20 bp, synthetic construct
  misc_feature 1..20: note = CRISPR gRNA sequence
  source 1..20: mol_type = other DNA
acttgccgcggccccagagc

SEQ ID NO: 5543 - DNA, 20 bp, synthetic construct
  misc_feature 1..20: note = CRISPR gRNA sequence
  source 1..20: mol_type = other DNA
tgccgcggccccagagctgg

SEQ ID NO: 5544 - DNA, 20 bp, synthetic construct
  misc_feature 1..20: note = CRISPR gRNA sequence
  source 1..20: mol_type = other DNA
gccgcggccccagagctggc

SEQ ID NO: 5545 - DNA, 20 bp, synthetic construct
  misc_feature 1..20: note = CRISPR gRNA sequence
  source 1..20: mol_type = other DNA
cgcggccccagagctggcgg

SEQ ID NO: 5546 - DNA, 20 bp, synthetic construct
  misc_feature 1..20: note = CRISPR gRNA sequence
  source 1..20: mol_type = other DNA
gcggccccagagctggcggg

SEQ ID NO: 5547 - DNA, 20 bp, synthetic construct
  misc_feature 1..20: note = CRISPR gRNA sequence
  source 1..20: mol_type = other DNA
cggccccagagctggcggga

SEQ ID NO: 5548 - DNA, 20 bp, synthetic construct
  misc_feature 1..20: note = CRISPR gRNA sequence
  source 1..20: mol_type = other DNA
gccccagagctggcgggagg

SEQ ID NO: 5549 - DNA, 20 bp, synthetic construct
  misc_feature 1..20: note = CRISPR gRNA sequence
  source 1..20: mol_type = other DNA
cccagagctggcgggaggga

SEQ ID NO: 5550 - DNA, 20 bp, synthetic construct
  misc_feature 1..20: note = CRISPR gRNA sequence
  source 1..20: mol_type = other DNA
ccagagctggcgggagggag

SEQ ID NO: 5551 - DNA, 20 bp, synthetic construct
  misc_feature 1..20: note = CRISPR gRNA sequence
  source 1..20: mol_type = other DNA
tggcgggagggagaggccac

SEQ ID NO: 5552 - DNA, 20 bp, synthetic construct
  misc_feature 1..20: note = CRISPR gRNA sequence
  source 1..20: mol_type = other DNA
cgggagggagaggccaccag

SEQ ID NO: 5553 - DNA, 20 bp, synthetic construct
  misc_feature 1..20: note = CRISPR gRNA sequence
  source 1..20: mol_type = other DNA
gaggccaccagcagcgcgcg

SEQ ID NO: 5554 - DNA, 20 bp, synthetic construct
  misc_feature 1..20: note = CRISPR gRNA sequence
  source 1..20: mol_type = other DNA
aggccaccagcagcgcgcgc

SEQ ID NO: 5555 - DNA, 20 bp, synthetic construct
  misc_feature 1..20: note = CRISPR gRNA sequence
  source 1..20: mol_type = other DNA
gccaccagcagcgcgcgcgg

SEQ ID NO: 5556 - DNA, 20 bp, synthetic construct
  misc_feature 1..20: note = CRISPR gRNA sequence
  source 1..20: mol_type = other DNA
cagcagcgcgcgcgggagcc

SEQ ID NO: 5557 - DNA, 20 bp, synthetic construct
  misc_feature 1..20: note = CRISPR gRNA sequence
  source 1..20: mol_type = other DNA
agcagcgcgcgcgggagccc

SEQ ID NO: 5558 - DNA, 20 bp, synthetic construct
  misc_feature 1..20: note = CRISPR gRNA sequence
  source 1..20: mol_type = other DNA
gcagcgcgcgcgggagcccg

SEQ ID NO: 5559 - DNA, 20 bp, synthetic construct
  misc_feature 1..20: note = CRISPR gRNA sequence
  source 1..20: mol_type = other DNA
gcgcgcgggagcccggggaa

SEQ ID NO: 5560 - DNA, 20 bp, synthetic construct
  misc_feature 1..20: note = CRISPR gRNA sequence
  source 1..20: mol_type = other DNA
cgcgggagcccggggaacag

SEQ ID NO: 5561 - DNA, 20 bp, synthetic construct
  misc_feature 1..20: note = CRISPR gRNA sequence
  source 1..20: mol_type = other DNA
gggagcccggggaacagcgg

SEQ ID NO: 5562 - DNA, 20 bp, synthetic construct
  misc_feature 1..20: note = CRISPR gRNA sequence
  source 1..20: mol_type = other DNA
ggagcccggggaacagcggt

SEQ ID NO: 5563 - DNA, 20 bp, synthetic construct
  misc_feature 1..20: note = CRISPR gRNA sequence
  source 1..20: mol_type = other DNA
ggaacagcggtaggtgacca

SEQ ID NO: 5564 - DNA, 20 bp, synthetic construct
  misc_feature 1..20: note = CRISPR gRNA sequence
  source 1..20: mol_type = other DNA
aagtctcctctgtaacccct

SEQ ID NO: 5565 - DNA, 20 bp, synthetic construct
  misc_feature 1..20: note = CRISPR gRNA sequence
  source 1..20: mol_type = other DNA
agtctcctctgtaaccccta

SEQ ID NO: 5566 - DNA, 20 bp, synthetic construct
  misc_feature 1..20: note = CRISPR gRNA sequence
  source 1..20: mol_type = other DNA
tcctctgtaacccctaaggt

SEQ ID NO: 5567 - DNA, 20 bp, synthetic construct
  misc_feature 1..20: note = CRISPR gRNA sequence
  source 1..20: mol_type = other DNA
cctctgtaacccctaaggtc

SEQ ID NO: 5568 - DNA, 20 bp, synthetic construct
  misc_feature 1..20: note = CRISPR gRNA sequence
  source 1..20: mol_type = other DNA
gtaacccctaaggtcgggct

SEQ ID NO: 5569 - DNA, 20 bp, synthetic construct
  misc_feature 1..20: note = CRISPR gRNA sequence
  source 1..20: mol_type = other DNA
ctaaggtcgggctgagaatc

SEQ ID NO: 5570 - DNA, 20 bp, synthetic construct
  misc_feature 1..20: note = CRISPR gRNA sequence
  source 1..20: mol_type = other DNA
taaggtcgggctgagaatcg

SEQ ID NO: 5571 - DNA, 20 bp, synthetic construct
  misc_feature 1..20: note = CRISPR gRNA sequence
  source 1..20: mol_type = other DNA
gggctgagaatcgaggctcc

SEQ ID NO: 5572 - DNA, 20 bp, synthetic construct
  misc_feature 1..20: note = CRISPR gRNA sequence
  source 1..20: mol_type = other DNA
aatcgaggctccgagactgt

SEQ ID NO: 5573 - DNA, 20 bp, synthetic construct
  misc_feature 1..20: note = CRISPR gRNA sequence
  source 1..20: mol_type = other DNA
agactgtcagctacttgctc

SEQ ID NO: 5574 - DNA, 20 bp, synthetic construct
  misc_feature 1..20: note = CRISPR gRNA sequence
  source 1..20: mol_type = other DNA
gactgtcagctacttgctca

SEQ ID NO: 5575 - DNA, 20 bp, synthetic construct
  misc_feature 1..20: note = CRISPR gRNA sequence
  source 1..20: mol_type = other DNA
gctacttgctcaaggtcaca

SEQ ID NO: 5576 - DNA, 20 bp, synthetic construct
  misc_feature 1..20: note = CRISPR gRNA sequence
  source 1..20: mol_type = other DNA
cttgctcaaggtcacacagc

SEQ ID NO: 5577 - DNA, 20 bp, synthetic construct
  misc_feature 1..20: note = CRISPR gRNA sequence
  source 1..20: mol_type = other DNA
tcaaggtcacacagcaagtc

SEQ ID NO: 5578 - DNA, 20 bp, synthetic construct
  misc_feature 1..20: note = CRISPR gRNA sequence
  source 1..20: mol_type = other DNA
caaggtcacacagcaagtct

SEQ ID NO: 5579 - DNA, 20 bp, synthetic construct
  misc_feature 1..20: note = CRISPR gRNA sequence
  source 1..20: mol_type = other DNA
aggtcacacagcaagtctgg

SEQ ID NO: 5580 - DNA, 20 bp, synthetic construct
  misc_feature 1..20: note = CRISPR gRNA sequence
  source 1..20: mol_type = other DNA
ggtcacacagcaagtctggg

SEQ ID NO: 5581 - DNA, 20 bp, synthetic construct
  misc_feature 1..20: note = CRISPR gRNA sequence
  source 1..20: mol_type = other DNA
acacagcaagtctgggagga

SEQ ID NO: 5582 - DNA, 20 bp, synthetic construct
  misc_feature 1..20: note = CRISPR gRNA sequence
  source 1..20: mol_type = other DNA
cacagcaagtctgggaggat

SEQ ID NO: 5583 - DNA, 20 bp, synthetic construct
  misc_feature 1..20: note = CRISPR gRNA sequence
  source 1..20: mol_type = other DNA
acagcaagtctgggaggatg

SEQ ID NO: 5584 - DNA, 20 bp, synthetic construct
  misc_feature 1..20: note = CRISPR gRNA sequence
  source 1..20: mol_type = other DNA
cagcaagtctgggaggatgg

SEQ ID NO: 5585 - DNA, 20 bp, synthetic construct
  misc_feature 1..20: note = CRISPR gRNA sequence
  source 1..20: mol_type = other DNA
agcaagtctgggaggatggg

SEQ ID NO: 5586 - DNA, 20 bp, synthetic construct
  misc_feature 1..20: note = CRISPR gRNA sequence
  source 1..20: mol_type = other DNA
agtctgggaggatgggggga

SEQ ID NO: 5587 - DNA, 20 bp, synthetic construct
  misc_feature 1..20: note = CRISPR gRNA sequence
  source 1..20: mol_type = other DNA
gggatggaatatgcaaaatg

SEQ ID NO: 5588 - DNA, 20 bp, synthetic construct
  misc_feature 1..20: note = CRISPR gRNA sequence
  source 1..20: mol_type = other DNA
ggatggaatatgcaaaatgt

SEQ ID NO: 5589 - DNA, 20 bp, synthetic construct
  misc_feature 1..20: note = CRISPR gRNA sequence
  source 1..20: mol_type = other DNA
gatggaatatgcaaaatgta

SEQ ID NO: 5590 - DNA, 20 bp, synthetic construct
  misc_feature 1..20: note = CRISPR gRNA sequence
  source 1..20: mol_type = other DNA
gaatatgcaaaatgtagggc

SEQ ID NO: 5591 - DNA, 20 bp, synthetic construct
  misc_feature 1..20: note = CRISPR gRNA sequence
  source 1..20: mol_type = other DNA
aatatgcaaaatgtagggcc

SEQ ID NO: 5592 - DNA, 20 bp, synthetic construct
  misc_feature 1..20: note = CRISPR gRNA sequence
  source 1..20: mol_type = other DNA
gccgggaaacacctcgtttc

SEQ ID NO: 5593 - DNA, 20 bp, synthetic construct
  misc_feature 1..20: note = CRISPR gRNA sequence
  source 1..20: mol_type = other DNA
atccccgcaacgactctgcg

SEQ ID NO: 5594 - DNA, 20 bp, synthetic construct
  misc_feature 1..20: note = CRISPR gRNA sequence
  source 1..20: mol_type = other DNA
tccccgcaacgactctgcgc

SEQ ID NO: 5595 - DNA, 20 bp, synthetic construct
  misc_feature 1..20: note = CRISPR gRNA sequence
  source 1..20: mol_type = other DNA
caacgactctgcgcgggaac

SEQ ID NO: 5596 - DNA, 20 bp, synthetic construct
  misc_feature 1..20: note = CRISPR gRNA sequence
  source 1..20: mol_type = other DNA
aacgactctgcgcgggaacc

SEQ ID NO: 5597 - DNA, 20 bp, synthetic construct
  misc_feature 1..20: note = CRISPR gRNA sequence
  source 1..20: mol_type = other DNA
cgactctgcgcgggaaccag

SEQ ID NO: 5598 - DNA, 20 bp, synthetic construct
  misc_feature 1..20: note = CRISPR gRNA sequence
  source 1..20: mol_type = other DNA
tctgcgcgggaaccaggagc

SEQ ID NO: 5599 - DNA, 20 bp, synthetic construct
  misc_feature 1..20: note = CRISPR gRNA sequence
  source 1..20: mol_type = other DNA
ctgcgcgggaaccaggagcc

SEQ ID NO: 5600 - DNA, 20 bp, synthetic construct
  misc_feature 1..20: note = CRISPR gRNA sequence
  source 1..20: mol_type = other DNA
ggaaccaggagccgggaacc

SEQ ID NO: 5601 - DNA, 20 bp, synthetic construct
  misc_feature 1..20: note = CRISPR gRNA sequence
  source 1..20: mol_type = other DNA
aaccaggagccgggaacccg

SEQ ID NO: 5602 - DNA, 20 bp, synthetic construct
  misc_feature 1..20: note = CRISPR gRNA sequence
  source 1..20: mol_type = other DNA
ggagccgggaacccggagct

SEQ ID NO: 5603 - DNA, 20 bp, synthetic construct
  misc_feature 1..20: note = CRISPR gRNA sequence
  source 1..20: mol_type = other DNA
ggagcttggcttgctgtgcc

SEQ ID NO: 5604 - DNA, 20 bp, synthetic construct
  misc_feature 1..20: note = CRISPR gRNA sequence
  source 1..20: mol_type = other DNA
agcttggcttgctgtgccca

SEQ ID NO: 5605 - DNA, 20 bp, synthetic construct
  misc_feature 1..20: note = CRISPR gRNA sequence
  source 1..20: mol_type = other DNA
gcttgctgtgcccagagctc

SEQ ID NO: 5606 - DNA, 20 bp, synthetic construct
  misc_feature 1..20: note = CRISPR gRNA sequence
  source 1..20: mol_type = other DNA
cttgctgtgcccagagctcc

SEQ ID NO: 5607 - DNA, 20 bp, synthetic construct
  misc_feature 1..20: note = CRISPR gRNA sequence
  source 1..20: mol_type = other DNA
ttgctgtgcccagagctccg

SEQ ID NO: 5608 - DNA, 20 bp, synthetic construct
  misc_feature 1..20: note = CRISPR gRNA sequence
  source 1..20: mol_type = other DNA
tgcccagagctccggggccg

SEQ ID NO: 5609 - DNA, 20 bp, synthetic construct
  misc_feature 1..20: note = CRISPR gRNA sequence
  source 1..20: mol_type = other DNA
gcccagagctccggggccgt

SEQ ID NO: 5610 - DNA, 20 bp, synthetic construct
  misc_feature 1..20: note = CRISPR gRNA sequence
  source 1..20: mol_type = other DNA
cagagctccggggccgtggg

SEQ ID NO: 5611 - DNA, 20 bp, synthetic construct
  misc_feature 1..20: note = CRISPR gRNA sequence
  source 1..20: mol_type = other DNA
agagctccggggccgtgggc

SEQ ID NO: 5612 - DNA, 20 bp, synthetic construct
  misc_feature 1..20: note = CRISPR gRNA sequence
  source 1..20: mol_type = other DNA
gctccggggccgtgggcggg

SEQ ID NO: 5613 - DNA, 20 bp, synthetic construct
  misc_feature 1..20: note = CRISPR gRNA sequence
  source 1..20: mol_type = other DNA
ccggggccgtgggcgggtgg

SEQ ID NO: 5614 - DNA, 20 bp, synthetic construct
  misc_feature 1..20: note = CRISPR gRNA sequence
  source 1..20: mol_type = other DNA
cggggccgtgggcgggtggc

SEQ ID NO: 5615 - DNA, 20 bp, synthetic construct
  misc_feature 1..20: note = CRISPR gRNA sequence
  source 1..20: mol_type = other DNA
gccgtgggcgggtggcagga

SEQ ID NO: 5616 - DNA, 20 bp, synthetic construct
  misc_feature 1..20: note = CRISPR gRNA sequence
  source 1..20: mol_type = other DNA
gggcgggtggcaggaaagcc

SEQ ID NO: 5617 - DNA, 20 bp, synthetic construct
  misc_feature 1..20: note = CRISPR gRNA sequence
  source 1..20: mol_type = other DNA
cgggtggcaggaaagcctgg

SEQ ID NO: 5618 - DNA, 20 bp, synthetic construct
  misc_feature 1..20: note = CRISPR gRNA sequence
  source 1..20: mol_type = other DNA
gtggcaggaaagcctggcgg

SEQ ID NO: 5619 - DNA, 20 bp, synthetic construct
  misc_feature 1..20: note = CRISPR gRNA sequence
  source 1..20: mol_type = other DNA
aagcctggcggcagcttctg

SEQ ID NO: 5620 - DNA, 20 bp, synthetic construct
  misc_feature 1..20: note = CRISPR gRNA sequence
  source 1..20: mol_type = other DNA
gcctggcggcagcttctgca

SEQ ID NO: 5621 - DNA, 20 bp, synthetic construct
  misc_feature 1..20: note = CRISPR gRNA sequence
  source 1..20: mol_type = other DNA
tggcggcagcttctgcagag

SEQ ID NO: 5622 - DNA, 20 bp, synthetic construct
  misc_feature 1..20: note = CRISPR gRNA sequence
  source 1..20: mol_type = other DNA
ggcagcttctgcagagaagc

SEQ ID NO: 5623 - DNA, 20 bp, synthetic construct
  misc_feature 1..20: note = CRISPR gRNA sequence
  source 1..20: mol_type = other DNA
cagcttctgcagagaagccg

SEQ ID NO: 5624 - DNA, 20 bp, synthetic construct
  misc_feature 1..20: note = CRISPR gRNA sequence
  source 1..20: mol_type = other DNA
tctgcagagaagccggagcg

SEQ ID NO: 5625 - DNA, 20 bp, synthetic construct
  misc_feature 1..20: note = CRISPR gRNA sequence
  source 1..20: mol_type = other DNA
agagaagccggagcgcagac

SEQ ID NO: 5626 - DNA, 20 bp, synthetic construct
  misc_feature 1..20: note = CRISPR gRNA sequence
  source 1..20: mol_type = other DNA
gagaagccggagcgcagact

SEQ ID NO: 5627 - DNA, 20 bp, synthetic construct
  misc_feature 1..20: note = CRISPR gRNA sequence
  source 1..20: mol_type = other DNA
gaagccggagcgcagactgg

SEQ ID NO: 5628 - DNA, 20 bp, synthetic construct
  misc_feature 1..20: note = CRISPR gRNA sequence
  source 1..20: mol_type = other DNA
cggagcgcagactgggagcg

SEQ ID NO: 5629 - DNA, 20 bp, synthetic construct
  misc_feature 1..20: note = CRISPR gRNA sequence
  source 1..20: mol_type = other DNA
gagcgcagactgggagcgcg

SEQ ID NO: 5630 - DNA, 20 bp, synthetic construct
  misc_feature 1..20: note = CRISPR gRNA sequence
  source 1..20: mol_type = other DNA
cgcagactgggagcgcggag

SEQ ID NO: 5631 - DNA, 20 bp, synthetic construct
  misc_feature 1..20: note = CRISPR gRNA sequence
  source 1..20: mol_type = other DNA
gcggagcagacacactcccc

SEQ ID NO: 5632 - DNA, 20 bp, synthetic construct
  misc_feature 1..20: note = CRISPR gRNA sequence
  source 1..20: mol_type = other DNA
cacactcccccggccaccct

SEQ ID NO: 5633 - DNA, 20 bp, synthetic construct
  misc_feature 1..20: note = CRISPR gRNA sequence
  source 1..20: mol_type = other DNA
cttggccgactccgcgcgcc

SEQ ID NO: 5634 - DNA, 20 bp, synthetic construct
  misc_feature 1..20: note = CRISPR gRNA sequence
  source 1..20: mol_type = other DNA
ttggccgactccgcgcgccc

SEQ ID NO: 5635 - DNA, 20 bp, synthetic construct
  misc_feature 1..20: note = CRISPR gRNA sequence
  source 1..20: mol_type = other DNA
tccgcgcgcccgggatcctg

SEQ ID NO: 5636 - DNA, 20 bp, synthetic construct
  misc_feature 1..20: note = CRISPR gRNA sequence
  source 1..20: mol_type = other DNA
cgcgcgcccgggatcctgca

SEQ ID NO: 5637 - DNA, 20 bp, synthetic construct
  misc_feature 1..20: note = CRISPR gRNA sequence
  source 1..20: mol_type = other DNA
gcgcgcccgggatcctgcag

SEQ ID NO: 5638 - DNA, 20 bp, synthetic construct
  misc_feature 1..20: note = CRISPR gRNA sequence
  source 1..20: mol_type = other DNA
tgcgcgcccttcttgtacgc

SEQ ID NO: 5639 - DNA, 20 bp, synthetic construct
  misc_feature 1..20: note = CRISPR gRNA sequence
  source 1..20: mol_type = other DNA
ccttcttgtacgccagactt

SEQ ID NO: 5640 - DNA, 20 bp, synthetic construct
  misc_feature 1..20: note = CRISPR gRNA sequence
  source 1..20: mol_type = other DNA
ttgtacgccagactttggac

SEQ ID NO: 5641 - DNA, 20 bp, synthetic construct
  misc_feature 1..20: note = CRISPR gRNA sequence
  source 1..20: mol_type = other DNA
tgtacgccagactttggacc

SEQ ID NO: 5642 - DNA, 20 bp, synthetic construct
  misc_feature 1..20: note = CRISPR gRNA sequence
  source 1..20: mol_type = other DNA
gtacgccagactttggacca

SEQ ID NO: 5643 - DNA, 20 bp, synthetic construct
  misc_feature 1..20: note = CRISPR gRNA sequence
  source 1..20: mol_type = other DNA
gaccagggccgccgttccct

SEQ ID NO: 5644 - DNA, 20 bp, synthetic construct
  misc_feature 1..20: note = CRISPR gRNA sequence
  source 1..20: mol_type = other DNA
ctgagcttcactttccctgt

SEQ ID NO: 5645 - DNA, 20 bp, synthetic construct
  misc_feature 1..20: note = CRISPR gRNA sequence
  source 1..20: mol_type = other DNA
tgagcttcactttccctgtt

SEQ ID NO: 5646 - DNA, 20 bp, synthetic construct
  misc_feature 1..20: note = CRISPR gRNA sequence
  source 1..20: mol_type = other DNA
tcatattccatctctaactc

SEQ ID NO: 5647 - DNA, 20 bp, synthetic construct
  misc_feature 1..20: note = CRISPR gRNA sequence
  source 1..20: mol_type = other DNA
catctctaactctggaatct

SEQ ID NO: 5648 - DNA, 20 bp, synthetic construct
  misc_feature 1..20: note = CRISPR gRNA sequence
  source 1..20: mol_type = other DNA
atctctaactctggaatctt

SEQ ID NO: 5649 - DNA, 20 bp, synthetic construct
  misc_feature 1..20: note = CRISPR gRNA sequence
  source 1..20: mol_type = other DNA
aactctggaatcttgggtat

SEQ ID NO: 5650 - DNA, 20 bp, synthetic construct
  misc_feature 1..20: note = CRISPR gRNA sequence
  source 1..20: mol_type = other DNA
actctggaatcttgggtatt

SEQ ID NO: 5651 - DNA, 20 bp, synthetic construct
  misc_feature 1..20: note = CRISPR gRNA sequence
  source 1..20: mol_type = other DNA
atcttgggtattgggctctc

SEQ ID NO: 5652 - DNA, 20 bp, synthetic construct
  misc_feature 1..20: note = CRISPR gRNA sequence
  source 1..20: mol_type = other DNA
tcttgggtattgggctctcc

SEQ ID NO: 5653 - DNA, 20 bp, synthetic construct
  misc_feature 1..20: note = CRISPR gRNA sequence
  source 1..20: mol_type = other DNA
tgggtattgggctctccagg

SEQ ID NO: 5654 - DNA, 20 bp, synthetic construct
  misc_feature 1..20: note = CRISPR gRNA sequence
  source 1..20: mol_type = other DNA
gggtattgggctctccaggc

SEQ ID NO: 5655 - DNA, 20 bp, synthetic construct
  misc_feature 1..20: note = CRISPR gRNA sequence
  source 1..20: mol_type = other DNA
ggtattgggctctccaggcg

SEQ ID NO: 5656 - DNA, 20 bp, synthetic construct
  misc_feature 1..20: note = CRISPR gRNA sequence
  source 1..20: mol_type = other DNA
gtattgggctctccaggcgg

SEQ ID NO: 5657 - DNA, 20 bp, synthetic construct
  misc_feature 1..20: note = CRISPR gRNA sequence
  source 1..20: mol_type = other DNA
tattgggctctccaggcggg

SEQ ID NO: 5658 - DNA, 20 bp, synthetic construct
  misc_feature 1..20: note = CRISPR gRNA sequence
  source 1..20: mol_type = other DNA
tccaggcggggggccctgct

SEQ ID NO: 5659 - DNA, 20 bp, synthetic construct
  misc_feature 1..20: note = CRISPR gRNA sequence
  source 1..20: mol_type = other DNA
ccaggcggggggccctgctc

SEQ ID NO: 5660 - DNA, 20 bp, synthetic construct
  misc_feature 1..20: note = CRISPR gRNA sequence
  source 1..20: mol_type = other DNA
caggcggggggccctgctca

SEQ ID NO: 5661 - DNA, 20 bp, synthetic construct
  misc_feature 1..20: note = CRISPR gRNA sequence
  source 1..20: mol_type = other DNA
ggcggggggccctgctcagg

SEQ ID NO: 5662 - DNA, 20 bp, synthetic construct
  misc_feature 1..20: note = CRISPR gRNA sequence
  source 1..20: mol_type = other DNA
gcggggggccctgctcaggg

SEQ ID NO: 5663 - DNA, 20 bp, synthetic construct
  misc_feature 1..20: note = CRISPR gRNA sequence
  source 1..20: mol_type = other DNA
gggggccctgctcagggagg

SEQ ID NO: 5664 - DNA, 20 bp, synthetic construct
  misc_feature 1..20: note = CRISPR gRNA sequence
  source 1..20: mol_type = other DNA
ggccctgctcagggaggcag

SEQ ID NO: 5665 - DNA, 20 bp, synthetic construct
  misc_feature 1..20: note = CRISPR gRNA sequence
  source 1..20: mol_type = other DNA
gccctgctcagggaggcagt

SEQ ID NO: 5666 - DNA, 20 bp, synthetic construct
  misc_feature 1..20: note = CRISPR gRNA sequence
  source 1..20: mol_type = other DNA
ccctgctcagggaggcagta

SEQ ID NO: 5667 - DNA, 20 bp, synthetic construct
  misc_feature 1..20: note = CRISPR gRNA sequence
  source 1..20: mol_type = other DNA
ctgctcagggaggcagtagg

SEQ ID NO: 5668 - DNA, 20 bp, synthetic construct
  misc_feature 1..20: note = CRISPR gRNA sequence
  source 1..20: mol_type = other DNA
tagggagccaaacctttaac

SEQ ID NO: 5669 - DNA, 20 bp, synthetic construct
  misc_feature 1..20: note = CRISPR gRNA sequence
  source 1..20: mol_type = other DNA
gggagccaaacctttaacca

SEQ ID NO: 5670 - DNA, 20 bp, synthetic construct
  misc_feature 1..20: note = CRISPR gRNA sequence
  source 1..20: mol_type = other DNA
ggagccaaacctttaaccag

SEQ ID NO: 5671 - DNA, 20 bp, synthetic construct
  misc_feature 1..20: note = CRISPR gRNA sequence
  source 1..20: mol_type = other DNA
ccaaacctttaaccagagga

SEQ ID NO: 5672 - DNA, 20 bp, synthetic construct
  misc_feature 1..20: note = CRISPR gRNA sequence
  source 1..20: mol_type = other DNA
caaacctttaaccagaggat

SEQ ID NO: 5673 - DNA, 20 bp, synthetic construct
  misc_feature 1..20: note = CRISPR gRNA sequence
  source 1..20: mol_type = other DNA
ctttaaccagaggatgggat

SEQ ID NO: 5674 - DNA, 20 bp, synthetic construct
  misc_feature 1..20: note = CRISPR gRNA sequence
  source 1..20: mol_type = other DNA
tcaactctcgttgaacatct

SEQ ID NO: 5675 - DNA, 20 bp, synthetic construct
  misc_feature 1..20: note = CRISPR gRNA sequence
  source 1..20: mol_type = other DNA
tctcgttgaacatcttggcg

SEQ ID NO: 5676 - DNA, 20 bp, synthetic construct
  misc_feature 1..20: note = CRISPR gRNA sequence
  source 1..20: mol_type = other DNA
ctcgttgaacatcttggcga

SEQ ID NO: 5677 - DNA, 20 bp, synthetic construct
  misc_feature 1..20: note = CRISPR gRNA sequence
  source 1..20: mol_type = other DNA
ttggcgaaggtgtgtgttgt

SEQ ID NO: 5678 - DNA, 20 bp, synthetic construct
  misc_feature 1..20: note = CRISPR gRNA sequence
  source 1..20: mol_type = other DNA
tggcgaaggtgtgtgttgtt

SEQ ID NO: 5679 - DNA, 20 bp, synthetic construct
  misc_feature 1..20: note = CRISPR gRNA sequence
  source 1..20: mol_type = other DNA
gcgaaggtgtgtgttgttgg

SEQ ID NO: 5680 - DNA, 20 bp, synthetic construct
  misc_feature 1..20: note = CRISPR gRNA sequence
  source 1..20: mol_type = other DNA
cgaaggtgtgtgttgttggg

SEQ ID NO: 5681 - DNA, 20 bp, synthetic construct
  misc_feature 1..20: note = CRISPR gRNA sequence
  source 1..20: mol_type = other DNA
gaaggtgtgtgttgttggga

SEQ ID NO: 5682 - DNA, 20 bp, synthetic construct
  misc_feature 1..20: note = CRISPR gRNA sequence
  source 1..20: mol_type = other DNA
aaggtgtgtgttgttgggag

SEQ ID NO: 5683 - DNA, 20 bp, synthetic construct
  misc_feature 1..20: note = CRISPR gRNA sequence
  source 1..20: mol_type = other DNA
gtgtgtgttgttgggagggg

SEQ ID NO: 5684 - DNA, 20 bp, synthetic construct
  misc_feature 1..20: note = CRISPR gRNA sequence
  source 1..20: mol_type = other DNA
tgtgtgttgttgggaggggt

SEQ ID NO: 5685 - DNA, 20 bp, synthetic construct
  misc_feature 1..20: note = CRISPR gRNA sequence
  source 1..20: mol_type = other DNA
gtgtgttgttgggaggggtg

SEQ ID NO: 5686 - DNA, 20 bp, synthetic construct
  misc_feature 1..20: note = CRISPR gRNA sequence
  source 1..20: mol_type = other DNA
tgtgttgttgggaggggtgg

SEQ ID NO: 5687 - DNA, 20 bp, synthetic construct
  misc_feature 1..20: note = CRISPR gRNA sequence
  source 1..20: mol_type = other DNA
tgttgttgggaggggtgggg

SEQ ID NO: 5688 - DNA, 20 bp, synthetic construct
  misc_feature 1..20: note = CRISPR gRNA sequence
  source 1..20: mol_type = other DNA
gttgttgggaggggtggggg

SEQ ID NO: 5689 - DNA, 20 bp, synthetic construct
  misc_feature 1..20: note = CRISPR gRNA sequence
  source 1..20: mol_type = other DNA
ttgttgggaggggtggggga

SEQ ID NO: 5690 - DNA, 20 bp, synthetic construct
  misc_feature 1..20: note = CRISPR gRNA sequence
  source 1..20: mol_type = other DNA
gggtgggggagggatccccc

SEQ ID NO: 5691 - DNA, 20 bp, synthetic construct
  misc_feature 1..20: note = CRISPR gRNA sequence
  source 1..20: mol_type = other DNA
ctcacttctctacctcgctt

SEQ ID NO: 5692 - DNA, 20 bp, synthetic construct
  misc_feature 1..20: note = CRISPR gRNA sequence
  source 1..20: mol_type = other DNA
tcacttctctacctcgcttt

SEQ ID NO: 5693 - DNA, 20 bp, synthetic construct
  misc_feature 1..20: note = CRISPR gRNA sequence
  source 1..20: mol_type = other DNA
cacttctctacctcgctttg

SEQ ID NO: 5694 - DNA, 20 bp, synthetic construct
  misc_feature 1..20: note = CRISPR gRNA sequence
  source 1..20: mol_type = other DNA
ctacctcgctttggggccct

SEQ ID NO: 5695 - DNA, 20 bp, synthetic construct
  misc_feature 1..20: note = CRISPR gRNA sequence
  source 1..20: mol_type = other DNA
ggccctgagtcacaccctct

SEQ ID NO: 5696 - DNA, 20 bp, synthetic construct
  misc_feature 1..20: note = CRISPR gRNA sequence
  source 1..20: mol_type = other DNA
gccctgagtcacaccctcta

SEQ ID NO: 5697 - DNA, 20 bp, synthetic construct
  misc_feature 1..20: note = CRISPR gRNA sequence
  source 1..20: mol_type = other DNA
cctgagtcacaccctctaag

SEQ ID NO: 5698 - DNA, 20 bp, synthetic construct
  misc_feature 1..20: note = CRISPR gRNA sequence
  source 1..20: mol_type = other DNA
tgagtcacaccctctaagga

SEQ ID NO: 5699 - DNA, 20 bp, synthetic construct
  misc_feature 1..20: note = CRISPR gRNA sequence
  source 1..20: mol_type = other DNA
agtcacaccctctaaggaga

SEQ ID NO: 5700 - DNA, 20 bp, synthetic construct
  misc_feature 1..20: note = CRISPR gRNA sequence
  source 1..20: mol_type = other DNA
gtcacaccctctaaggagag

SEQ ID NO: 5701 - DNA, 20 bp, synthetic construct
  misc_feature 1..20: note = CRISPR gRNA sequence
  source 1..20: mol_type = other DNA
ccctctaaggagagaggcta

SEQ ID NO: 5702 - DNA, 20 bp, synthetic construct
  misc_feature 1..20: note = CRISPR gRNA sequence
  source 1..20: mol_type = other DNA
ggagagaggctaaagcgccc

SEQ ID NO: 5703 - DNA, 20 bp, synthetic construct
  misc_feature 1..20: note = CRISPR gRNA sequence
  source 1..20: mol_type = other DNA
agaggctaaagcgccccgga

SEQ ID NO: 5704 - DNA, 20 bp, synthetic construct
  misc_feature 1..20: note = CRISPR gRNA sequence
  source 1..20: mol_type = other DNA
gctaaagcgccccggaaagc

SEQ ID NO: 5705 - DNA, 20 bp, synthetic construct
  misc_feature 1..20: note = CRISPR gRNA sequence
  source 1..20: mol_type = other DNA
gaaagccagcgtgcgaatgc

SEQ ID NO: 5706 - DNA, 20 bp, synthetic construct
  misc_feature 1..20: note = CRISPR gRNA sequence
  source 1..20: mol_type = other DNA
aaagccagcgtgcgaatgcc

SEQ ID NO: 5707 - DNA, 20 bp, synthetic construct
  misc_feature 1..20: note = CRISPR gRNA sequence
  source 1..20: mol_type = other DNA
aagccagcgtgcgaatgccg

SEQ ID NO: 5708 - DNA, 20 bp, synthetic construct
  misc_feature 1..20: note = CRISPR gRNA sequence
  source 1..20: mol_type = other DNA
ccagcgtgcgaatgccgggg

SEQ ID NO: 5709 - DNA, 20 bp, synthetic construct
  misc_feature 1..20: note = CRISPR gRNA sequence
  source 1..20: mol_type = other DNA
cagcgtgcgaatgccggggt

SEQ ID NO: 5710 - DNA, 20 bp, synthetic construct
  misc_feature 1..20: note = CRISPR gRNA sequence
  source 1..20: mol_type = other DNA
gcgtgcgaatgccggggtgg

SEQ ID NO: 5711 - DNA, 20 bp, synthetic construct
  misc_feature 1..20: note = CRISPR gRNA sequence
  source 1..20: mol_type = other DNA
tgcgaatgccggggtgggag

SEQ ID NO: 5712 - DNA, 20 bp, synthetic construct
  misc_feature 1..20: note = CRISPR gRNA sequence
  source 1..20: mol_type = other DNA
gcgaatgccggggtgggagt

SEQ ID NO: 5713 - DNA, 20 bp, synthetic construct
  misc_feature 1..20: note = CRISPR gRNA sequence
  source 1..20: mol_type = other DNA
gaatgccggggtgggagtgg

SEQ ID NO: 5714 - DNA, 20 bp, synthetic construct
  misc_feature 1..20: note = CRISPR gRNA sequence
  source 1..20: mol_type = other DNA
ccggggtgggagtgggagat

SEQ ID NO: 5715 - DNA, 20 bp, synthetic construct
  misc_feature 1..20: note = CRISPR gRNA sequence
  source 1..20: mol_type = other DNA
agtgggagattggatctccc

SEQ ID NO: 5716 - DNA, 20 bp, synthetic construct
  misc_feature 1..20: note = CRISPR gRNA sequence
  source 1..20: mol_type = other DNA
gtgggagattggatctccct

SEQ ID NO: 5717 - DNA, 20 bp, synthetic construct
  misc_feature 1..20: note = CRISPR gRNA sequence
  source 1..20: mol_type = other DNA
tgggagattggatctccctg

SEQ ID NO: 5718 - DNA, 20 bp, synthetic construct
  misc_feature 1..20: note = CRISPR gRNA sequence
  source 1..20: mol_type = other DNA
gattggatctccctggggtc

SEQ ID NO: 5719 - DNA, 20 bp, synthetic construct
  misc_feature 1..20: note = CRISPR gRNA sequence
  source 1..20: mol_type = other DNA
attggatctccctggggtcc

SEQ ID NO: 5720 - DNA, 20 bp, synthetic construct
  misc_feature 1..20: note = CRISPR gRNA sequence
  source 1..20: mol_type = other DNA
gatctccctggggtccagga

SEQ ID NO: 5721 - DNA, 20 bp, synthetic construct
  misc_feature 1..20: note = CRISPR gRNA sequence
  source 1..20: mol_type = other DNA
tccctggggtccaggaaagc

SEQ ID NO: 5722 - DNA, 20 bp, synthetic construct
  misc_feature 1..20: note = CRISPR gRNA sequence
  source 1..20: mol_type = other DNA
gggtccaggaaagccggaat

SEQ ID NO: 5723 - DNA, 20 bp, synthetic construct
  misc_feature 1..20: note = CRISPR gRNA sequence
  source 1..20: mol_type = other DNA
gtccaggaaagccggaatcg

SEQ ID NO: 5724 - DNA, 20 bp, synthetic construct
  misc_feature 1..20: note = CRISPR gRNA sequence
  source 1..20: mol_type = other DNA
ggaatcggagccaccatgct

SEQ ID NO: 5725 - DNA, 20 bp, synthetic construct
  misc_feature 1..20: note = CRISPR gRNA sequence
  source 1..20: mol_type = other DNA
cggagccaccatgcttagct

SEQ ID NO: 5726 - DNA, 20 bp, synthetic construct
  misc_feature 1..20: note = CRISPR gRNA sequence
  source 1..20: mol_type = other DNA
ccaccatgcttagcttagtc

SEQ ID NO: 5727 - DNA, 20 bp, synthetic construct
  misc_feature 1..20: note = CRISPR gRNA sequence
  source 1..20: mol_type = other DNA
gcttagtctggaactcttaa

SEQ ID NO: 5728 - DNA, 20 bp, synthetic construct
  misc_feature 1..20: note = CRISPR gRNA sequence
  source 1..20: mol_type = other DNA
tctggaactcttaaaagccg

SEQ ID NO: 5729 - DNA, 20 bp, synthetic construct
  misc_feature 1..20: note = CRISPR gRNA sequence
  source 1..20: mol_type = other DNA
ttaaaagccgcggtcctcct

SEQ ID NO: 5730 - DNA, 20 bp, synthetic construct
  misc_feature 1..20: note = CRISPR gRNA sequence
  source 1..20: mol_type = other DNA
cgcggtcctcctgagtccca

SEQ ID NO: 5731 - DNA, 20 bp, synthetic construct
  misc_feature 1..20: note = CRISPR gRNA sequence
  source 1..20: mol_type = other DNA
cccacagcccctctccaccc

SEQ ID NO: 5732 - DNA, 20 bp, synthetic construct
  misc_feature 1..20: note = CRISPR gRNA sequence
  source 1..20: mol_type = other DNA
ccacagcccctctccaccct

SEQ ID NO: 5733 - DNA, 20 bp, synthetic construct
  misc_feature 1..20: note = CRISPR gRNA sequence
  source 1..20: mol_type = other DNA
cagcccctctccaccctagg

SEQ ID NO: 5734 - DNA, 20 bp, synthetic construct
  misc_feature 1..20: note = CRISPR gRNA sequence
  source 1..20: mol_type = other DNA
cctctccaccctaggtggca

SEQ ID NO: 5735 - DNA, 20 bp, synthetic construct
  misc_feature 1..20: note = CRISPR gRNA sequence
  source 1..20: mol_type = other DNA
ctctccaccctaggtggcac

SEQ ID NO: 5736 - DNA, 20 bp, synthetic construct
  misc_feature 1..20: note = CRISPR gRNA sequence
  source 1..20: mol_type = other DNA
ctccaccctaggtggcacag

SEQ ID NO: 5737 - DNA, 20 bp, synthetic construct
  misc_feature 1..20: note = CRISPR gRNA sequence
  source 1..20: mol_type = other DNA
ccaccctaggtggcacagga

SEQ ID NO: 5738 - DNA, 20 bp, synthetic construct
  misc_feature 1..20: note = CRISPR gRNA sequence
  source 1..20: mol_type = other DNA
caccctaggtggcacaggag

SEQ ID NO: 5739 - DNA, 20 bp, synthetic construct
  misc_feature 1..20: note = CRISPR gRNA sequence
  source 1..20: mol_type = other DNA
cctaggtggcacaggagagg

SEQ ID NO: 5740 - DNA, 20 bp, synthetic construct
  misc_feature 1..20: note = CRISPR gRNA sequence
  source 1..20: mol_type = other DNA
tggcacaggagaggtggcaa

SEQ ID NO: 5741 - DNA, 20 bp, synthetic construct
  misc_feature 1..20: note = CRISPR gRNA sequence
  source 1..20: mol_type = other DNA
caggagaggtggcaaaagcc

SEQ ID NO: 5742 - DNA, 20 bp, synthetic construct
  misc_feature 1..20: note = CRISPR gRNA sequence
  source 1..20: mol_type = other DNA
gagaggtggcaaaagcctag

SEQ ID NO: 5743 - DNA, 20 bp, synthetic construct
  misc_feature 1..20: note = CRISPR gRNA sequence
  source 1..20: mol_type = other DNA
tggcaaaagcctagaagttc

SEQ ID NO: 5744 - DNA, 20 bp, synthetic construct
  misc_feature 1..20: note = CRISPR gRNA sequence
  source 1..20: mol_type = other DNA
ggcaaaagcctagaagttca

SEQ ID NO: 5745 - DNA, 20 bp, synthetic construct
  misc_feature 1..20: note = CRISPR gRNA sequence
  source 1..20: mol_type = other DNA
aagcctagaagttcaaggca

SEQ ID NO: 5746 - DNA, 20 bp, synthetic construct
  misc_feature 1..20: note = CRISPR gRNA sequence
  source 1..20: mol_type = other DNA
tcaaggcatggctccctccc

SEQ ID NO: 5747 - DNA, 20 bp, synthetic construct
  misc_feature 1..20: note = CRISPR gRNA sequence
  source 1..20: mol_type = other DNA
catggctccctccccagccg

SEQ ID NO: 5748 - DNA, 20 bp, synthetic construct
  misc_feature 1..20: note = CRISPR gRNA sequence
  source 1..20: mol_type = other DNA
ctccctccccagccgcagcc

SEQ ID NO: 5749 - DNA, 20 bp, synthetic construct
  misc_feature 1..20: note = CRISPR gRNA sequence
  source 1..20: mol_type = other DNA
ccctccccagccgcagcctg

SEQ ID NO: 5750 - DNA, 20 bp, synthetic construct
  misc_feature 1..20: note = CRISPR gRNA sequence
  source 1..20: mol_type = other DNA
cagcctggagtgtctaactt

SEQ ID NO: 5751 - DNA, 20 bp, synthetic construct
  misc_feature 1..20: note = CRISPR gRNA sequence
  source 1..20: mol_type = other DNA
cctggagtgtctaactttgg

SEQ ID NO: 5752 - DNA, 20 bp, synthetic construct
  misc_feature 1..20: note = CRISPR gRNA sequence
  source 1..20: mol_type = other DNA
ctggagtgtctaactttggc

SEQ ID NO: 5753 - DNA, 20 bp, synthetic construct
  misc_feature 1..20: note = CRISPR gRNA sequence
  source 1..20: mol_type = other DNA
gagtgtctaactttggcagg

SEQ ID NO: 5754 - DNA, 20 bp, synthetic construct
  misc_feature 1..20: note = CRISPR gRNA sequence
  source 1..20: mol_type = other DNA
tccgtttctgctccccactc

SEQ ID NO: 5755 - DNA, 20 bp, synthetic construct
  misc_feature 1..20: note = CRISPR gRNA sequence
  source 1..20: mol_type = other DNA
cgtttctgctccccactcca

SEQ ID NO: 5756 - DNA, 20 bp, synthetic construct
  misc_feature 1..20: note = CRISPR gRNA sequence
  source 1..20: mol_type = other DNA
aaaataaataaatacttctc

SEQ ID NO: 5757 - DNA, 20 bp, synthetic construct
  misc_feature 1..20: note = CRISPR gRNA sequence
  source 1..20: mol_type = other DNA
aataaataaatacttctccg

SEQ ID NO: 5758 - DNA, 20 bp, synthetic construct
  misc_feature 1..20: note = CRISPR gRNA sequence
  source 1..20: mol_type = other DNA
aataaatacttctccggagt

SEQ ID NO: 5759 - DNA, 20 bp, synthetic construct
  misc_feature 1..20: note = CRISPR gRNA sequence
  source 1..20: mol_type = other DNA
tacttctccggagtgagatt

SEQ ID NO: 5760 - DNA, 20 bp, synthetic construct
  misc_feature 1..20: note = CRISPR gRNA sequence
  source 1..20: mol_type = other DNA
acttctccggagtgagatta

SEQ ID NO: 5761 - DNA, 20 bp, synthetic construct
  misc_feature 1..20: note = CRISPR gRNA sequence
  source 1..20: mol_type = other DNA
ccggagtgagattaaggaaa

SEQ ID NO: 5762 - DNA, 20 bp, synthetic construct
  misc_feature 1..20: note = CRISPR gRNA sequence
  source 1..20: mol_type = other DNA
cggagtgagattaaggaaac

SEQ ID NO: 5763 - DNA, 20 bp, synthetic construct
  misc_feature 1..20: note = CRISPR gRNA sequence
  source 1..20: mol_type = other DNA
aaacaggtacttcttcctct

SEQ ID NO: 5764 - DNA, 20 bp, synthetic construct
  misc_feature 1..20: note = CRISPR gRNA sequence
  source 1..20: mol_type = other DNA
acaggtacttcttcctcttg

SEQ ID NO: 5765 - DNA, 20 bp, synthetic construct
  misc_feature 1..20: note = CRISPR gRNA sequence
  source 1..20: mol_type = other DNA
gtacttcttcctcttggaga

SEQ ID NO: 5766 - DNA, 20 bp, synthetic construct
  misc_feature 1..20: note = CRISPR gRNA sequence
  source 1..20: mol_type = other DNA
acttcttcctcttggagaaa

SEQ ID NO: 5767 - DNA, 20 bp, synthetic construct
  misc_feature 1..20: note = CRISPR gRNA sequence
  source 1..20: mol_type = other DNA
cttcttcctcttggagaaag

SEQ ID NO: 5768 - DNA, 20 bp, synthetic construct
  misc_feature 1..20: note = CRISPR gRNA sequence
  source 1..20: mol_type = other DNA
tcttcctcttggagaaagag

SEQ ID NO: 5769 - DNA, 20 bp, synthetic construct
  misc_feature 1..20: note = CRISPR gRNA sequence
  source 1..20: mol_type = other DNA
tcttggagaaagaggagcca

SEQ ID NO: 5770 - DNA, 20 bp, synthetic construct
  misc_feature 1..20: note = CRISPR gRNA sequence
  source 1..20: mol_type = other DNA
cttggagaaagaggagccaa

SEQ ID NO: 5771 - DNA, 20 bp, synthetic construct
  misc_feature 1..20: note = CRISPR gRNA sequence
  source 1..20: mol_type = other DNA
atgatcaccttgcaaacccc

SEQ ID NO: 5772 - DNA, 20 bp, synthetic construct
  misc_feature 1..20: note = CRISPR gRNA sequence
  source 1..20: mol_type = other DNA
ttgcaaacccccggctccct

SEQ ID NO: 5773 - DNA, 20 bp, synthetic construct
  misc_feature 1..20: note = CRISPR gRNA sequence
  source 1..20: mol_type = other DNA
tgcaaacccccggctccctt

SEQ ID NO: 5774 - DNA, 20 bp, synthetic construct
  misc_feature 1..20: note = CRISPR gRNA sequence
  source 1..20: mol_type = other DNA
gcaaacccccggctccctta

SEQ ID NO: 5775 - DNA, 20 bp, synthetic construct
  misc_feature 1..20: note = CRISPR gRNA sequence
  source 1..20: mol_type = other DNA
caaacccccggctcccttag

SEQ ID NO: 5776 - DNA, 20 bp, synthetic construct
  misc_feature 1..20: note = CRISPR gRNA sequence
  source 1..20: mol_type = other DNA
ggctcccttaggggatgacc

SEQ ID NO: 5777 - DNA, 20 bp, synthetic construct
  misc_feature 1..20: note = CRISPR gRNA sequence
  source 1..20: mol_type = other DNA
gacctggtctccaacaatct

SEQ ID NO: 5778 - DNA, 20 bp, synthetic construct
  misc_feature 1..20: note = CRISPR gRNA sequence
  source 1..20: mol_type = other DNA
cctggtctccaacaatctca

SEQ ID NO: 5779 - DNA, 20 bp, synthetic construct
  misc_feature 1..20: note = CRISPR gRNA sequence
  source 1..20: mol_type = other DNA
tccaacaatctcagagcgtt

SEQ ID NO: 5780 - DNA, 20 bp, synthetic construct
  misc_feature 1..20: note = CRISPR gRNA sequence
  source 1..20: mol_type = other DNA
caacaatctcagagcgtttg

SEQ ID NO: 5781 - DNA, 20 bp, synthetic construct
  misc_feature 1..20: note = CRISPR gRNA sequence
  source 1..20: mol_type = other DNA
aacaatctcagagcgtttgg

SEQ ID NO: 5782 - DNA, 20 bp, synthetic construct
  misc_feature 1..20: note = CRISPR gRNA sequence
  source 1..20: mol_type = other DNA
aatctcagagcgtttggagg

SEQ ID NO: 5783 - DNA, 20 bp, synthetic construct
  misc_feature 1..20: note = CRISPR gRNA sequence
  source 1..20: mol_type = other DNA
atctcagagcgtttggaggc

SEQ ID NO: 5784 - DNA, 20 bp, synthetic construct
  misc_feature 1..20: note = CRISPR gRNA sequence
  source 1..20: mol_type = other DNA
tctcagagcgtttggaggca

SEQ ID NO: 5785 - DNA, 20 bp, synthetic construct
  misc_feature 1..20: note = CRISPR gRNA sequence
  source 1..20: mol_type = other DNA
gcgtttggaggcagggtctt

SEQ ID NO: 5786 - DNA, 20 bp, synthetic construct
  misc_feature 1..20: note = CRISPR gRNA sequence
  source 1..20: mol_type = other DNA
gtttggaggcagggtctttg

SEQ ID NO: 5787 - DNA, 20 bp, synthetic construct
  misc_feature 1..20: note = CRISPR gRNA sequence
  source 1..20: mol_type = other DNA
cagggtctttggagatgact

SEQ ID NO: 5788 - DNA, 20 bp, synthetic construct
  misc_feature 1..20: note = CRISPR gRNA sequence
  source 1..20: mol_type = other DNA
ggtctttggagatgactgag

SEQ ID NO: 5789 - DNA, 20 bp, synthetic construct
  misc_feature 1..20: note = CRISPR gRNA sequence
  source 1..20: mol_type = other DNA
gtctttggagatgactgagt

SEQ ID NO: 5790 - DNA, 20 bp, synthetic construct
  misc_feature 1..20: note = CRISPR gRNA sequence
  source 1..20: mol_type = other DNA
tctttggagatgactgagtg

SEQ ID NO: 5791 - DNA, 20 bp, synthetic construct
  misc_feature 1..20: note = CRISPR gRNA sequence
  source 1..20: mol_type = other DNA
gatgactgagtggggaatcc

SEQ ID NO: 5792 - DNA, 20 bp, synthetic construct
  misc_feature 1..20: note = CRISPR gRNA sequence
  source 1..20: mol_type = other DNA
atgactgagtggggaatccc

SEQ ID NO: 5793 - DNA, 20 bp, synthetic construct
  misc_feature 1..20: note = CRISPR gRNA sequence
  source 1..20: mol_type = other DNA
ccccacacatgaacatcacc

SEQ ID NO: 5794 - DNA, 20 bp, synthetic construct
  misc_feature 1..20: note = CRISPR gRNA sequence
  source 1..20: mol_type = other DNA
cccacacatgaacatcacct

SEQ ID NO: 5795 - DNA, 20 bp, synthetic construct
  misc_feature 1..20: note = CRISPR gRNA sequence
  source 1..20: mol_type = other DNA
cctgggatgatcaacctgtt

SEQ ID NO: 5796 - DNA, 20 bp, synthetic construct
  misc_feature 1..20: note = CRISPR gRNA sequence
  source 1..20: mol_type = other DNA
ctgggatgatcaacctgttc

SEQ ID NO: 5797 - DNA, 20 bp, synthetic construct
  misc_feature 1..20: note = CRISPR gRNA sequence
  source 1..20: mol_type = other DNA
tgatcaacctgttcaggatg

SEQ ID NO: 5798 - DNA, 20 bp, synthetic construct
  misc_feature 1..20: note = CRISPR gRNA sequence
  source 1..20: mol_type = other DNA
gatcaacctgttcaggatgt

SEQ ID NO: 5799 - DNA, 20 bp, synthetic construct
  misc_feature 1..20: note = CRISPR gRNA sequence
  source 1..20: mol_type = other DNA
ctgttcaggatgtaggttcc

SEQ ID NO: 5800 - DNA, 20 bp, synthetic construct
  misc_feature 1..20: note = CRISPR gRNA sequence
  source 1..20: mol_type = other DNA
tgttcaggatgtaggttccc

SEQ ID NO: 5801 - DNA, 20 bp, synthetic construct
  misc_feature 1..20: note = CRISPR gRNA sequence
  source 1..20: mol_type = other DNA
taggttcccgggctcacccc

SEQ ID NO: 5802 - DNA, 20 bp, synthetic construct
  misc_feature 1..20: note = CRISPR gRNA sequence
  source 1..20: mol_type = other DNA
aggttcccgggctcaccccc

SEQ ID NO: 5803 - DNA, 20 bp, synthetic construct
  misc_feature 1..20: note = CRISPR gRNA sequence
  source 1..20: mol_type = other DNA
cccgggctcacccccaggcc

SEQ ID NO: 5804 - DNA, 20 bp, synthetic construct
  misc_feature 1..20: note = CRISPR gRNA sequence
  source 1..20: mol_type = other DNA
ggctcacccccaggcccggt

SEQ ID NO: 5805 - DNA, 20 bp, synthetic construct
  misc_feature 1..20: note = CRISPR gRNA sequence
  source 1..20: mol_type = other DNA
cacccccaggcccggttggc

SEQ ID NO: 5806 - DNA, 20 bp, synthetic construct
  misc_feature 1..20: note = CRISPR gRNA sequence
  source 1..20: mol_type = other DNA
acccccaggcccggttggct

SEQ ID NO: 5807 - DNA, 20 bp, synthetic construct
  misc_feature 1..20: note = CRISPR gRNA sequence
  source 1..20: mol_type = other DNA
caggcccggttggctaggcc

SEQ ID NO: 5808 - DNA, 20 bp, synthetic construct
  misc_feature 1..20: note = CRISPR gRNA sequence
  source 1..20: mol_type = other DNA
aggcccggttggctaggcct

SEQ ID NO: 5809 - DNA, 20 bp, synthetic construct
  misc_feature 1..20: note = CRISPR gRNA sequence
  source 1..20: mol_type = other DNA
ggcccggttggctaggcctg

SEQ ID NO: 5810 - DNA, 20 bp, synthetic construct
  misc_feature 1..20: note = CRISPR gRNA sequence
  source 1..20: mol_type = other DNA
cggttggctaggcctggggt

SEQ ID NO: 5811 - DNA, 20 bp, synthetic construct
  misc_feature 1..20: note = CRISPR gRNA sequence
  source 1..20: mol_type = other DNA
ggttggctaggcctggggtg

SEQ ID NO: 5812 - DNA, 20 bp, synthetic construct
  misc_feature 1..20: note = CRISPR gRNA sequence
  source 1..20: mol_type = other DNA
gctaggcctggggtgaggct

SEQ ID NO: 5813 - DNA, 20 bp, synthetic construct
  misc_feature 1..20: note = CRISPR gRNA sequence
  source 1..20: mol_type = other DNA
ggggtgaggctgagatcctg

SEQ ID NO: 5814 - DNA, 20 bp, synthetic construct
  misc_feature 1..20: note = CRISPR gRNA sequence
  source 1..20: mol_type = other DNA
gggtgaggctgagatcctgc

SEQ ID NO: 5815 - DNA, 20 bp, synthetic construct
  misc_feature 1..20: note = CRISPR gRNA sequence
  source 1..20: mol_type = other DNA
gcaggttaaaccatctatcc

SEQ ID NO: 5816 - DNA, 20 bp, synthetic construct
  misc_feature 1..20: note = CRISPR gRNA sequence
  source 1..20: mol_type = other DNA
caggttaaaccatctatccc

SEQ ID NO: 5817 - DNA, 20 bp, synthetic construct
  misc_feature 1..20: note = CRISPR gRNA sequence
  source 1..20: mol_type = other DNA
gtgactccaatgttcgtttg

SEQ ID NO: 5818 - DNA, 20 bp, synthetic construct
  misc_feature 1..20: note = CRISPR gRNA sequence
  source 1..20: mol_type = other DNA
tgactccaatgttcgtttgt

SEQ ID NO: 5819 - DNA, 20 bp, synthetic construct
  misc_feature 1..20: note = CRISPR gRNA sequence
  source 1..20: mol_type = other DNA
gactccaatgttcgtttgtg

SEQ ID NO: 5820 - DNA, 20 bp, synthetic construct
  misc_feature 1..20: note = CRISPR gRNA sequence
  source 1..20: mol_type = other DNA
aatgttcgtttgtggggcaa

SEQ ID NO: 5821 - DNA, 20 bp, synthetic construct
  misc_feature 1..20: note = CRISPR gRNA sequence
  source 1..20: mol_type = other DNA
ttgtggggcaaaagtccctc

SEQ ID NO: 5822 - DNA, 20 bp, synthetic construct
  misc_feature 1..20: note = CRISPR gRNA sequence
  source 1..20: mol_type = other DNA
ggggcaaaagtccctcaagt

SEQ ID NO: 5823 - DNA, 20 bp, synthetic construct
  misc_feature 1..20: note = CRISPR gRNA sequence
  source 1..20: mol_type = other DNA
ggcaaaagtccctcaagtca

SEQ ID NO: 5824 - DNA, 20 bp, synthetic construct
  misc_feature 1..20: note = CRISPR gRNA sequence
  source 1..20: mol_type = other DNA
gtccctcaagtcagagacac

SEQ ID NO: 5825 - DNA, 20 bp, synthetic construct
  misc_feature 1..20: note = CRISPR gRNA sequence
  source 1..20: mol_type = other DNA
tccctcaagtcagagacact

SEQ ID NO: 5826 - DNA, 20 bp, synthetic construct
  misc_feature 1..20: note = CRISPR gRNA sequence
  source 1..20: mol_type = other DNA
cctcaagtcagagacactgg

SEQ ID NO: 5827 - DNA, 20 bp, synthetic construct
  misc_feature 1..20: note = CRISPR gRNA sequence
  source 1..20: mol_type = other DNA
ctcaagtcagagacactggg

SEQ ID NO: 5828 - DNA, 20 bp, synthetic construct
  misc_feature 1..20: note = CRISPR gRNA sequence
  source 1..20: mol_type = other DNA
gacactgggaggcgctgatg

SEQ ID NO: 5829 - DNA, 20 bp, synthetic construct
  misc_feature 1..20: note = CRISPR gRNA sequence
  source 1..20: mol_type = other DNA
ccctgttacaaaacctctat

SEQ ID NO: 5830 - DNA, 20 bp, synthetic construct
  misc_feature 1..20: note = CRISPR gRNA sequence
  source 1..20: mol_type = other DNA
ttacaaaacctctatcagaa

SEQ ID NO: 5831 - DNA, 20 bp, synthetic construct
  misc_feature 1..20: note = CRISPR gRNA sequence
  source 1..20: mol_type = other DNA
tacaaaacctctatcagaaa

SEQ ID NO: 5832 - DNA, 20 bp, synthetic construct
  misc_feature 1..20: note = CRISPR gRNA sequence
  source 1..20: mol_type = other DNA
caaaacctctatcagaaaag

SEQ ID NO: 5833 - DNA, 20 bp, synthetic construct
  misc_feature 1..20: note = CRISPR gRNA sequence
  source 1..20: mol_type = other DNA
ctctatcagaaaaggagtac

SEQ ID NO: 5834 - DNA, 20 bp, synthetic construct
  misc_feature 1..20: note = CRISPR gRNA sequence
  source 1..20: mol_type = other DNA
tctatcagaaaaggagtacc

SEQ ID NO: 5835 - DNA, 20 bp, synthetic construct
  misc_feature 1..20: note = CRISPR gRNA sequence
  source 1..20: mol_type = other DNA
tatcagaaaaggagtaccag

SEQ ID NO: 5836 - DNA, 20 bp, synthetic construct
  misc_feature 1..20: note = CRISPR gRNA sequence
  source 1..20: mol_type = other DNA
atcagaaaaggagtaccagg

SEQ ID NO: 5837 - DNA, 20 bp, synthetic construct
  misc_feature 1..20: note = CRISPR gRNA sequence
  source 1..20: mol_type = other DNA
ttgttttgcttaacgccaca

SEQ ID NO: 5838 - DNA, 20 bp, synthetic construct
  misc_feature 1..20: note = CRISPR gRNA sequence
  source 1..20: mol_type = other DNA
tttgcttaacgccacatagc

SEQ ID NO: 5839 - DNA, 20 bp, synthetic construct
  misc_feature 1..20: note = CRISPR gRNA sequence
  source 1..20: mol_type = other DNA
gcttaacgccacatagcaag

SEQ ID NO: 5840 - DNA, 20 bp, synthetic construct
  misc_feature 1..20: note = CRISPR gRNA sequence
  source 1..20: mol_type = other DNA
gccacatagcaagcagtttg

SEQ ID NO: 5841 - DNA, 20 bp, synthetic construct
  misc_feature 1..20: note = CRISPR gRNA sequence
  source 1..20: mol_type = other DNA
tagcaagcagtttgcagacg

SEQ ID NO: 5842 - DNA, 20 bp, synthetic construct
  misc_feature 1..20: note = CRISPR gRNA sequence
  source 1..20: mol_type = other DNA
agcaagcagtttgcagacgc

SEQ ID NO: 5843 - DNA, 20 bp, synthetic construct
  misc_feature 1..20: note = CRISPR gRNA sequence
  source 1..20: mol_type = other DNA
cagacgcaggatttgaaccc

SEQ ID NO: 5844 - DNA, 20 bp, synthetic construct
  misc_feature 1..20: note = CRISPR gRNA sequence
  source 1..20: mol_type = other DNA
gatttgaaccctggtctact

SEQ ID NO: 5845 - DNA, 20 bp, synthetic construct
  misc_feature 1..20: note = CRISPR gRNA sequence
  source 1..20: mol_type = other DNA
tttgaaccctggtctactga

SEQ ID NO: 5846 - DNA, 20 bp, synthetic construct
  misc_feature 1..20: note = CRISPR gRNA sequence
  source 1..20: mol_type = other DNA
accctggtctactgagagcc

SEQ ID NO: 5847 - DNA, 20 bp, synthetic construct
  misc_feature 1..20: note = CRISPR gRNA sequence
  source 1..20: mol_type = other DNA
ggtctactgagagcccagcc

SEQ ID NO: 5848 - DNA, 20 bp, synthetic construct
  misc_feature 1..20: note = CRISPR gRNA sequence
  source 1..20: mol_type = other DNA
actgagagcccagcccagtg

SEQ ID NO: 5849 - DNA, 20 bp, synthetic construct
  misc_feature 1..20: note = CRISPR gRNA sequence
  source 1..20: mol_type = other DNA
agagcccagcccagtgcagc

SEQ ID NO: 5850 - DNA, 20 bp, synthetic construct
  misc_feature 1..20: note = CRISPR gRNA sequence
  source 1..20: mol_type = other DNA
gcccagcccagtgcagcaag

SEQ ID NO: 5851 - DNA, 20 bp, synthetic construct
  misc_feature 1..20: note = CRISPR gRNA sequence
  source 1..20: mol_type = other DNA
gatgtgaacctccacaaatg

SEQ ID NO: 5852 - DNA, 20 bp, synthetic construct
  misc_feature 1..20: note = CRISPR gRNA sequence
  source 1..20: mol_type = other DNA
atgtgaacctccacaaatgc

SEQ ID NO: 5853 - DNA, 20 bp, synthetic construct
  misc_feature 1..20: note = CRISPR gRNA sequence
  source 1..20: mol_type = other DNA
tgtgaacctccacaaatgca

SEQ ID NO: 5854 - DNA, 20 bp, synthetic construct
  misc_feature 1..20: note = CRISPR gRNA sequence
  source 1..20: mol_type = other DNA
gaacctccacaaatgcaggg

SEQ ID NO: 5855 - DNA, 20 bp, synthetic construct
  misc_feature 1..20: note = CRISPR gRNA sequence
  source 1..20: mol_type = other DNA
aacctccacaaatgcagggc

SEQ ID NO: 5856 - DNA, 20 bp, synthetic construct
  misc_feature 1..20: note = CRISPR gRNA sequence
  source 1..20: mol_type = other DNA
cacaaatgcagggcaggtcc

SEQ ID NO: 5857 - DNA, 20 bp, synthetic construct
  misc_feature 1..20: note = CRISPR gRNA sequence
  source 1..20: mol_type = other DNA
acaaatgcagggcaggtccc

SEQ ID NO: 5858 - DNA, 20 bp, synthetic construct
  misc_feature 1..20: note = CRISPR gRNA sequence
  source 1..20: mol_type = other DNA
aatgcagggcaggtcccagg

SEQ ID NO: 5859 - DNA, 20 bp, synthetic construct
  misc_feature 1..20: note = CRISPR gRNA sequence
  source 1..20: mol_type = other DNA
cagggcaggtcccaggcagt

SEQ ID NO: 5860 - DNA, 20 bp, synthetic construct
  misc_feature 1..20: note = CRISPR gRNA sequence
  source 1..20: mol_type = other DNA
gggcaggtcccaggcagtca

SEQ ID NO: 5861 - DNA, 20 bp, synthetic construct
  misc_feature 1..20: note = CRISPR gRNA sequence
  source 1..20: mol_type = other DNA
gcaggtcccaggcagtcaga

SEQ ID NO: 5862 - DNA, 20 bp, synthetic construct
  misc_feature 1..20: note = CRISPR gRNA sequence
  source 1..20: mol_type = other DNA
gagagaaacctgttgatacc

SEQ ID NO: 5863 - DNA, 20 bp, synthetic construct
  misc_feature 1..20: note = CRISPR gRNA sequence
  source 1..20: mol_type = other DNA
ttgatacccagtctgtctga

SEQ ID NO: 5864 - DNA, 20 bp, synthetic construct
  misc_feature 1..20: note = CRISPR gRNA sequence
  source 1..20: mol_type = other DNA
tacccagtctgtctgatggc

SEQ ID NO: 5865 - DNA, 20 bp, synthetic construct
  misc_feature 1..20: note = CRISPR gRNA sequence
  source 1..20: mol_type = other DNA
acccagtctgtctgatggct

SEQ ID NO: 5866 - DNA, 20 bp, synthetic construct
  misc_feature 1..20: note = CRISPR gRNA sequence
  source 1..20: mol_type = other DNA
cccagtctgtctgatggctg

SEQ ID NO: 5867 - DNA, 20 bp, synthetic construct
  misc_feature 1..20: note = CRISPR gRNA sequence
  source 1..20: mol_type = other DNA
tctgtctgatggctggggct

SEQ ID NO: 5868 - DNA, 20 bp, synthetic construct
  misc_feature 1..20: note = CRISPR gRNA sequence
  source 1..20: mol_type = other DNA
ggggcttggtttcatgtcct

SEQ ID NO: 5869 - DNA, 20 bp, synthetic construct
  misc_feature 1..20: note = CRISPR gRNA sequence
  source 1..20: mol_type = other DNA
tggtttcatgtcctaagacc

SEQ ID NO: 5870 - DNA, 20 bp, synthetic construct
  misc_feature 1..20: note = CRISPR gRNA sequence
  source 1..20: mol_type = other DNA
catgtcctaagacccagcct

SEQ ID NO: 5871 - DNA, 20 bp, synthetic construct
  misc_feature 1..20: note = CRISPR gRNA sequence
  source 1..20: mol_type = other DNA
gacccagcctcagatacctt

SEQ ID NO: 5872 - DNA, 20 bp, synthetic construct
  misc_feature 1..20: note = CRISPR gRNA sequence
  source 1..20: mol_type = other DNA
ccagcctcagataccttgag

SEQ ID NO: 5873 - DNA, 20 bp, synthetic construct
  misc_feature 1..20: note = CRISPR gRNA sequence
  source 1..20: mol_type = other DNA
agcctcagataccttgagaa

SEQ ID NO: 5874 - DNA, 20 bp, synthetic construct
  misc_feature 1..20: note = CRISPR gRNA sequence
  source 1..20: mol_type = other DNA
ctcagataccttgagaagag

SEQ ID NO: 5875 - DNA, 20 bp, synthetic construct
  misc_feature 1..20: note = CRISPR gRNA sequence
  source 1..20: mol_type = other DNA
taccttgagaagagcagaat

SEQ ID NO: 5876 - DNA, 20 bp, synthetic construct
  misc_feature 1..20: note = CRISPR gRNA sequence
  source 1..20: mol_type = other DNA
gcagaatcagaaattaaccc

SEQ ID NO: 5877 - DNA, 20 bp, synthetic construct
  misc_feature 1..20: note = CRISPR gRNA sequence
  source 1..20: mol_type = other DNA
cagaatcagaaattaaccca

SEQ ID NO: 5878 - DNA, 20 bp, synthetic construct
  misc_feature 1..20: note = CRISPR gRNA sequence
  source 1..20: mol_type = other DNA
aaattaacccaaggaaactc

SEQ ID NO: 5879 - DNA, 20 bp, synthetic construct
  misc_feature 1..20: note = CRISPR gRNA sequence
  source 1..20: mol_type = other DNA
aacccaaggaaactctggat

SEQ ID NO: 5880 - DNA, 20 bp, synthetic construct
  misc_feature 1..20: note = CRISPR gRNA sequence
  source 1..20: mol_type = other DNA
aggaaactctggattagttc

SEQ ID NO: 5881 - DNA, 20 bp, synthetic construct
  misc_feature 1..20: note = CRISPR gRNA sequence
  source 1..20: mol_type = other DNA
ggaaactctggattagttcc

SEQ ID NO: 5882 - DNA, 20 bp, synthetic construct
  misc_feature 1..20: note = CRISPR gRNA sequence
  source 1..20: mol_type = other DNA
ctggattagttccaggcaat

SEQ ID NO: 5883 - DNA, 20 bp, synthetic construct
  misc_feature 1..20: note = CRISPR gRNA sequence
  source 1..20: mol_type = other DNA
tggattagttccaggcaatc

SEQ ID NO: 5884 - DNA, 20 bp, synthetic construct
  misc_feature 1..20: note = CRISPR gRNA sequence
  source 1..20: mol_type = other DNA
ggattagttccaggcaatca

SEQ ID NO: 5885 - DNA, 20 bp, synthetic construct
  misc_feature 1..20: note = CRISPR gRNA sequence
  source 1..20: mol_type = other DNA
ttagttccaggcaatcaggg

SEQ ID NO: 5886 - DNA, 20 bp, synthetic construct
  misc_feature 1..20: note = CRISPR gRNA sequence
  source 1..20: mol_type = other DNA
gttccaggcaatcagggaag

SEQ ID NO: 5887 - DNA, 20 bp, synthetic construct
  misc_feature 1..20: note = CRISPR gRNA sequence
  source 1..20: mol_type = other DNA
caggcaatcagggaagtggc

SEQ ID NO: 5888 - DNA, 20 bp, synthetic construct
  misc_feature 1..20: note = CRISPR gRNA sequence
  source 1..20: mol_type = other DNA
ggcaatcagggaagtggctg

SEQ ID NO: 5889 - DNA, 20 bp, synthetic construct
  misc_feature 1..20: note = CRISPR gRNA sequence
  source 1..20: mol_type = other DNA
gcaatcagggaagtggctgg

SEQ ID NO: 5890 - DNA, 20 bp, synthetic construct
  misc_feature 1..20: note = CRISPR gRNA sequence
  source 1..20: mol_type = other DNA
caatcagggaagtggctgga

SEQ ID NO: 5891 - DNA, 20 bp, synthetic construct
  misc_feature 1..20: note = CRISPR gRNA sequence
  source 1..20: mol_type = other DNA
atcagggaagtggctggagg

SEQ ID NO: 5892 - DNA, 20 bp, synthetic construct
  misc_feature 1..20: note = CRISPR gRNA sequence
  source 1..20: mol_type = other DNA
tcagggaagtggctggaggg

SEQ ID NO: 5893 - DNA, 20 bp, synthetic construct
  misc_feature 1..20: note = CRISPR gRNA sequence
  source 1..20: mol_type = other DNA
gggaagtggctggagggagg

SEQ ID NO: 5894 - DNA, 20 bp, synthetic construct
  misc_feature 1..20: note = CRISPR gRNA sequence
  source 1..20: mol_type = other DNA
ggaagtggctggagggaggt

SEQ ID NO: 5895 - DNA, 20 bp, synthetic construct
  misc_feature 1..20: note = CRISPR gRNA sequence
  source 1..20: mol_type = other DNA
ggagggaggtaggaaacttc

SEQ ID NO: 5896 - DNA, 20 bp, synthetic construct
  misc_feature 1..20: note = CRISPR gRNA sequence
  source 1..20: mol_type = other DNA
aggtaggaaacttctggact

SEQ ID NO: 5897 - DNA, 20 bp, synthetic construct
  misc_feature 1..20: note = CRISPR gRNA sequence
  source 1..20: mol_type = other DNA
gaaacttctggacttagcct

SEQ ID NO: 5898 - DNA, 20 bp, synthetic construct
  misc_feature 1..20: note = CRISPR gRNA sequence
  source 1..20: mol_type = other DNA
cttagcctcagatttgcctt

SEQ ID NO: 5899 - DNA, 20 bp, synthetic construct
  misc_feature 1..20: note = CRISPR gRNA sequence
  source 1..20: mol_type = other DNA
ttgccttgagtcacactgac

SEQ ID NO: 5900 - DNA, 20 bp, synthetic construct
  misc_feature 1..20: note = CRISPR gRNA sequence
  source 1..20: mol_type = other DNA
acaagtgacttcccctctct

SEQ ID NO: 5901 - DNA, 20 bp, synthetic construct
  misc_feature 1..20: note = CRISPR gRNA sequence
  source 1..20: mol_type = other DNA
caagtgacttcccctctctg

SEQ ID NO: 5902 - DNA, 20 bp, synthetic construct
  misc_feature 1..20: note = CRISPR gRNA sequence
  source 1..20: mol_type = other DNA
tctgaggttcatctgtaaaa

SEQ ID NO: 5903 - DNA, 20 bp, synthetic construct
  misc_feature 1..20: note = CRISPR gRNA sequence
  source 1..20: mol_type = other DNA
ctgtaaaatggataaaacat

SEQ ID NO: 5904 - DNA, 20 bp, synthetic construct
  misc_feature 1..20: note = CRISPR gRNA sequence
  source 1..20: mol_type = other DNA
gtaaaatggataaaacatga

SEQ ID NO: 5905 - DNA, 20 bp, synthetic construct
  misc_feature 1..20: note = CRISPR gRNA sequence
  source 1..20: mol_type = other DNA
ttgatgatgtctgatgtgta

SEQ ID NO: 5906 - DNA, 20 bp, synthetic construct
  misc_feature 1..20: note = CRISPR gRNA sequence
  source 1..20: mol_type = other DNA
atgtctgatgtgtacagaaa

SEQ ID NO: 5907 - DNA, 20 bp, synthetic construct
  misc_feature 1..20: note = CRISPR gRNA sequence
  source 1..20: mol_type = other DNA
tgtgtacagaaaaagcactt

SEQ ID NO: 5908 - DNA, 20 bp, synthetic construct
  misc_feature 1..20: note = CRISPR gRNA sequence
  source 1..20: mol_type = other DNA
agcactttagaaaaccacca

SEQ ID NO: 5909 - DNA, 20 bp, synthetic construct
  misc_feature 1..20: note = CRISPR gRNA sequence
  source 1..20: mol_type = other DNA
accaaagaatattcatgcat

SEQ ID NO: 5910 - DNA, 20 bp, synthetic construct
  misc_feature 1..20: note = CRISPR gRNA sequence
  source 1..20: mol_type = other DNA
ccaaagaatattcatgcatt

SEQ ID NO: 5911 - DNA, 20 bp, synthetic construct
  misc_feature 1..20: note = CRISPR gRNA sequence
  source 1..20: mol_type = other DNA
tgcattgggaataattatta

SEQ ID NO: 5912 - DNA, 20 bp, synthetic construct
  misc_feature 1..20: note = CRISPR gRNA sequence
  source 1..20: mol_type = other DNA
aataattattatagatccta

SEQ ID NO: 5913 - DNA, 20 bp, synthetic construct
  misc_feature 1..20: note = CRISPR gRNA sequence
  source 1..20: mol_type = other DNA
ataattattatagatcctaa

SEQ ID NO: 5914 - DNA, 20 bp, synthetic construct
  misc_feature 1..20: note = CRISPR gRNA sequence
  source 1..20: mol_type = other DNA
taattattatagatcctaaa

SEQ ID NO: 5915 - DNA, 20 bp, synthetic construct
  misc_feature 1..20: note = CRISPR gRNA sequence
  source 1..20: mol_type = other DNA
tagatcctaaagggattgtt

SEQ ID NO: 5916 - DNA, 20 bp, synthetic construct
  misc_feature 1..20: note = CRISPR gRNA sequence
  source 1..20: mol_type = other DNA
tcctaaagggattgtttaga

SEQ ID NO: 5917 - DNA, 20 bp, synthetic construct
  misc_feature 1..20: note = CRISPR gRNA sequence
  source 1..20: mol_type = other DNA
aagggattgtttagaaagat

SEQ ID NO: 5918 - DNA, 20 bp, synthetic construct
  misc_feature 1..20: note = CRISPR gRNA sequence
  source 1..20: mol_type = other DNA
gggattgtttagaaagatca

SEQ ID NO: 5919 - DNA, 20 bp, synthetic construct
  misc_feature 1..20: note = CRISPR gRNA sequence
  source 1..20: mol_type = other DNA
gattgtttagaaagatcaga

SEQ ID NO: 5920 - DNA, 20 bp, synthetic construct
  misc_feature 1..20: note = CRISPR gRNA sequence
  source 1..20: mol_type = other DNA
attgtttagaaagatcagag

SEQ ID NO: 5921 - DNA, 20 bp, synthetic construct
  misc_feature 1..20: note = CRISPR gRNA sequence
  source 1..20: mol_type = other DNA
ttgtttagaaagatcagaga

SEQ ID NO: 5922 - DNA, 20 bp, synthetic construct
  misc_feature 1..20: note = CRISPR gRNA sequence
  source 1..20: mol_type = other DNA
tgtttagaaagatcagagag

SEQ ID NO: 5923 - DNA, 20 bp, synthetic construct
  misc_feature 1..20: note = CRISPR gRNA sequence
  source 1..20: mol_type = other DNA
tagaaagatcagagaggggc

SEQ ID NO: 5924 - DNA, 20 bp, synthetic construct
  misc_feature 1..20: note = CRISPR gRNA sequence
  source 1..20: mol_type = other DNA
agaaagatcagagaggggcc

SEQ ID NO: 5925 - DNA, 20 bp, synthetic construct
  misc_feature 1..20: note = CRISPR gRNA sequence
  source 1..20: mol_type = other DNA
aaagatcagagaggggccgg

SEQ ID NO: 5926 - DNA, 20 bp, synthetic construct
  misc_feature 1..20: note = CRISPR gRNA sequence
  source 1..20: mol_type = other DNA
gatcagagaggggccgggag

SEQ ID NO: 5927 - DNA, 20 bp, synthetic construct
  misc_feature 1..20: note = CRISPR gRNA sequence
  source 1..20: mol_type = other DNA
cagagaggggccgggagcag

SEQ ID NO: 5928 - DNA, 20 bp, synthetic construct
  misc_feature 1..20: note = CRISPR gRNA sequence
  source 1..20: mol_type = other DNA
gtggttcacacctgtaatcc

SEQ ID NO: 5929 - DNA, 20 bp, synthetic construct
  misc_feature 1..20: note = CRISPR gRNA sequence
  source 1..20: mol_type = other DNA
cacctgtaatcctagcactt

SEQ ID NO: 5930 - DNA, 20 bp, synthetic construct
  misc_feature 1..20: note = CRISPR gRNA sequence
  source 1..20: mol_type = other DNA
acctgtaatcctagcacttt

SEQ ID NO: 5931 - DNA, 20 bp, synthetic construct
  misc_feature 1..20: note = CRISPR gRNA sequence
  source 1..20: mol_type = other DNA
ctgtaatcctagcactttgg

SEQ ID NO: 5932 - DNA, 20 bp, synthetic construct
  misc_feature 1..20: note = CRISPR gRNA sequence
  source 1..20: mol_type = other DNA
tgtaatcctagcactttggg

SEQ ID NO: 5933 - DNA, 20 bp, synthetic construct
  misc_feature 1..20: note = CRISPR gRNA sequence
  source 1..20: mol_type = other DNA
tcctagcactttgggaggcc

SEQ ID NO: 5934 - DNA, 20 bp, synthetic construct
  misc_feature 1..20: note = CRISPR gRNA sequence
  source 1..20: mol_type = other DNA
cctagcactttgggaggccg

SEQ ID NO: 5935 - DNA, 20 bp, synthetic construct
  misc_feature 1..20: note = CRISPR gRNA sequence
  source 1..20: mol_type = other DNA
agcactttgggaggccgagg

SEQ ID NO: 5936 - DNA, 20 bp, synthetic construct
  misc_feature 1..20: note = CRISPR gRNA sequence
  source 1..20: mol_type = other DNA
gcactttgggaggccgaggc

SEQ ID NO: 5937 - DNA, 20 bp, synthetic construct
  misc_feature 1..20: note = CRISPR gRNA sequence
  source 1..20: mol_type = other DNA
ctttgggaggccgaggcggg

SEQ ID NO: 5938 - DNA, 20 bp, synthetic construct
  misc_feature 1..20: note = CRISPR gRNA sequence
  source 1..20: mol_type = other DNA
ccgaggcgggtggattgctt

SEQ ID NO: 5939 - DNA, 20 bp, synthetic construct
  misc_feature 1..20: note = CRISPR gRNA sequence
  source 1..20: mol_type = other DNA
cgaggcgggtggattgcttg

SEQ ID NO: 5940 - DNA, 20 bp, synthetic construct
  misc_feature 1..20: note = CRISPR gRNA sequence
  source 1..20: mol_type = other DNA
gcgggtggattgcttgaggc

SEQ ID NO: 5941 - DNA, 20 bp, synthetic construct
  misc_feature 1..20: note = CRISPR gRNA sequence
  source 1..20: mol_type = other DNA
cgggtggattgcttgaggcc

SEQ ID NO: 5942 - DNA, 20 bp, synthetic construct
  misc_feature 1..20: note = CRISPR gRNA sequence
  source 1..20: mol_type = other DNA
ggtggattgcttgaggccag

SEQ ID NO: 5943 - DNA, 20 bp, synthetic construct
  misc_feature 1..20: note = CRISPR gRNA sequence
  source 1..20: mol_type = other DNA
ttgcttgaggccaggagttc

SEQ ID NO: 5944 - DNA, 20 bp, synthetic construct
  misc_feature 1..20: note = CRISPR gRNA sequence
  source 1..20: mol_type = other DNA
tgaggccaggagttcaagac

SEQ ID NO: 5945 - DNA, 20 bp, synthetic construct
  misc_feature 1..20: note = CRISPR gRNA sequence
  source 1..20: mol_type = other DNA
ccaggagttcaagaccagcc

SEQ ID NO: 5946 - DNA, 20 bp, synthetic construct
  misc_feature 1..20: note = CRISPR gRNA sequence
  source 1..20: mol_type = other DNA
caggagttcaagaccagcct

SEQ ID NO: 5947 - DNA, 20 bp, synthetic construct
  misc_feature 1..20: note = CRISPR gRNA sequence
  source 1..20: mol_type = other DNA
caagaccagcctgggcaacc

SEQ ID NO: 5948 - DNA, 20 bp, synthetic construct
  misc_feature 1..20: note = CRISPR gRNA sequence
  source 1..20: mol_type = other DNA
agaccagcctgggcaacctg

SEQ ID NO: 5949 - DNA, 20 bp, synthetic construct
  misc_feature 1..20: note = CRISPR gRNA sequence
  source 1..20: mol_type = other DNA
taaaacacttttttgtgttt

SEQ ID NO: 5950 - DNA, 20 bp, synthetic construct
  misc_feature 1..20: note = CRISPR gRNA sequence
  source 1..20: mol_type = other DNA
acacttttttgtgttttagc

SEQ ID NO: 5951 - DNA, 20 bp, synthetic construct
  misc_feature 1..20: note = CRISPR gRNA sequence
  source 1..20: mol_type = other DNA
cacttttttgtgttttagcc

SEQ ID NO: 5952 - DNA, 20 bp, synthetic construct
  misc_feature 1..20: note = CRISPR gRNA sequence
  source 1..20: mol_type = other DNA
ttttgtgttttagccgggca

SEQ ID NO: 5953 - DNA, 20 bp, synthetic construct
  misc_feature 1..20: note = CRISPR gRNA sequence
  source 1..20: mol_type = other DNA
tgtgttttagccgggcatgg

SEQ ID NO: 5954 - DNA, 20 bp, synthetic construct
  misc_feature 1..20: note = CRISPR gRNA sequence
  source 1..20: mol_type = other DNA
cacctgtaatctcaactact

SEQ ID NO: 5955 - DNA, 20 bp, synthetic construct
  misc_feature 1..20: note = CRISPR gRNA sequence
  source 1..20: mol_type = other DNA
acctgtaatctcaactactt

SEQ ID NO: 5956 - DNA, 20 bp, synthetic construct
  misc_feature 1..20: note = CRISPR gRNA sequence
  source 1..20: mol_type = other DNA
ctgtaatctcaactacttgg

SEQ ID NO: 5957 - DNA, 20 bp, synthetic construct
  misc_feature 1..20: note = CRISPR gRNA sequence
  source 1..20: mol_type = other DNA
tgtaatctcaactacttggg

SEQ ID NO: 5958 - DNA, 20 bp, synthetic construct
  misc_feature 1..20: note = CRISPR gRNA sequence
  source 1..20: mol_type = other DNA
tctcaactacttgggaggct

SEQ ID NO: 5959 - DNA, 20 bp, synthetic construct
  misc_feature 1..20: note = CRISPR gRNA sequence
  source 1..20: mol_type = other DNA
ctcaactacttgggaggctg

SEQ ID NO: 5960 - DNA, 20 bp, synthetic construct
  misc_feature 1..20: note = CRISPR gRNA sequence
  source 1..20: mol_type = other DNA
tacttgggaggctgaggcac

SEQ ID NO: 5961 - DNA, 20 bp, synthetic construct
  misc_feature 1..20: note = CRISPR gRNA sequence
  source 1..20: mol_type = other DNA
cacgagaatcacttgaaccc

SEQ ID NO: 5962 - DNA, 20 bp, synthetic construct
  misc_feature 1..20: note = CRISPR gRNA sequence
  source 1..20: mol_type = other DNA
cgagaatcacttgaacccaa

SEQ ID NO: 5963 - DNA, 20 bp, synthetic construct
  misc_feature 1..20: note = CRISPR gRNA sequence
  source 1..20: mol_type = other DNA
gagaatcacttgaacccaag

SEQ ID NO: 5964 - DNA, 20 bp, synthetic construct
  misc_feature 1..20: note = CRISPR gRNA sequence
  source 1..20: mol_type = other DNA
aatcacttgaacccaagagg

SEQ ID NO: 5965 - DNA, 20 bp, synthetic construct
  misc_feature 1..20: note = CRISPR gRNA sequence
  source 1..20: mol_type = other DNA
tcacttgaacccaagaggcg

SEQ ID NO: 5966 - DNA, 20 bp, synthetic construct
  misc_feature 1..20: note = CRISPR gRNA sequence
  source 1..20: mol_type = other DNA
ccaagaggcggagtttaccc

SEQ ID NO: 5967 - DNA, 20 bp, synthetic construct
  misc_feature 1..20: note = CRISPR gRNA sequence
  source 1..20: mol_type = other DNA
aagaggcggagtttacccga

SEQ ID NO: 5968 - DNA, 20 bp, synthetic construct
  misc_feature 1..20: note = CRISPR gRNA sequence
  source 1..20: mol_type = other DNA
agaggcggagtttacccgag

SEQ ID NO: 5969 - DNA, 20 bp, synthetic construct
  misc_feature 1..20: note = CRISPR gRNA sequence
  source 1..20: mol_type = other DNA
ggcggagtttacccgagagg

SEQ ID NO: 5970 - DNA, 20 bp, synthetic construct
  misc_feature 1..20: note = CRISPR gRNA sequence
  source 1..20: mol_type = other DNA
cggagtttacccgagaggtg

SEQ ID NO: 5971 - DNA, 20 bp, synthetic construct
  misc_feature 1..20: note = CRISPR gRNA sequence
  source 1..20: mol_type = other DNA
ggagtttacccgagaggtgg

SEQ ID NO: 5972 - DNA, 20 bp, synthetic construct
  misc_feature 1..20: note = CRISPR gRNA sequence
  source 1..20: mol_type = other DNA
ccgagaggtggaggttaccc

SEQ ID NO: 5973 - DNA, 20 bp, synthetic construct
  misc_feature 1..20: note = CRISPR gRNA sequence
  source 1..20: mol_type = other DNA
gagaggtggaggttacccga

SEQ ID NO: 5974 - DNA, 20 bp, synthetic construct
  misc_feature 1..20: note = CRISPR gRNA sequence
  source 1..20: mol_type = other DNA
gtggaggttacccgagagct

SEQ ID NO: 5975 - DNA, 20 bp, synthetic construct
  misc_feature 1..20: note = CRISPR gRNA sequence
  source 1..20: mol_type = other DNA
gagattgcaccactgcacgc

SEQ ID NO: 5976 - DNA, 20 bp, synthetic construct
  misc_feature 1..20: note = CRISPR gRNA sequence
  source 1..20: mol_type = other DNA
tgcaccactgcacgccagcc

SEQ ID NO: 5977 - DNA, 20 bp, synthetic construct
  misc_feature 1..20: note = CRISPR gRNA sequence
  source 1..20: mol_type = other DNA
gcaccactgcacgccagcct

SEQ ID NO: 5978 - DNA, 20 bp, synthetic construct
  misc_feature 1..20: note = CRISPR gRNA sequence
  source 1..20: mol_type = other DNA
ctgcacgccagcctgggcaa

SEQ ID NO: 5979 - DNA, 20 bp, synthetic construct
  misc_feature 1..20: note = CRISPR gRNA sequence
  source 1..20: mol_type = other DNA
gcacgccagcctgggcaaca

SEQ ID NO: 5980 - DNA, 20 bp, synthetic construct
  misc_feature 1..20: note = CRISPR gRNA sequence
  source 1..20: mol_type = other DNA
gccagcctgggcaacagagc

SEQ ID NO: 5981 - DNA, 20 bp, synthetic construct
  misc_feature 1..20: note = CRISPR gRNA sequence
  source 1..20: mol_type = other DNA
gcaacagagcaagactgtct

SEQ ID NO: 5982 - DNA, 20 bp, synthetic construct
  misc_feature 1..20: note = CRISPR gRNA sequence
  source 1..20: mol_type = other DNA
caacagagcaagactgtctc

SEQ ID NO: 5983 - DNA, 20 bp, synthetic construct
  misc_feature 1..20: note = CRISPR gRNA sequence
  source 1..20: mol_type = other DNA
gactgtctcaggaaaaaaaa

SEQ ID NO: 5984 - DNA, 20 bp, synthetic construct
  misc_feature 1..20: note = CRISPR gRNA sequence
  source 1..20: mol_type = other DNA
ctgtctcaggaaaaaaaaaa

SEQ ID NO: 5985 - DNA, 20 bp, synthetic construct
  misc_feature 1..20: note = CRISPR gRNA sequence
  source 1..20: mol_type = other DNA
gtctcaggaaaaaaaaaaga

SEQ ID NO: 5986 - DNA, 20 bp, synthetic construct
  misc_feature 1..20: note = CRISPR gRNA sequence
  source 1..20: mol_type = other DNA
ctcaggaaaaaaaaaagaga

SEQ ID NO: 5987 - DNA, 20 bp, synthetic construct
  misc_feature 1..20: note = CRISPR gRNA sequence
  source 1..20: mol_type = other DNA
aaaaaaaaagagagagaaaa

SEQ ID NO: 5988 - DNA, 20 bp, synthetic construct
  misc_feature 1..20: note = CRISPR gRNA sequence
  source 1..20: mol_type = other DNA
aaaaagagagagaaaaaagt

SEQ ID NO: 5989 - DNA, 20 bp, synthetic construct
  misc_feature 1..20: note = CRISPR gRNA sequence
  source 1..20: mol_type = other DNA
aaagagagagaaaaaagtca

SEQ ID NO: 5990 - DNA, 20 bp, synthetic construct
  misc_feature 1..20: note = CRISPR gRNA sequence
  source 1..20: mol_type = other DNA
agagagagaaaaaagtcaga

SEQ ID NO: 5991 - DNA, 20 bp, synthetic construct
  misc_feature 1..20: note = CRISPR gRNA sequence
  source 1..20: mol_type = other DNA
gagagagaaaaaagtcagag

SEQ ID NO: 5992 - DNA, 20 bp, synthetic construct
  misc_feature 1..20: note = CRISPR gRNA sequence
  source 1..20: mol_type = other DNA
gagaaaaaagtcagagagga

SEQ ID NO: 5993 - DNA, 20 bp, synthetic construct
  misc_feature 1..20: note = CRISPR gRNA sequence
  source 1..20: mol_type = other DNA
aaaagtcagagaggaaagca

SEQ ID NO: 5994 - DNA, 20 bp, synthetic construct
  misc_feature 1..20: note = CRISPR gRNA sequence
  source 1..20: mol_type = other DNA
aaagtcagagaggaaagcat

SEQ ID NO: 5995 - DNA, 20 bp, synthetic construct
  misc_feature 1..20: note = CRISPR gRNA sequence
  source 1..20: mol_type = other DNA
gtcagagaggaaagcatagg

SEQ ID NO: 5996 - DNA, 20 bp, synthetic construct
  misc_feature 1..20: note = CRISPR gRNA sequence
  source 1..20: mol_type = other DNA
gagaggaaagcataggcaga

SEQ ID NO: 5997 - DNA, 20 bp, synthetic construct
  misc_feature 1..20: note = CRISPR gRNA sequence
  source 1..20: mol_type = other DNA
agaggaaagcataggcagat

SEQ ID NO: 5998 - DNA, 20 bp, synthetic construct
  misc_feature 1..20: note = CRISPR gRNA sequence
  source 1..20: mol_type = other DNA
aggaaagcataggcagatgg

SEQ ID NO: 5999 - DNA, 20 bp, synthetic construct
  misc_feature 1..20: note = CRISPR gRNA sequence
  source 1..20: mol_type = other DNA
ggaaagcataggcagatggg

SEQ ID NO: 6000 - DNA, 20 bp, synthetic construct
  misc_feature 1..20: note = CRISPR gRNA sequence
  source 1..20: mol_type = other DNA
aggcagatgggaggtttcca

SEQ ID NO: 6001 - DNA, 20 bp, synthetic construct
  misc_feature 1..20: note = CRISPR gRNA sequence
  source 1..20: mol_type = other DNA
atgggaggtttccaaagacc

SEQ ID NO: 6002 - DNA, 20 bp, synthetic construct
  misc_feature 1..20: note = CRISPR gRNA sequence
  source 1..20: mol_type = other DNA
tccaaagaccaagacacaca

SEQ ID NO: 6003 - DNA, 20 bp, synthetic construct
  misc_feature 1..20: note = CRISPR gRNA sequence
  source 1..20: mol_type = other DNA
accaagacacacacagtcaa

SEQ ID NO: 6004 - DNA, 20 bp, synthetic construct
  misc_feature 1..20: note = CRISPR gRNA sequence
  source 1..20: mol_type = other DNA
agacacacacagtcaaaaga

SEQ ID NO: 6005 - DNA, 20 bp, synthetic construct
  misc_feature 1..20: note = CRISPR gRNA sequence
  source 1..20: mol_type = other DNA
cacacagtcaaaagacagtt

SEQ ID NO: 6006 - DNA, 20 bp, synthetic construct
  misc_feature 1..20: note = CRISPR gRNA sequence
  source 1..20: mol_type = other DNA
cagtcaaaagacagttcaga

SEQ ID NO: 6007 - DNA, 20 bp, synthetic construct
  misc_feature 1..20: note = CRISPR gRNA sequence
  source 1..20: mol_type = other DNA
agtcaaaagacagttcagaa

SEQ ID NO: 6008 - DNA, 20 bp, synthetic construct
  misc_feature 1..20: note = CRISPR gRNA sequence
  source 1..20: mol_type = other DNA
gtcaaaagacagttcagaaa

SEQ ID NO: 6009 - DNA, 20 bp, synthetic construct
  misc_feature 1..20: note = CRISPR gRNA sequence
  source 1..20: mol_type = other DNA
tcaaaagacagttcagaaag

SEQ ID NO: 6010 - DNA, 20 bp, synthetic construct
  misc_feature 1..20: note = CRISPR gRNA sequence
  source 1..20: mol_type = other DNA
gacagttcagaaaggggcat

SEQ ID NO: 6011 - DNA, 20 bp, synthetic construct
  misc_feature 1..20: note = CRISPR gRNA sequence
  source 1..20: mol_type = other DNA
ttagttaccaccgattctca

SEQ ID NO: 6012 - DNA, 20 bp, synthetic construct
  misc_feature 1..20: note = CRISPR gRNA sequence
  source 1..20: mol_type = other DNA
tagttaccaccgattctcat

SEQ ID NO: 6013 - DNA, 20 bp, synthetic construct
  misc_feature 1..20: note = CRISPR gRNA sequence
  source 1..20: mol_type = other DNA
ttaccaccgattctcatagg

SEQ ID NO: 6014 - DNA, 20 bp, synthetic construct
  misc_feature 1..20: note = CRISPR gRNA sequence
  source 1..20: mol_type = other DNA
taccaccgattctcatagga

SEQ ID NO: 6015 - DNA, 20 bp, synthetic construct
  misc_feature 1..20: note = CRISPR gRNA sequence
  source 1..20: mol_type = other DNA
cgattctcataggaaggaca

SEQ ID NO: 6016 - DNA, 20 bp, synthetic construct
  misc_feature 1..20: note = CRISPR gRNA sequence
  source 1..20: mol_type = other DNA
tctcataggaaggacataga

SEQ ID NO: 6017 - DNA, 20 bp, synthetic construct
  misc_feature 1..20: note = CRISPR gRNA sequence
  source 1..20: mol_type = other DNA
ggaaggacatagatagtttt

SEQ ID NO: 6018 - DNA, 20 bp, synthetic construct
  misc_feature 1..20: note = CRISPR gRNA sequence
  source 1..20: mol_type = other DNA
ccttcaatccttctgacatc

SEQ ID NO: 6019 - DNA, 20 bp, synthetic construct
  misc_feature 1..20: note = CRISPR gRNA sequence
  source 1..20: mol_type = other DNA
cttcaatccttctgacatca

SEQ ID NO: 6020 - DNA, 20 bp, synthetic construct
  misc_feature 1..20: note = CRISPR gRNA sequence
  source 1..20: mol_type = other DNA
tccttctgacatcaaggaca

SEQ ID NO: 6021 - DNA, 20 bp, synthetic construct
  misc_feature 1..20: note = CRISPR gRNA sequence
  source 1..20: mol_type = other DNA
tgattttccctgatgtttga

SEQ ID NO: 6022 - DNA, 20 bp, synthetic construct
  misc_feature 1..20: note = CRISPR gRNA sequence
  source 1..20: mol_type = other DNA
acagtgccctaatgcttgct

SEQ ID NO: 6023 - DNA, 20 bp, synthetic construct
  misc_feature 1..20: note = CRISPR gRNA sequence
  source 1..20: mol_type = other DNA
gctaagatttctttttaaca

SEQ ID NO: 6024 - DNA, 20 bp, synthetic construct
  misc_feature 1..20: note = CRISPR gRNA sequence
  source 1..20: mol_type = other DNA
aagatttctttttaacaaag

SEQ ID NO: 6025 - DNA, 20 bp, synthetic construct
  misc_feature 1..20: note = CRISPR gRNA sequence
  source 1..20: mol_type = other DNA
ttctttttaacaaagtggta

SEQ ID NO: 6026 - DNA, 20 bp, synthetic construct
  misc_feature 1..20: note = CRISPR gRNA sequence
  source 1..20: mol_type = other DNA
tttttaacaaagtggtaaag

SEQ ID NO: 6027 - DNA, 20 bp, synthetic construct
  misc_feature 1..20: note = CRISPR gRNA sequence
  source 1..20: mol_type = other DNA
aacaaagtggtaaagaagct

SEQ ID NO: 6028 - DNA, 20 bp, synthetic construct
  misc_feature 1..20: note = CRISPR gRNA sequence
  source 1..20: mol_type = other DNA
taaagaagctgagattattt

SEQ ID NO: 6029 - DNA, 20 bp, synthetic construct
  misc_feature 1..20: note = CRISPR gRNA sequence
  source 1..20: mol_type = other DNA
attgtttctttttcaaccac

SEQ ID NO: 6030 - DNA, 20 bp, synthetic construct
  misc_feature 1..20: note = CRISPR gRNA sequence
  source 1..20: mol_type = other DNA
tcaaccacaagtgatactgt

SEQ ID NO: 6031 - DNA, 20 bp, synthetic construct
  misc_feature 1..20: note = CRISPR gRNA sequence
  source 1..20: mol_type = other DNA
cacaagtgatactgttggtt

SEQ ID NO: 6032 - DNA, 20 bp, synthetic construct
  misc_feature 1..20: note = CRISPR gRNA sequence
  source 1..20: mol_type = other DNA
tttgcttttccgtttataca

SEQ ID NO: 6033 - DNA, 20 bp, synthetic construct
  misc_feature 1..20: note = CRISPR gRNA sequence
  source 1..20: mol_type = other DNA
ccgtttatacatggaaaaaa

SEQ ID NO: 6034 - DNA, 20 bp, synthetic construct
  misc_feature 1..20: note = CRISPR gRNA sequence
  source 1..20: mol_type = other DNA
gttttctttttgtaaaatca

SEQ ID NO: 6035 - DNA, 20 bp, synthetic construct
  misc_feature 1..20: note = CRISPR gRNA sequence
  source 1..20: mol_type = other DNA
ccactttcaaatgtacattt

SEQ ID NO: 6036 - DNA, 20 bp, synthetic construct
  misc_feature 1..20: note = CRISPR gRNA sequence
  source 1..20: mol_type = other DNA
ctttcaaatgtacatttcag

SEQ ID NO: 6037 - DNA, 20 bp, synthetic construct
  misc_feature 1..20: note = CRISPR gRNA sequence
  source 1..20: mol_type = other DNA
cctccgctaccatccatctc

SEQ ID NO: 6038 - DNA, 20 bp, synthetic construct
  misc_feature 1..20: note = CRISPR gRNA sequence
  source 1..20: mol_type = other DNA
aaactgaaactctacccaat

SEQ ID NO: 6039 - DNA, 20 bp, synthetic construct
  misc_feature 1..20: note = CRISPR gRNA sequence
  source 1..20: mol_type = other DNA
tccccactgccccttccacc

SEQ ID NO: 6040 - DNA, 20 bp, synthetic construct
  misc_feature 1..20: note = CRISPR gRNA sequence
  source 1..20: mol_type = other DNA
tgccccttccacccagctcg

SEQ ID NO: 6041 - DNA, 20 bp, synthetic construct
  misc_feature 1..20: note = CRISPR gRNA sequence
  source 1..20: mol_type = other DNA
aacttcctgtctctatgttt

SEQ ID NO: 6042 - DNA, 20 bp, synthetic construct
  misc_feature 1..20: note = CRISPR gRNA sequence
  source 1..20: mol_type = other DNA
acttcctgtctctatgtttt

SEQ ID NO: 6043 - DNA, 20 bp, synthetic construct
  misc_feature 1..20: note = CRISPR gRNA sequence
  source 1..20: mol_type = other DNA
ctctatgttttgggctactc

SEQ ID NO: 6044 - DNA, 20 bp, synthetic construct
  misc_feature 1..20: note = CRISPR gRNA sequence
  source 1..20: mol_type = other DNA
ctctagacaccgcctataaa

SEQ ID NO: 6045 - DNA, 20 bp, synthetic construct
  misc_feature 1..20: note = CRISPR gRNA sequence
  source 1..20: mol_type = other DNA
gatatttgtctttttgtgcc

SEQ ID NO: 6046 - DNA, 20 bp, synthetic construct
  misc_feature 1..20: note = CRISPR gRNA sequence
  source 1..20: mol_type = other DNA
tgtgcctggcttctttcact

SEQ ID NO: 6047 - DNA, 20 bp, synthetic construct
  misc_feature 1..20: note = CRISPR gRNA sequence
  source 1..20: mol_type = other DNA
tcacttagcataatgtcttc

SEQ ID NO: 6048 - DNA, 20 bp, synthetic construct
  misc_feature 1..20: note = CRISPR gRNA sequence
  source 1..20: mol_type = other DNA
cacttagcataatgtcttcc

SEQ ID NO: 6049 - DNA, 20 bp, synthetic construct
  misc_feature 1..20: note = CRISPR gRNA sequence
  source 1..20: mol_type = other DNA
ccatgtgtaattcctttcta

SEQ ID NO: 6050 - DNA, 20 bp, synthetic construct
  misc_feature 1..20: note = CRISPR gRNA sequence
  source 1..20: mol_type = other DNA
tgtgtaattcctttctatgg

SEQ ID NO: 6051 - DNA, 20 bp, synthetic construct
  misc_feature 1..20: note = CRISPR gRNA sequence
  source 1..20: mol_type = other DNA
aattcctttctatggcggaa

SEQ ID NO: 6052 - DNA, 20 bp, synthetic construct
  misc_feature 1..20: note = CRISPR gRNA sequence
  source 1..20: mol_type = other DNA
cggaatagtattctaatatg

SEQ ID NO: 6053 - DNA, 20 bp, synthetic construct
  misc_feature 1..20: note = CRISPR gRNA sequence
  source 1..20: mol_type = other DNA
ttcatccattcatttgttga

SEQ ID NO: 6054 - DNA, 20 bp, synthetic construct
  misc_feature 1..20: note = CRISPR gRNA sequence
  source 1..20: mol_type = other DNA
ttcatttgttgatagacact

SEQ ID NO: 6055 - DNA, 20 bp, synthetic construct
  misc_feature 1..20: note = CRISPR gRNA sequence
  source 1..20: mol_type = other DNA
tcatttgttgatagacactt

SEQ ID NO: 6056 - DNA, 20 bp, synthetic construct
  misc_feature 1..20: note = CRISPR gRNA sequence
  source 1..20: mol_type = other DNA
actattgtgaataatcttgc

SEQ ID NO: 6057 - DNA, 20 bp, synthetic construct
  misc_feature 1..20: note = CRISPR gRNA sequence
  source 1..20: mol_type = other DNA
ctattgtgaataatcttgct

SEQ ID NO: 6058 - DNA, 20 bp, synthetic construct
  misc_feature 1..20: note = CRISPR gRNA sequence
  source 1..20: mol_type = other DNA
gaataatcttgctaggtaca

SEQ ID NO: 6059 - DNA, 20 bp, synthetic construct
  misc_feature 1..20: note = CRISPR gRNA sequence
  source 1..20: mol_type = other DNA
aataatcttgctaggtacat

SEQ ID NO: 6060 - DNA, 20 bp, synthetic construct
  misc_feature 1..20: note = CRISPR gRNA sequence
  source 1..20: mol_type = other DNA
aatcttgctaggtacatggg

SEQ ID NO: 6061 - DNA, 20 bp, synthetic construct
  misc_feature 1..20: note = CRISPR gRNA sequence
  source 1..20: mol_type = other DNA
tgactccccgctttcaactc

SEQ ID NO: 6062 - DNA, 20 bp, synthetic construct
  misc_feature 1..20: note = CRISPR gRNA sequence
  source 1..20: mol_type = other DNA
tccccgctttcaactctaga

SEQ ID NO: 6063 - DNA, 20 bp, synthetic construct
  misc_feature 1..20: note = CRISPR gRNA sequence
  source 1..20: mol_type = other DNA
agaaagctttcttttaaaat

SEQ ID NO: 6064 - DNA, 20 bp, synthetic construct
  misc_feature 1..20: note = CRISPR gRNA sequence
  source 1..20: mol_type = other DNA
cttttaaaatcggtctattt

SEQ ID NO: 6065 - DNA, 20 bp, synthetic construct
  misc_feature 1..20: note = CRISPR gRNA sequence
  source 1..20: mol_type = other DNA
tctatttaagtttctttaaa

SEQ ID NO: 6066 - DNA, 20 bp, synthetic construct
  misc_feature 1..20: note = CRISPR gRNA sequence
  source 1..20: mol_type = other DNA
tttctttaaaaagttaattt

SEQ ID NO: 6067 - DNA, 20 bp, synthetic construct
  misc_feature 1..20: note = CRISPR gRNA sequence
  source 1..20: mol_type = other DNA
gttaatttaagaaaaatact

SEQ ID NO: 6068 - DNA, 20 bp, synthetic construct
  misc_feature 1..20: note = CRISPR gRNA sequence
  source 1..20: mol_type = other DNA
ttaatttaagaaaaatacta

SEQ ID NO: 6069 - DNA, 20 bp, synthetic construct
  misc_feature 1..20: note = CRISPR gRNA sequence
  source 1..20: mol_type = other DNA
aaaaatactaaggtaaattg

SEQ ID NO: 6070 - DNA, 20 bp, synthetic construct
  misc_feature 1..20: note = CRISPR gRNA sequence
  source 1..20: mol_type = other DNA
tactaaggtaaattgtagaa

SEQ ID NO: 6071 - DNA, 20 bp, synthetic construct
  misc_feature 1..20: note = CRISPR gRNA sequence
  source 1..20: mol_type = other DNA
actaaggtaaattgtagaac

SEQ ID NO: 6072 - DNA, 20 bp, synthetic construct
  misc_feature 1..20: note = CRISPR gRNA sequence
  source 1..20: mol_type = other DNA
atatgaccccaaaaattgta

SEQ ID NO: 6073 - DNA, 20 bp, synthetic construct
  misc_feature 1..20: note = CRISPR gRNA sequence
  source 1..20: mol_type = other DNA
gaccccaaaaattgtaaaga

SEQ ID NO: 6074 - DNA, 20 bp, synthetic construct
  misc_feature 1..20: note = CRISPR gRNA sequence
  source 1..20: mol_type = other DNA
cccaaaaattgtaaagatgg

SEQ ID NO: 6075 - DNA, 20 bp, synthetic construct
  misc_feature 1..20: note = CRISPR gRNA sequence
  source 1..20: mol_type = other DNA
agatggaagacgaatgcctg

SEQ ID NO: 6076 - DNA, 20 bp, synthetic construct
  misc_feature 1..20: note = CRISPR gRNA sequence
  source 1..20: mol_type = other DNA
gaagacgaatgcctgcagtt

SEQ ID NO: 6077 - DNA, 20 bp, synthetic construct
  misc_feature 1..20: note = CRISPR gRNA sequence
  source 1..20: mol_type = other DNA
aagacgaatgcctgcagttt

SEQ ID NO: 6078 - DNA, 20 bp, synthetic construct
  misc_feature 1..20: note = CRISPR gRNA sequence
  source 1..20: mol_type = other DNA
atgcctgcagtttgggaaac

SEQ ID NO: 6079 - DNA, 20 bp, synthetic construct
  misc_feature 1..20: note = CRISPR gRNA sequence
  source 1..20: mol_type = other DNA
tgcagtttgggaaaccggat

SEQ ID NO: 6080 - DNA, 20 bp, synthetic construct
  misc_feature 1..20: note = CRISPR gRNA sequence
  source 1..20: mol_type = other DNA
cagtttgggaaaccggatga

SEQ ID NO: 6081 - DNA, 20 bp, synthetic construct
  misc_feature 1..20: note = CRISPR gRNA sequence
  source 1..20: mol_type = other DNA
agtttgggaaaccggatgag

SEQ ID NO: 6082 - DNA, 20 bp, synthetic construct
  misc_feature 1..20: note = CRISPR gRNA sequence
  source 1..20: mol_type = other DNA
tgggaaaccggatgagagga

SEQ ID NO: 6083 - DNA, 20 bp, synthetic construct
  misc_feature 1..20: note = CRISPR gRNA sequence
  source 1..20: mol_type = other DNA
accggatgagaggaaagacc

SEQ ID NO: 6084 - DNA, 20 bp, synthetic construct
  misc_feature 1..20: note = CRISPR gRNA sequence
  source 1..20: mol_type = other DNA
ggatgagaggaaagacctgg

SEQ ID NO: 6085 - DNA, 20 bp, synthetic construct
  misc_feature 1..20: note = CRISPR gRNA sequence
  source 1..20: mol_type = other DNA
gctattgtaaaatctatgct

SEQ ID NO: 6086 - DNA, 20 bp, synthetic construct
  misc_feature 1..20: note = CRISPR gRNA sequence
  source 1..20: mol_type = other DNA
ctattgtaaaatctatgctg

SEQ ID NO: 6087 - DNA, 20 bp, synthetic construct
  misc_feature 1..20: note = CRISPR gRNA sequence
  source 1..20: mol_type = other DNA
tattgtaaaatctatgctga

SEQ ID NO: 6088 - DNA, 20 bp, synthetic construct
  misc_feature 1..20: note = CRISPR gRNA sequence
  source 1..20: mol_type = other DNA
taaaatctatgctgagggtc

SEQ ID NO: 6089 - DNA, 20 bp, synthetic construct
  misc_feature 1..20: note = CRISPR gRNA sequence
  source 1..20: mol_type = other DNA
gctgagggtctggtgactac

SEQ ID NO: 6090 - DNA, 20 bp, synthetic construct
  misc_feature 1..20: note = CRISPR gRNA sequence
  source 1..20: mol_type = other DNA
ggtctggtgactactagacc

SEQ ID NO: 6091 - DNA, 20 bp, synthetic construct
  misc_feature 1..20: note = CRISPR gRNA sequence
  source 1..20: mol_type = other DNA
gtctggtgactactagacca

SEQ ID NO: 6092 - DNA, 20 bp, synthetic construct
  misc_feature 1..20: note = CRISPR gRNA sequence
  source 1..20: mol_type = other DNA
tctggtgactactagaccaa

SEQ ID NO: 6093 - DNA, 20 bp, synthetic construct
  misc_feature 1..20: note = CRISPR gRNA sequence
  source 1..20: mol_type = other DNA
tgactactagaccaagggca

SEQ ID NO: 6094 - DNA, 20 bp, synthetic construct
  misc_feature 1..20: note = CRISPR gRNA sequence
  source 1..20: mol_type = other DNA
ctactagaccaagggcatgg

SEQ ID NO: 6095 - DNA, 20 bp, synthetic construct
  misc_feature 1..20: note = CRISPR gRNA sequence
  source 1..20: mol_type = other DNA
ctagaccaagggcatggcag

SEQ ID NO: 6096 - DNA, 20 bp, synthetic construct
  misc_feature 1..20: note = CRISPR gRNA sequence
  source 1..20: mol_type = other DNA
agaccaagggcatggcagca

SEQ ID NO: 6097 - DNA, 20 bp, synthetic construct
  misc_feature 1..20: note = CRISPR gRNA sequence
  source 1..20: mol_type = other DNA
gaccaagggcatggcagcag

SEQ ID NO: 6098 - DNA, 20 bp, synthetic construct
  misc_feature 1..20: note = CRISPR gRNA sequence
  source 1..20: mol_type = other DNA
accaagggcatggcagcaga

SEQ ID NO: 6099 - DNA, 20 bp, synthetic construct
  misc_feature 1..20: note = CRISPR gRNA sequence
  source 1..20: mol_type = other DNA
aagggcatggcagcagaggg

SEQ ID NO: 6100 - DNA, 20 bp, synthetic construct
  misc_feature 1..20: note = CRISPR gRNA sequence
  source 1..20: mol_type = other DNA
tggcagcagagggcagctga

SEQ ID NO: 6101 - DNA, 20 bp, synthetic construct
  misc_feature 1..20: note = CRISPR gRNA sequence
  source 1..20: mol_type = other DNA
agagggcagctgaaagactt

SEQ ID NO: 6102 - DNA, 20 bp, synthetic construct
  misc_feature 1..20: note = CRISPR gRNA sequence
  source 1..20: mol_type = other DNA
gagggcagctgaaagacttc

SEQ ID NO: 6103 - DNA, 20 bp, synthetic construct
  misc_feature 1..20: note = CRISPR gRNA sequence
  source 1..20: mol_type = other DNA
ggcagctgaaagacttcagg

SEQ ID NO: 6104 - DNA, 20 bp, synthetic construct
  misc_feature 1..20: note = CRISPR gRNA sequence
  source 1..20: mol_type = other DNA
gcagctgaaagacttcagga

SEQ ID NO: 6105 - DNA, 20 bp, synthetic construct
  misc_feature 1..20: note = CRISPR gRNA sequence
  source 1..20: mol_type = other DNA
ctgaaagacttcaggaagga

SEQ ID NO: 6106 - DNA, 20 bp, synthetic construct
  misc_feature 1..20: note = CRISPR gRNA sequence
  source 1..20: mol_type = other DNA
acttcaggaaggaaagatat

SEQ ID NO: 6107 - DNA, 20 bp, synthetic construct
  misc_feature 1..20: note = CRISPR gRNA sequence
  source 1..20: mol_type = other DNA
gaaggaaagatataagaatt

SEQ ID NO: 6108 - DNA, 20 bp, synthetic construct
  misc_feature 1..20: note = CRISPR gRNA sequence
  source 1..20: mol_type = other DNA
gaaagatataagaattaaga

SEQ ID NO: 6109 - DNA, 20 bp, synthetic construct
  misc_feature 1..20: note = CRISPR gRNA sequence
  source 1..20: mol_type = other DNA
aaagatataagaattaagaa

SEQ ID NO: 6110 - DNA, 20 bp, synthetic construct
  misc_feature 1..20: note = CRISPR gRNA sequence
  source 1..20: mol_type = other DNA
aagatataagaattaagaaa

SEQ ID NO: 6111 - DNA, 20 bp, synthetic construct
  misc_feature 1..20: note = CRISPR gRNA sequence
  source 1..20: mol_type = other DNA
agatataagaattaagaaag

SEQ ID NO: 6112 - DNA, 20 bp, synthetic construct
  misc_feature 1..20: note = CRISPR gRNA sequence
  source 1..20: mol_type = other DNA
taagaattaagaaaggggcc

SEQ ID NO: 6113 - DNA, 20 bp, synthetic construct
  misc_feature 1..20: note = CRISPR gRNA sequence
  source 1..20: mol_type = other DNA
attaagaaaggggcctggtg

SEQ ID NO: 6114 - DNA, 20 bp, synthetic construct
  misc_feature 1..20: note = CRISPR gRNA sequence
  source 1..20: mol_type = other DNA
aagaaaggggcctggtgcag

SEQ ID NO: 6115 - DNA, 20 bp, synthetic construct
  misc_feature 1..20: note = CRISPR gRNA sequence
  source 1..20: mol_type = other DNA
tgcctgtaattccatcacct

SEQ ID NO: 6116 - DNA, 20 bp, synthetic construct
  misc_feature 1..20: note = CRISPR gRNA sequence
  source 1..20: mol_type = other DNA
gcctgtaattccatcacctt

SEQ ID NO: 6117 - DNA, 20 bp, synthetic construct
  misc_feature 1..20: note = CRISPR gRNA sequence
  source 1..20: mol_type = other DNA
ctgtaattccatcaccttgg

SEQ ID NO: 6118 - DNA, 20 bp, synthetic construct
  misc_feature 1..20: note = CRISPR gRNA sequence
  source 1..20: mol_type = other DNA
tgtaattccatcaccttggg

SEQ ID NO: 6119 - DNA, 20 bp, synthetic construct
  misc_feature 1..20: note = CRISPR gRNA sequence
  source 1..20: mol_type = other DNA
ttccatcaccttgggaggtc

SEQ ID NO: 6120 - DNA, 20 bp, synthetic construct
  misc_feature 1..20: note = CRISPR gRNA sequence
  source 1..20: mol_type = other DNA
tccatcaccttgggaggtca

SEQ ID NO: 6121 - DNA, 20 bp, synthetic construct
  misc_feature 1..20: note = CRISPR gRNA sequence
  source 1..20: mol_type = other DNA
atcaccttgggaggtcaagg

SEQ ID NO: 6122 - DNA, 20 bp, synthetic construct
  misc_feature 1..20: note = CRISPR gRNA sequence
  source 1..20: mol_type = other DNA
tcaccttgggaggtcaaggc

SEQ ID NO: 6123 - DNA, 20 bp, synthetic construct
  misc_feature 1..20: note = CRISPR gRNA sequence
  source 1..20: mol_type = other DNA
gggaggtcaaggcaggatga

SEQ ID NO: 6124 - DNA, 20 bp, synthetic construct
  misc_feature 1..20: note = CRISPR gRNA sequence
  source 1..20: mol_type = other DNA
tcaaggcaggatgatggctt

SEQ ID NO: 6125 - DNA, 20 bp, synthetic construct
  misc_feature 1..20: note = CRISPR gRNA sequence
  source 1..20: mol_type = other DNA
gcaggatgatggcttgagac

SEQ ID NO: 6126 - DNA, 20 bp, synthetic construct
  misc_feature 1..20: note = CRISPR gRNA sequence
  source 1..20: mol_type = other DNA
caggatgatggcttgagacc

SEQ ID NO: 6127 - DNA, 20 bp, synthetic construct
  misc_feature 1..20: note = CRISPR gRNA sequence
  source 1..20: mol_type = other DNA
ggatgatggcttgagaccag

SEQ ID NO: 6128 - DNA, 20 bp, synthetic construct
  misc_feature 1..20: note = CRISPR gRNA sequence
  source 1..20: mol_type = other DNA
tggcttgagaccaggagttc

SEQ ID NO: 6129 - DNA, 20 bp, synthetic construct
  misc_feature 1..20: note = CRISPR gRNA sequence
  source 1..20: mol_type = other DNA
tgagaccaggagttcaagac

SEQ ID NO: 6130 - DNA, 20 bp, synthetic construct
  misc_feature 1..20: note = CRISPR gRNA sequence
  source 1..20: mol_type = other DNA
ccaggagttcaagaccagcc

SEQ ID NO: 6131 - DNA, 20 bp, synthetic construct
  misc_feature 1..20: note = CRISPR gRNA sequence
  source 1..20: mol_type = other DNA
caggagttcaagaccagcct

SEQ ID NO: 6132 - DNA, 20 bp, synthetic construct
  misc_feature 1..20: note = CRISPR gRNA sequence
  source 1..20: mol_type = other DNA
ttcaagaccagcctgggcaa

SEQ ID NO: 6133 - DNA, 20 bp, synthetic construct
  misc_feature 1..20: note = CRISPR gRNA sequence
  source 1..20: mol_type = other DNA
caagaccagcctgggcaaca

SEQ ID NO: 6134 - DNA, 20 bp, synthetic construct
  misc_feature 1..20: note = CRISPR gRNA sequence
  source 1..20: mol_type = other DNA
accagcctgggcaacagagc

SEQ ID NO: 6135 - DNA, 20 bp, synthetic construct
  misc_feature 1..20: note = CRISPR gRNA sequence
  source 1..20: mol_type = other DNA
aacagagcaagacctttttt

SEQ ID NO: 6136 - DNA, 20 bp, synthetic construct
  misc_feature 1..20: note = CRISPR gRNA sequence
  source 1..20: mol_type = other DNA
acagagcaagaccttttttt

SEQ ID NO: 6137 - DNA, 20 bp, synthetic construct
  misc_feature 1..20: note = CRISPR gRNA sequence
  source 1..20: mol_type = other DNA
aaaataaatttttgaaaata

SEQ ID NO: 6138 - DNA, 20 bp, synthetic construct
  misc_feature 1..20: note = CRISPR gRNA sequence
  source 1..20: mol_type = other DNA
atttttgaaaatacagattc

SEQ ID NO: 6139 - DNA, 20 bp, synthetic construct
  misc_feature 1..20: note = CRISPR gRNA sequence
  source 1..20: mol_type = other DNA
tttttgaaaatacagattcc

SEQ ID NO: 6140 - DNA, 20 bp, synthetic construct
  misc_feature 1..20: note = CRISPR gRNA sequence
  source 1..20: mol_type = other DNA
tgaaaatacagattccaggc

SEQ ID NO: 6141 - DNA, 20 bp, synthetic construct
  misc_feature 1..20: note = CRISPR gRNA sequence
  source 1..20: mol_type = other DNA
gaaaatacagattccaggcc

SEQ ID NO: 6142 - DNA, 20 bp, synthetic construct
  misc_feature 1..20: note = CRISPR gRNA sequence
  source 1..20: mol_type = other DNA
tacagattccaggccgggca

SEQ ID NO: 6143 - DNA, 20 bp, synthetic construct
  misc_feature 1..20: note = CRISPR gRNA sequence
  source 1..20: mol_type = other DNA
agattccaggccgggcatgg

SEQ ID NO: 6144 - DNA, 20 bp, synthetic construct
  misc_feature 1..20: note = CRISPR gRNA sequence
  source 1..20: mol_type = other DNA
gtggctcacacctgtaaccc

SEQ ID NO: 6145 - DNA, 20 bp, synthetic construct
  misc_feature 1..20: note = CRISPR gRNA sequence
  source 1..20: mol_type = other DNA
cacctgtaaccccagcactt

SEQ ID NO: 6146 - DNA, 20 bp, synthetic construct
  misc_feature 1..20: note = CRISPR gRNA sequence
  source 1..20: mol_type = other DNA
acctgtaaccccagcacttt

SEQ ID NO: 6147 - DNA, 20 bp, synthetic construct
  misc_feature 1..20: note = CRISPR gRNA sequence
  source 1..20: mol_type = other DNA
ctgtaaccccagcactttgg

SEQ ID NO: 6148 - DNA, 20 bp, synthetic construct
  misc_feature 1..20: note = CRISPR gRNA sequence
  source 1..20: mol_type = other DNA
tgtaaccccagcactttggg

SEQ ID NO: 6149 - DNA, 20 bp, synthetic construct
  misc_feature 1..20: note = CRISPR gRNA sequence
  source 1..20: mol_type = other DNA
ccccagcactttgggaggct

SEQ ID NO: 6150 - DNA, 20 bp, synthetic construct
  misc_feature 1..20: note = CRISPR gRNA sequence
  source 1..20: mol_type = other DNA
cccagcactttgggaggctg

SEQ ID NO: 6151 - DNA, 20 bp, synthetic construct
  misc_feature 1..20: note = CRISPR gRNA sequence
  source 1..20: mol_type = other DNA
gcactttgggaggctgaggc

SEQ ID NO: 6152 - DNA, 20 bp, synthetic construct
  misc_feature 1..20: note = CRISPR gRNA sequence
  source 1..20: mol_type = other DNA
ctttgggaggctgaggccgg

SEQ ID NO: 6153 - DNA, 20 bp, synthetic construct
  misc_feature 1..20: note = CRISPR gRNA sequence
  source 1..20: mol_type = other DNA
gctgaggccggtggatcacc

SEQ ID NO: 6154 - DNA, 20 bp, synthetic construct
  misc_feature 1..20: note = CRISPR gRNA sequence
  source 1..20: mol_type = other DNA
ctgaggccggtggatcacct

SEQ ID NO: 6155 - DNA, 20 bp, synthetic construct
  misc_feature 1..20: note = CRISPR gRNA sequence
  source 1..20: mol_type = other DNA
gccggtggatcacctgggat

SEQ ID NO: 6156 - DNA, 20 bp, synthetic construct
  misc_feature 1..20: note = CRISPR gRNA sequence
  source 1..20: mol_type = other DNA
ccggtggatcacctgggatc

SEQ ID NO: 6157 - DNA, 20 bp, synthetic construct
  misc_feature 1..20: note = CRISPR gRNA sequence
  source 1..20: mol_type = other DNA
ggtggatcacctgggatcag

SEQ ID NO: 6158 - DNA, 20 bp, synthetic construct
  misc_feature 1..20: note = CRISPR gRNA sequence
  source 1..20: mol_type = other DNA
tcacctgggatcaggagttc

SEQ ID NO: 6159 - DNA, 20 bp, synthetic construct
  misc_feature 1..20: note = CRISPR gRNA sequence
  source 1..20: mol_type = other DNA
tgggatcaggagttcgagac

SEQ ID NO: 6160 - DNA, 20 bp, synthetic construct
  misc_feature 1..20: note = CRISPR gRNA sequence
  source 1..20: mol_type = other DNA
tcaggagttcgagaccagcc

SEQ ID NO: 6161 - DNA, 20 bp, synthetic construct
  misc_feature 1..20: note = CRISPR gRNA sequence
  source 1..20: mol_type = other DNA
caggagttcgagaccagcct

SEQ ID NO: 6162 - DNA, 20 bp, synthetic construct
  misc_feature 1..20: note = CRISPR gRNA sequence
  source 1..20: mol_type = other DNA
cgagaccagcctgggcaaca

SEQ ID NO: 6163 - DNA, 20 bp, synthetic construct
  misc_feature 1..20: note = CRISPR gRNA sequence
  source 1..20: mol_type = other DNA
ctctcctaaaaatacaaaat

SEQ ID NO: 6164 - DNA, 20 bp, synthetic construct
  misc_feature 1..20: note = CRISPR gRNA sequence
  source 1..20: mol_type = other DNA
cctaaaaatacaaaattagc

SEQ ID NO: 6165 - DNA, 20 bp, synthetic construct
  misc_feature 1..20: note = CRISPR gRNA sequence
  source 1..20: mol_type = other DNA
ctaaaaatacaaaattagcc

SEQ ID NO: 6166 - DNA, 20 bp, synthetic construct
  misc_feature 1..20: note = CRISPR gRNA sequence
  source 1..20: mol_type = other DNA
aatacaaaattagccgggtg

SEQ ID NO: 6167 - DNA, 20 bp, synthetic construct
  misc_feature 1..20: note = CRISPR gRNA sequence
  source 1..20: mol_type = other DNA
acaaaattagccgggtgtag

SEQ ID NO: 6168 - DNA, 20 bp, synthetic construct
  misc_feature 1..20: note = CRISPR gRNA sequence
  source 1..20: mol_type = other DNA
gtggtgcatgcctgtaatcc

SEQ ID NO: 6169 - DNA, 20 bp, synthetic construct
  misc_feature 1..20: note = CRISPR gRNA sequence
  source 1..20: mol_type = other DNA
tgcctgtaatcccagctact

SEQ ID NO: 6170 - DNA, 20 bp, synthetic construct
  misc_feature 1..20: note = CRISPR gRNA sequence
  source 1..20: mol_type = other DNA
ctgtaatcccagctactcgg

SEQ ID NO: 6171 - DNA, 20 bp, synthetic construct
  misc_feature 1..20: note = CRISPR gRNA sequence
  source 1..20: mol_type = other DNA
tgtaatcccagctactcggt

SEQ ID NO: 6172 - DNA, 20 bp, synthetic construct
  misc_feature 1..20: note = CRISPR gRNA sequence
  source 1..20: mol_type = other DNA
atcccagctactcggtaggc

SEQ ID NO: 6173 - DNA, 20 bp, synthetic construct
  misc_feature 1..20: note = CRISPR gRNA sequence
  source 1..20: mol_type = other DNA
ccagctactcggtaggctgg

SEQ ID NO: 6174 - DNA, 20 bp, synthetic construct
  misc_feature 1..20: note = CRISPR gRNA sequence
  source 1..20: mol_type = other DNA
agctactcggtaggctggtg

SEQ ID NO: 6175 - DNA, 20 bp, synthetic construct
  misc_feature 1..20: note = CRISPR gRNA sequence
  source 1..20: mol_type = other DNA
gctactcggtaggctggtgg

SEQ ID NO: 6176 - DNA, 20 bp, synthetic construct
  misc_feature 1..20: note = CRISPR gRNA sequence
  source 1..20: mol_type = other DNA
tactcggtaggctggtggag

SEQ ID NO: 6177 - DNA, 20 bp, synthetic construct
  misc_feature 1..20: note = CRISPR gRNA sequence
  source 1..20: mol_type = other DNA
ggaggagaatcgcctgaacc

SEQ ID NO: 6178 - DNA, 20 bp, synthetic construct
  misc_feature 1..20: note = CRISPR gRNA sequence
  source 1..20: mol_type = other DNA
gaggagaatcgcctgaaccc

SEQ ID NO: 6179 - DNA, 20 bp, synthetic construct
  misc_feature 1..20: note = CRISPR gRNA sequence
  source 1..20: mol_type = other DNA
ggagaatcgcctgaacccag

SEQ ID NO: 6180 - DNA, 20 bp, synthetic construct
  misc_feature 1..20: note = CRISPR gRNA sequence
  source 1..20: mol_type = other DNA
gagaatcgcctgaacccagg

SEQ ID NO: 6181 - DNA, 20 bp, synthetic construct
  misc_feature 1..20: note = CRISPR gRNA sequence
  source 1..20: mol_type = other DNA
aatcgcctgaacccaggagg

SEQ ID NO: 6182 - DNA, 20 bp, synthetic construct
  misc_feature 1..20: note = CRISPR gRNA sequence
  source 1..20: mol_type = other DNA
tcgcctgaacccaggaggcg

SEQ ID NO: 6183 - DNA, 20 bp, synthetic construct
  misc_feature 1..20: note = CRISPR gRNA sequence
  source 1..20: mol_type = other DNA
aacccaggaggcggagattg

SEQ ID NO: 6184 - DNA, 20 bp, synthetic construct
  misc_feature 1..20: note = CRISPR gRNA sequence
  source 1..20: mol_type = other DNA
caggaggcggagattgcggt

SEQ ID NO: 6185 - DNA, 20 bp, synthetic construct
  misc_feature 1..20: note = CRISPR gRNA sequence
  source 1..20: mol_type = other DNA
ggcggagattgcggtgagcc

SEQ ID NO: 6186 - DNA, 20 bp, synthetic construct
  misc_feature 1..20: note = CRISPR gRNA sequence
  source 1..20: mol_type = other DNA
gagatcacaccattgcactc

SEQ ID NO: 6187 - DNA, 20 bp, synthetic construct
  misc_feature 1..20: note = CRISPR gRNA sequence
  source 1..20: mol_type = other DNA
cacaccattgcactccagcc

SEQ ID NO: 6188 - DNA, 20 bp, synthetic construct
  misc_feature 1..20: note = CRISPR gRNA sequence
  source 1..20: mol_type = other DNA
acaccattgcactccagcct

SEQ ID NO: 6189 - DNA, 20 bp, synthetic construct
  misc_feature 1..20: note = CRISPR gRNA sequence
  source 1..20: mol_type = other DNA
tgcactccagcctgggcaac

SEQ ID NO: 6190 - DNA, 20 bp, synthetic construct
  misc_feature 1..20: note = CRISPR gRNA sequence
  source 1..20: mol_type = other DNA
cactccagcctgggcaacaa

SEQ ID NO: 6191 - DNA, 20 bp, synthetic construct
  misc_feature 1..20: note = CRISPR gRNA sequence
  source 1..20: mol_type = other DNA
ctccgtctcaaaaaaaatga

SEQ ID NO: 6192 - DNA, 20 bp, synthetic construct
  misc_feature 1..20: note = CRISPR gRNA sequence
  source 1..20: mol_type = other DNA
aaaaaaaatgaaagaaaata

SEQ ID NO: 6193 - DNA, 20 bp, synthetic construct
  misc_feature 1..20: note = CRISPR gRNA sequence
  source 1..20: mol_type = other DNA
tgaaagaaaatacagattcc

SEQ ID NO: 6194 - DNA, 20 bp, synthetic construct
  misc_feature 1..20: note = CRISPR gRNA sequence
  source 1..20: mol_type = other DNA
gaaagaaaatacagattcct

SEQ ID NO: 6195 - DNA, 20 bp, synthetic construct
  misc_feature 1..20: note = CRISPR gRNA sequence
  source 1..20: mol_type = other DNA
aaaatacagattcctgggcc

SEQ ID NO: 6196 - DNA, 20 bp, synthetic construct
  misc_feature 1..20: note = CRISPR gRNA sequence
  source 1..20: mol_type = other DNA
cagattcctgggcccggctg

SEQ ID NO: 6197 - DNA, 20 bp, synthetic construct
  misc_feature 1..20: note = CRISPR gRNA sequence
  source 1..20: mol_type = other DNA
ccggctgcagactccctgaa

SEQ ID NO: 6198 - DNA, 20 bp, synthetic construct
  misc_feature 1..20: note = CRISPR gRNA sequence
  source 1..20: mol_type = other DNA
gactccctgaatagaatcac

SEQ ID NO: 6199 - DNA, 20 bp, synthetic construct
  misc_feature 1..20: note = CRISPR gRNA sequence
  source 1..20: mol_type = other DNA
actccctgaatagaatcact

SEQ ID NO: 6200 - DNA, 20 bp, synthetic construct
  misc_feature 1..20: note = CRISPR gRNA sequence
  source 1..20: mol_type = other DNA
ctccctgaatagaatcactg

SEQ ID NO: 6201 - DNA, 20 bp, synthetic construct
  misc_feature 1..20: note = CRISPR gRNA sequence
  source 1..20: mol_type = other DNA
tccctgaatagaatcactgg

SEQ ID NO: 6202 - DNA, 20 bp, synthetic construct
  misc_feature 1..20: note = CRISPR gRNA sequence
  source 1..20: mol_type = other DNA
tgaatagaatcactgggggt

SEQ ID NO: 6203 - DNA, 20 bp, synthetic construct
  misc_feature 1..20: note = CRISPR gRNA sequence
  source 1..20: mol_type = other DNA
gaatagaatcactgggggtg

SEQ ID NO: 6204 - DNA, 20 bp, synthetic construct
  misc_feature 1..20: note = CRISPR gRNA sequence
  source 1..20: mol_type = other DNA
gaatcactgggggtgaggcc

SEQ ID NO: 6205 - DNA, 20 bp, synthetic construct
  misc_feature 1..20: note = CRISPR gRNA sequence
  source 1..20: mol_type = other DNA
aatcactgggggtgaggccc

SEQ ID NO: 6206 - DNA, 20 bp, synthetic construct
  misc_feature 1..20: note = CRISPR gRNA sequence
  source 1..20: mol_type = other DNA
tgtgtttttaacacccttcc

SEQ ID NO: 6207 - DNA, 20 bp, synthetic construct
  misc_feature 1..20: note = CRISPR gRNA sequence
  source 1..20: mol_type = other DNA
gtgtttttaacacccttccc

SEQ ID NO: 6208 - DNA, 20 bp, synthetic construct
  misc_feature 1..20: note = CRISPR gRNA sequence
  source 1..20: mol_type = other DNA
tcccaggtaattctcactca

SEQ ID NO: 6209 - DNA, 20 bp, synthetic construct
  misc_feature 1..20: note = CRISPR gRNA sequence
  source 1..20: mol_type = other DNA
ggtaattctcactcacagcc

SEQ ID NO: 6210 - DNA, 20 bp, synthetic construct
  misc_feature 1..20: note = CRISPR gRNA sequence
  source 1..20: mol_type = other DNA
ctcacagccaagcctgccga

SEQ ID NO: 6211 - DNA, 20 bp, synthetic construct
  misc_feature 1..20: note = CRISPR gRNA sequence
  source 1..20: mol_type = other DNA
cagccaagcctgccgatggc

SEQ ID NO: 6212 - DNA, 20 bp, synthetic construct
  misc_feature 1..20: note = CRISPR gRNA sequence
  source 1..20: mol_type = other DNA
ctgccgatggctggactccg

SEQ ID NO: 6213 - DNA, 20 bp, synthetic construct
  misc_feature 1..20: note = CRISPR gRNA sequence
  source 1..20: mol_type = other DNA
cgatggctggactccgtagt

SEQ ID NO: 6214 - DNA, 20 bp, synthetic construct
  misc_feature 1..20: note = CRISPR gRNA sequence
  source 1..20: mol_type = other DNA
tggactccgtagtcagatct

SEQ ID NO: 6215 - DNA, 20 bp, synthetic construct
  misc_feature 1..20: note = CRISPR gRNA sequence
  source 1..20: mol_type = other DNA
ctccgtagtcagatctcagc

SEQ ID NO: 6216 - DNA, 20 bp, synthetic construct
  misc_feature 1..20: note = CRISPR gRNA sequence
  source 1..20: mol_type = other DNA
cgtagtcagatctcagcaag

SEQ ID NO: 6217 - DNA, 20 bp, synthetic construct
  misc_feature 1..20: note = CRISPR gRNA sequence
  source 1..20: mol_type = other DNA
gtagtcagatctcagcaagc

SEQ ID NO: 6218 - DNA, 20 bp, synthetic construct
  misc_feature 1..20: note = CRISPR gRNA sequence
  source 1..20: mol_type = other DNA
cagatctcagcaagcaggac

SEQ ID NO: 6219 - DNA, 20 bp, synthetic construct
  misc_feature 1..20: note = CRISPR gRNA sequence
  source 1..20: mol_type = other DNA
cagcaagcaggactggctcg

SEQ ID NO: 6220 - DNA, 20 bp, synthetic construct
  misc_feature 1..20: note = CRISPR gRNA sequence
  source 1..20: mol_type = other DNA
gactggctcgtggttcatct

SEQ ID NO: 6221 - DNA, 20 bp, synthetic construct
  misc_feature 1..20: note = CRISPR gRNA sequence
  source 1..20: mol_type = other DNA
actggctcgtggttcatctt

SEQ ID NO: 6222 - DNA, 20 bp, synthetic construct
  misc_feature 1..20: note = CRISPR gRNA sequence
  source 1..20: mol_type = other DNA
ctggctcgtggttcatcttg

SEQ ID NO: 6223 - DNA, 20 bp, synthetic construct
  misc_feature 1..20: note = CRISPR gRNA sequence
  source 1..20: mol_type = other DNA
gtggttcatcttggggtctc

SEQ ID NO: 6224 - DNA, 20 bp, synthetic construct
  misc_feature 1..20: note = CRISPR gRNA sequence
  source 1..20: mol_type = other DNA
atcttggggtctccagcacc

SEQ ID NO: 6225 - DNA, 20 bp, synthetic construct
  misc_feature 1..20: note = CRISPR gRNA sequence
  source 1..20: mol_type = other DNA
ttggggtctccagcacccag

SEQ ID NO: 6226 - DNA, 20 bp, synthetic construct
  misc_feature 1..20: note = CRISPR gRNA sequence
  source 1..20: mol_type = other DNA
ggggtctccagcacccagca

SEQ ID NO: 6227 - DNA, 20 bp, synthetic construct
  misc_feature 1..20: note = CRISPR gRNA sequence
  source 1..20: mol_type = other DNA
tccagcacccagcagagtgc

SEQ ID NO: 6228 - DNA, 20 bp, synthetic construct
  misc_feature 1..20: note = CRISPR gRNA sequence
  source 1..20: mol_type = other DNA
agcacccagcagagtgctgg

SEQ ID NO: 6229 - DNA, 20 bp, synthetic construct
  misc_feature 1..20: note = CRISPR gRNA sequence
  source 1..20: mol_type = other DNA
gcacccagcagagtgctggc

SEQ ID NO: 6230 - DNA, 20 bp, synthetic construct
  misc_feature 1..20: note = CRISPR gRNA sequence
  source 1..20: mol_type = other DNA
cacccagcagagtgctggcg

SEQ ID NO: 6231 - DNA, 20 bp, synthetic construct
  misc_feature 1..20: note = CRISPR gRNA sequence
  source 1..20: mol_type = other DNA
acccagcagagtgctggcgg

SEQ ID NO: 6232 - DNA, 20 bp, synthetic construct
  misc_feature 1..20: note = CRISPR gRNA sequence
  source 1..20: mol_type = other DNA
cccagcagagtgctggcggg

SEQ ID NO: 6233 - DNA, 20 bp, synthetic construct
  misc_feature 1..20: note = CRISPR gRNA sequence
  source 1..20: mol_type = other DNA
gctggcggggggactgtgtt

SEQ ID NO: 6234 - DNA, 20 bp, synthetic construct
  misc_feature 1..20: note = CRISPR gRNA sequence
  source 1..20: mol_type = other DNA
ggcggggggactgtgttaag

SEQ ID NO: 6235 - DNA, 20 bp, synthetic construct
  misc_feature 1..20: note = CRISPR gRNA sequence
  source 1..20: mol_type = other DNA
cggggggactgtgttaagta

SEQ ID NO: 6236 - DNA, 20 bp, synthetic construct
  misc_feature 1..20: note = CRISPR gRNA sequence
  source 1..20: mol_type = other DNA
gggactgtgttaagtagagc

SEQ ID NO: 6237 - DNA, 20 bp, synthetic construct
  misc_feature 1..20: note = CRISPR gRNA sequence
  source 1..20: mol_type = other DNA
ctgtgttaagtagagccgga

SEQ ID NO: 6238 - DNA, 20 bp, synthetic construct
  misc_feature 1..20: note = CRISPR gRNA sequence
  source 1..20: mol_type = other DNA
tgtgttaagtagagccggat

SEQ ID NO: 6239 - DNA, 20 bp, synthetic construct
  misc_feature 1..20: note = CRISPR gRNA sequence
  source 1..20: mol_type = other DNA
ttaagtagagccggatgggt

SEQ ID NO: 6240 - DNA, 20 bp, synthetic construct
  misc_feature 1..20: note = CRISPR gRNA sequence
  source 1..20: mol_type = other DNA
taagtagagccggatgggtc

SEQ ID NO: 6241 - DNA, 20 bp, synthetic construct
  misc_feature 1..20: note = CRISPR gRNA sequence
  source 1..20: mol_type = other DNA
agagccggatgggtcaggac

SEQ ID NO: 6242 - DNA, 20 bp, synthetic construct
  misc_feature 1..20: note = CRISPR gRNA sequence
  source 1..20: mol_type = other DNA
agccggatgggtcaggactg

SEQ ID NO: 6243 - DNA, 20 bp, synthetic construct
  misc_feature 1..20: note = CRISPR gRNA sequence
  source 1..20: mol_type = other DNA
gatgggtcaggactggagtg

SEQ ID NO: 6244 - DNA, 20 bp, synthetic construct
  misc_feature 1..20: note = CRISPR gRNA sequence
  source 1..20: mol_type = other DNA
atgggtcaggactggagtgt

SEQ ID NO: 6245 - DNA, 20 bp, synthetic construct
  misc_feature 1..20: note = CRISPR gRNA sequence
  source 1..20: mol_type = other DNA
tgggtcaggactggagtgtg

SEQ ID NO: 6246 - DNA, 20 bp, synthetic construct
  misc_feature 1..20: note = CRISPR gRNA sequence
  source 1..20: mol_type = other DNA
caggactggagtgtggggcc

SEQ ID NO: 6247 - DNA, 20 bp, synthetic construct
  misc_feature 1..20: note = CRISPR gRNA sequence
  source 1..20: mol_type = other DNA
gggcctggctttgctaactg

SEQ ID NO: 6248 - DNA, 20 bp, synthetic construct
  misc_feature 1..20: note = CRISPR gRNA sequence
  source 1..20: mol_type = other DNA
gctttgctaactgcagtcac

SEQ ID NO: 6249 - DNA, 20 bp, synthetic construct
  misc_feature 1..20: note = CRISPR gRNA sequence
  source 1..20: mol_type = other DNA
catcactccaccccctaccc

SEQ ID NO: 6250 - DNA, 20 bp, synthetic construct
  misc_feature 1..20: note = CRISPR gRNA sequence
  source 1..20: mol_type = other DNA
tccaccccctaccccagcac

SEQ ID NO: 6251 - DNA, 20 bp, synthetic construct
  misc_feature 1..20: note = CRISPR gRNA sequence
  source 1..20: mol_type = other DNA
ccaccccctaccccagcacc

SEQ ID NO: 6252 - DNA, 20 bp, synthetic construct
  misc_feature 1..20: note = CRISPR gRNA sequence
  source 1..20: mol_type = other DNA
caccccctaccccagcacca

SEQ ID NO: 6253 - DNA, 20 bp, synthetic construct
  misc_feature 1..20: note = CRISPR gRNA sequence
  source 1..20: mol_type = other DNA
ccctaccccagcaccagggt

SEQ ID NO: 6254 - DNA, 20 bp, synthetic construct
  misc_feature 1..20: note = CRISPR gRNA sequence
  source 1..20: mol_type = other DNA
cctaccccagcaccagggtc

SEQ ID NO: 6255 - DNA, 20 bp, synthetic construct
  misc_feature 1..20: note = CRISPR gRNA sequence
  source 1..20: mol_type = other DNA
accagggtcaggttcccttc

SEQ ID NO: 6256 - DNA, 20 bp, synthetic construct
  misc_feature 1..20: note = CRISPR gRNA sequence
  source 1..20: mol_type = other DNA
ccagggtcaggttcccttcc

SEQ ID NO: 6257 - DNA, 20 bp, synthetic construct
  misc_feature 1..20: note = CRISPR gRNA sequence
  source 1..20: mol_type = other DNA
cccttccaggaaaaacttgt

SEQ ID NO: 6258 - DNA, 20 bp, synthetic construct
  misc_feature 1..20: note = CRISPR gRNA sequence
  source 1..20: mol_type = other DNA
aaacttgttggactcctttc

SEQ ID NO: 6259 - DNA, 20 bp, synthetic construct
  misc_feature 1..20: note = CRISPR gRNA sequence
  source 1..20: mol_type = other DNA
aacttgttggactcctttcc

SEQ ID NO: 6260 - DNA, 20 bp, synthetic construct
  misc_feature 1..20: note = CRISPR gRNA sequence
  source 1..20: mol_type = other DNA
cctttccaggtcattgactg

SEQ ID NO: 6261 - DNA, 20 bp, synthetic construct
  misc_feature 1..20: note = CRISPR gRNA sequence
  source 1..20: mol_type = other DNA
tccaggtcattgactgcagt

SEQ ID NO: 6262 - DNA, 20 bp, synthetic construct
  misc_feature 1..20: note = CRISPR gRNA sequence
  source 1..20: mol_type = other DNA
ccaggtcattgactgcagtt

SEQ ID NO: 6263 - DNA, 20 bp, synthetic construct
  misc_feature 1..20: note = CRISPR gRNA sequence
  source 1..20: mol_type = other DNA
aggtcattgactgcagttag

SEQ ID NO: 6264 - DNA, 20 bp, synthetic construct
  misc_feature 1..20: note = CRISPR gRNA sequence
  source 1..20: mol_type = other DNA
tcattgactgcagttaggag

SEQ ID NO: 6265 - DNA, 20 bp, synthetic construct
  misc_feature 1..20: note = CRISPR gRNA sequence
  source 1..20: mol_type = other DNA
ctgcagttaggagtggcatg

SEQ ID NO: 6266 - DNA, 20 bp, synthetic construct
  misc_feature 1..20: note = CRISPR gRNA sequence
  source 1..20: mol_type = other DNA
cagttaggagtggcatgcag

SEQ ID NO: 6267 - DNA, 20 bp, synthetic construct
  misc_feature 1..20: note = CRISPR gRNA sequence
  source 1..20: mol_type = other DNA
agttaggagtggcatgcaga

SEQ ID NO: 6268 - DNA, 20 bp, synthetic construct
  misc_feature 1..20: note = CRISPR gRNA sequence
  source 1..20: mol_type = other DNA
gttaggagtggcatgcagaa

SEQ ID NO: 6269 - DNA, 20 bp, synthetic construct
  misc_feature 1..20: note = CRISPR gRNA sequence
  source 1..20: mol_type = other DNA
taggagtggcatgcagaagg

SEQ ID NO: 6270 - DNA, 20 bp, synthetic construct
  misc_feature 1..20: note = CRISPR gRNA sequence
  source 1..20: mol_type = other DNA
aggagtggcatgcagaaggg

SEQ ID NO: 6271 - DNA, 20 bp, synthetic construct
  misc_feature 1..20: note = CRISPR gRNA sequence
  source 1..20: mol_type = other DNA
catgcagaagggaggctatc

SEQ ID NO: 6272 - DNA, 20 bp, synthetic construct
  misc_feature 1..20: note = CRISPR gRNA sequence
  source 1..20: mol_type = other DNA
tgcagaagggaggctatctg

SEQ ID NO: 6273 - DNA, 20 bp, synthetic construct
  misc_feature 1..20: note = CRISPR gRNA sequence
  source 1..20: mol_type = other DNA
gaagggaggctatctggagc

SEQ ID NO: 6274 - DNA, 20 bp, synthetic construct
  misc_feature 1..20: note = CRISPR gRNA sequence
  source 1..20: mol_type = other DNA
aagggaggctatctggagct

SEQ ID NO: 6275 - DNA, 20 bp, synthetic construct
  misc_feature 1..20: note = CRISPR gRNA sequence
  source 1..20: mol_type = other DNA
gaggctatctggagctggga

SEQ ID NO: 6276 - DNA, 20 bp, synthetic construct
  misc_feature 1..20: note = CRISPR gRNA sequence
  source 1..20: mol_type = other DNA
tatctggagctgggacagac

SEQ ID NO: 6277 - DNA, 20 bp, synthetic construct
  misc_feature 1..20: note = CRISPR gRNA sequence
  source 1..20: mol_type = other DNA
atctggagctgggacagacc

SEQ ID NO: 6278 - DNA, 20 bp, synthetic construct
  misc_feature 1..20: note = CRISPR gRNA sequence
  source 1..20: mol_type = other DNA
ggagctgggacagaccaggc

SEQ ID NO: 6279 - DNA, 20 bp, synthetic construct
  misc_feature 1..20: note = CRISPR gRNA sequence
  source 1..20: mol_type = other DNA
gctgggacagaccaggcaag

SEQ ID NO: 6280 - DNA, 20 bp, synthetic construct
  misc_feature 1..20: note = CRISPR gRNA sequence
  source 1..20: mol_type = other DNA
ctgggacagaccaggcaagc

SEQ ID NO: 6281 - DNA, 20 bp, synthetic construct
  misc_feature 1..20: note = CRISPR gRNA sequence
  source 1..20: mol_type = other DNA
tgggacagaccaggcaagcg

SEQ ID NO: 6282 - DNA, 20 bp, synthetic construct
  misc_feature 1..20: note = CRISPR gRNA sequence
  source 1..20: mol_type = other DNA
gacagaccaggcaagcgggg

SEQ ID NO: 6283 - DNA, 20 bp, synthetic construct
  misc_feature 1..20: note = CRISPR gRNA sequence
  source 1..20: mol_type = other DNA
acagaccaggcaagcgggga

SEQ ID NO: 6284 - DNA, 20 bp, synthetic construct
  misc_feature 1..20: note = CRISPR gRNA sequence
  source 1..20: mol_type = other DNA
cagaccaggcaagcggggaa

SEQ ID NO: 6285 - DNA, 20 bp, synthetic construct
  misc_feature 1..20: note = CRISPR gRNA sequence
  source 1..20: mol_type = other DNA
cttatcccaaccctgcattc

SEQ ID NO: 6286 - DNA, 20 bp, synthetic construct
  misc_feature 1..20: note = CRISPR gRNA sequence
  source 1..20: mol_type = other DNA
tcccaaccctgcattctgga

SEQ ID NO: 6287 - DNA, 20 bp, synthetic construct
  misc_feature 1..20: note = CRISPR gRNA sequence
  source 1..20: mol_type = other DNA
cccaaccctgcattctggac

SEQ ID NO: 6288 - DNA, 20 bp, synthetic construct
  misc_feature 1..20: note = CRISPR gRNA sequence
  source 1..20: mol_type = other DNA
ccaaccctgcattctggaca

SEQ ID NO: 6289 - DNA, 20 bp, synthetic construct
  misc_feature 1..20: note = CRISPR gRNA sequence
  source 1..20: mol_type = other DNA
tgcattctggacagggaccg

SEQ ID NO: 6290 - DNA, 20 bp, synthetic construct
  misc_feature 1..20: note = CRISPR gRNA sequence
  source 1..20: mol_type = other DNA
gcattctggacagggaccga

SEQ ID NO: 6291 - DNA, 20 bp, synthetic construct
  misc_feature 1..20: note = CRISPR gRNA sequence
  source 1..20: mol_type = other DNA
gacagggaccgaaggtctcc

SEQ ID NO: 6292 - DNA, 20 bp, synthetic construct
  misc_feature 1..20: note = CRISPR gRNA sequence
  source 1..20: mol_type = other DNA
gaccgaaggtctcctggctg

SEQ ID NO: 6293 - DNA, 20 bp, synthetic construct
  misc_feature 1..20: note = CRISPR gRNA sequence
  source 1..20: mol_type = other DNA
tctcctggctgcagctcata

SEQ ID NO: 6294 - DNA, 20 bp, synthetic construct
  misc_feature 1..20: note = CRISPR gRNA sequence
  source 1..20: mol_type = other DNA
gctcatcttcattctcatcc

SEQ ID NO: 6295 - DNA, 20 bp, synthetic construct
  misc_feature 1..20: note = CRISPR gRNA sequence
  source 1..20: mol_type = other DNA
ctcatcttcattctcatcct

SEQ ID NO: 6296 - DNA, 20 bp, synthetic construct
  misc_feature 1..20: note = CRISPR gRNA sequence
  source 1..20: mol_type = other DNA
cattctcatcctgggaccac

SEQ ID NO: 6297 - DNA, 20 bp, synthetic construct
  misc_feature 1..20: note = CRISPR gRNA sequence
  source 1..20: mol_type = other DNA
attctcatcctgggaccacc

SEQ ID NO: 6298 - DNA, 20 bp, synthetic construct
  misc_feature 1..20: note = CRISPR gRNA sequence
  source 1..20: mol_type = other DNA
acaataactttaccctttac

SEQ ID NO: 6299 - DNA, 20 bp, synthetic construct
  misc_feature 1..20: note = CRISPR gRNA sequence
  source 1..20: mol_type = other DNA
ccctttactggcaaatgcac

SEQ ID NO: 6300 - DNA, 20 bp, synthetic construct
  misc_feature 1..20: note = CRISPR gRNA sequence
  source 1..20: mol_type = other DNA
ttactggcaaatgcacaagc

SEQ ID NO: 6301 - DNA, 20 bp, synthetic construct
  misc_feature 1..20: note = CRISPR gRNA sequence
  source 1..20: mol_type = other DNA
actggcaaatgcacaagctg

SEQ ID NO: 6302 - DNA, 20 bp, synthetic construct
  misc_feature 1..20: note = CRISPR gRNA sequence
  source 1..20: mol_type = other DNA
aatgcacaagctggagatga

SEQ ID NO: 6303 - DNA, 20 bp, synthetic construct
  misc_feature 1..20: note = CRISPR gRNA sequence
  source 1..20: mol_type = other DNA
ctggagatgatggcccattc

SEQ ID NO: 6304 - DNA, 20 bp, synthetic construct
  misc_feature 1..20: note = CRISPR gRNA sequence
  source 1..20: mol_type = other DNA
tgatggcccattcgagtttt

SEQ ID NO: 6305 - DNA, 20 bp, synthetic construct
  misc_feature 1..20: note = CRISPR gRNA sequence
  source 1..20: mol_type = other DNA
ttcgagttttaagattttcc

SEQ ID NO: 6306 - DNA, 20 bp, synthetic construct
  misc_feature 1..20: note = CRISPR gRNA sequence
  source 1..20: mol_type = other DNA
aagattttccaagttgttat

SEQ ID NO: 6307 - DNA, 20 bp, synthetic construct
  misc_feature 1..20: note = CRISPR gRNA sequence
  source 1..20: mol_type = other DNA
agattttccaagttgttatg

SEQ ID NO: 6308 - DNA, 20 bp, synthetic construct
  misc_feature 1..20: note = CRISPR gRNA sequence
  source 1..20: mol_type = other DNA
tttccaagttgttatgaggt

SEQ ID NO: 6309 - DNA, 20 bp, synthetic construct
  misc_feature 1..20: note = CRISPR gRNA sequence
  source 1..20: mol_type = other DNA
atgaggtcagtgtcctcaat

SEQ ID NO: 6310 - DNA, 20 bp, synthetic construct
  misc_feature 1..20: note = CRISPR gRNA sequence
  source 1..20: mol_type = other DNA
tgaggtcagtgtcctcaatc

SEQ ID NO: 6311 - DNA, 20 bp, synthetic construct
  misc_feature 1..20: note = CRISPR gRNA sequence
  source 1..20: mol_type = other DNA
cagtgtcctcaatcgggacc

SEQ ID NO: 6312 - DNA, 20 bp, synthetic construct
  misc_feature 1..20: note = CRISPR gRNA sequence
  source 1..20: mol_type = other DNA
gtgtcctcaatcgggaccca

SEQ ID NO: 6313 - DNA, 20 bp, synthetic construct
  misc_feature 1..20: note = CRISPR gRNA sequence
  source 1..20: mol_type = other DNA
tcctcaatcgggacccagag

SEQ ID NO: 6314 - DNA, 20 bp, synthetic construct
  misc_feature 1..20: note = CRISPR gRNA sequence
  source 1..20: mol_type = other DNA
caatcgggacccagagaaga

SEQ ID NO: 6315 - DNA, 20 bp, synthetic construct
  misc_feature 1..20: note = CRISPR gRNA sequence
  source 1..20: mol_type = other DNA
aatcgggacccagagaagat

SEQ ID NO: 6316 - DNA, 20 bp, synthetic construct
  misc_feature 1..20: note = CRISPR gRNA sequence
  source 1..20: mol_type = other DNA
cgggacccagagaagatagg

SEQ ID NO: 6317 - DNA, 20 bp, synthetic construct
  misc_feature 1..20: note = CRISPR gRNA sequence
  source 1..20: mol_type = other DNA
aggtggcttgcctgaacttt

SEQ ID NO: 6318 - DNA, 20 bp, synthetic construct
  misc_feature 1..20: note = CRISPR gRNA sequence
  source 1..20: mol_type = other DNA
gtggcttgcctgaactttca

SEQ ID NO: 6319 - DNA, 20 bp, synthetic construct
  misc_feature 1..20: note = CRISPR gRNA sequence
  source 1..20: mol_type = other DNA
tggcttgcctgaactttcag

SEQ ID NO: 6320 - DNA, 20 bp, synthetic construct
  misc_feature 1..20: note = CRISPR gRNA sequence
  source 1..20: mol_type = other DNA
ggcttgcctgaactttcaga

SEQ ID NO: 6321 - DNA, 20 bp, synthetic construct
  misc_feature 1..20: note = CRISPR gRNA sequence
  source 1..20: mol_type = other DNA
gcttgcctgaactttcagag

SEQ ID NO: 6322 - DNA, 20 bp, synthetic construct
  misc_feature 1..20: note = CRISPR gRNA sequence
  source 1..20: mol_type = other DNA
cttgcctgaactttcagagg

SEQ ID NO: 6323 - DNA, 20 bp, synthetic construct
  misc_feature 1..20: note = CRISPR gRNA sequence
  source 1..20: mol_type = other DNA
actttcagagggggcatctg

SEQ ID NO: 6324 - DNA, 20 bp, synthetic construct
  misc_feature 1..20: note = CRISPR gRNA sequence
  source 1..20: mol_type = other DNA
ggcatctgtggtgtcttttg

SEQ ID NO: 6325 - DNA, 20 bp, synthetic construct
  misc_feature 1..20: note = CRISPR gRNA sequence
  source 1..20: mol_type = other DNA
gcatctgtggtgtcttttgt

SEQ ID NO: 6326 - DNA, 20 bp, synthetic construct
  misc_feature 1..20: note = CRISPR gRNA sequence
  source 1..20: mol_type = other DNA
catctgtggtgtcttttgtg

SEQ ID NO: 6327 - DNA, 20 bp, synthetic construct
  misc_feature 1..20: note = CRISPR gRNA sequence
  source 1..20: mol_type = other DNA
gtgtcttttgtggggtcctg

SEQ ID NO: 6328 - DNA, 20 bp, synthetic construct
  misc_feature 1..20: note = CRISPR gRNA sequence
  source 1..20: mol_type = other DNA
tgtcttttgtggggtcctgt

SEQ ID NO: 6329 - DNA, 20 bp, synthetic construct
  misc_feature 1..20: note = CRISPR gRNA sequence
  source 1..20: mol_type = other DNA
taggatttccacgtccctct

SEQ ID NO: 6330 - DNA, 20 bp, synthetic construct
  misc_feature 1..20: note = CRISPR gRNA sequence
  source 1..20: mol_type = other DNA
ggatttccacgtccctcttg

SEQ ID NO: 6331 - DNA, 20 bp, synthetic construct
  misc_feature 1..20: note = CRISPR gRNA sequence
  source 1..20: mol_type = other DNA
gatttccacgtccctcttgg

SEQ ID NO: 6332 - DNA, 20 bp, synthetic construct
  misc_feature 1..20: note = CRISPR gRNA sequence
  source 1..20: mol_type = other DNA
cgtccctcttggaggaaaaa

SEQ ID NO: 6333 - DNA, 20 bp, synthetic construct
  misc_feature 1..20: note = CRISPR gRNA sequence
  source 1..20: mol_type = other DNA
ccctcttggaggaaaaatag

SEQ ID NO: 6334 - DNA, 20 bp, synthetic construct
  misc_feature 1..20: note = CRISPR gRNA sequence
  source 1..20: mol_type = other DNA
cttggaggaaaaatagaagt

SEQ ID NO: 6335 - DNA, 20 bp, synthetic construct
  misc_feature 1..20: note = CRISPR gRNA sequence
  source 1..20: mol_type = other DNA
aaaatagaagtaagttgtct

SEQ ID NO: 6336 - DNA, 20 bp, synthetic construct
  misc_feature 1..20: note = CRISPR gRNA sequence
  source 1..20: mol_type = other DNA
aaatagaagtaagttgtctc

SEQ ID NO: 6337 - DNA, 20 bp, synthetic construct
  misc_feature 1..20: note = CRISPR gRNA sequence
  source 1..20: mol_type = other DNA
agaagtaagttgtctcaggt

SEQ ID NO: 6338 - DNA, 20 bp, synthetic construct
  misc_feature 1..20: note = CRISPR gRNA sequence
  source 1..20: mol_type = other DNA
ttgtctcaggtcagattgtc

SEQ ID NO: 6339 - DNA, 20 bp, synthetic construct
  misc_feature 1..20: note = CRISPR gRNA sequence
  source 1..20: mol_type = other DNA
tgtctcaggtcagattgtct

SEQ ID NO: 6340 - DNA, 20 bp, synthetic construct
  misc_feature 1..20: note = CRISPR gRNA sequence
  source 1..20: mol_type = other DNA
ctcaggtcagattgtctggg

SEQ ID NO: 6341 - DNA, 20 bp, synthetic construct
  misc_feature 1..20: note = CRISPR gRNA sequence
  source 1..20: mol_type = other DNA
gtcagattgtctgggaagcc

SEQ ID NO: 6342 - DNA, 20 bp, synthetic construct
  misc_feature 1..20: note = CRISPR gRNA sequence
  source 1..20: mol_type = other DNA
agattgtctgggaagccaag

SEQ ID NO: 6343 - DNA, 20 bp, synthetic construct
  misc_feature 1..20: note = CRISPR gRNA sequence
  source 1..20: mol_type = other DNA
gattgtctgggaagccaagt

SEQ ID NO: 6344 - DNA, 20 bp, synthetic construct
  misc_feature 1..20: note = CRISPR gRNA sequence
  source 1..20: mol_type = other DNA
ttgtctgggaagccaagtag

SEQ ID NO: 6345 - DNA, 20 bp, synthetic construct
  misc_feature 1..20: note = CRISPR gRNA sequence
  source 1..20: mol_type = other DNA
ctgggaagccaagtaggaga

SEQ ID NO: 6346 - DNA, 20 bp, synthetic construct
  misc_feature 1..20: note = CRISPR gRNA sequence
  source 1..20: mol_type = other DNA
gggaagccaagtaggagatg

SEQ ID NO: 6347 - DNA, 20 bp, synthetic construct
  misc_feature 1..20: note = CRISPR gRNA sequence
  source 1..20: mol_type = other DNA
aggagatggagatttgcata

SEQ ID NO: 6348 - DNA, 20 bp, synthetic construct
  misc_feature 1..20: note = CRISPR gRNA sequence
  source 1..20: mol_type = other DNA
ggagatggagatttgcatat

SEQ ID NO: 6349 - DNA, 20 bp, synthetic construct
  misc_feature 1..20: note = CRISPR gRNA sequence
  source 1..20: mol_type = other DNA
agatggagatttgcatatag

SEQ ID NO: 6350 - DNA, 20 bp, synthetic construct
  misc_feature 1..20: note = CRISPR gRNA sequence
  source 1..20: mol_type = other DNA
gatggagatttgcatatagg

SEQ ID NO: 6351 - DNA, 20 bp, synthetic construct
  misc_feature 1..20: note = CRISPR gRNA sequence
  source 1..20: mol_type = other DNA
tttgcatataggaggtttac

SEQ ID NO: 6352 - DNA, 20 bp, synthetic construct
  misc_feature 1..20: note = CRISPR gRNA sequence
  source 1..20: mol_type = other DNA
ttgcatataggaggtttact

SEQ ID NO: 6353 - DNA, 20 bp, synthetic construct
  misc_feature 1..20: note = CRISPR gRNA sequence
  source 1..20: mol_type = other DNA
tgcatataggaggtttactg

SEQ ID NO: 6354 - DNA, 20 bp, synthetic construct
  misc_feature 1..20: note = CRISPR gRNA sequence
  source 1..20: mol_type = other DNA
aggtttactggggacattca

SEQ ID NO: 6355 - DNA, 20 bp, synthetic construct
  misc_feature 1..20: note = CRISPR gRNA sequence
  source 1..20: mol_type = other DNA
ggtttactggggacattcac

SEQ ID NO: 6356 - DNA, 20 bp, synthetic construct
  misc_feature 1..20: note = CRISPR gRNA sequence
  source 1..20: mol_type = other DNA
tttactggggacattcacag

SEQ ID NO: 6357 - DNA, 20 bp, synthetic construct
  misc_feature 1..20: note = CRISPR gRNA sequence
  source 1..20: mol_type = other DNA
ttactggggacattcacagg

SEQ ID NO: 6358 - DNA, 20 bp, synthetic construct
  misc_feature 1..20: note = CRISPR gRNA sequence
  source 1..20: mol_type = other DNA
tactggggacattcacagga

SEQ ID NO: 6359 - DNA, 20 bp, synthetic construct
  misc_feature 1..20: note = CRISPR gRNA sequence
  source 1..20: mol_type = other DNA
ttcacaggagggaacacccg

SEQ ID NO: 6360 - DNA, 20 bp, synthetic construct
  misc_feature 1..20: note = CRISPR gRNA sequence
  source 1..20: mol_type = other DNA
tcacaggagggaacacccga

SEQ ID NO: 6361 - DNA, 20 bp, synthetic construct
  misc_feature 1..20: note = CRISPR gRNA sequence
  source 1..20: mol_type = other DNA
ggagggaacacccgaaggaa

SEQ ID NO: 6362 - DNA, 20 bp, synthetic construct
  misc_feature 1..20: note = CRISPR gRNA sequence
  source 1..20: mol_type = other DNA
gagggaacacccgaaggaaa

SEQ ID NO: 6363 - DNA, 20 bp, synthetic construct
  misc_feature 1..20: note = CRISPR gRNA sequence
  source 1..20: mol_type = other DNA
agggaacacccgaaggaaaa

SEQ ID NO: 6364 - DNA, 20 bp, synthetic construct
  misc_feature 1..20: note = CRISPR gRNA sequence
  source 1..20: mol_type = other DNA
gaacacccgaaggaaaaggg

SEQ ID NO: 6365 - DNA, 20 bp, synthetic construct
  misc_feature 1..20: note = CRISPR gRNA sequence
  source 1..20: mol_type = other DNA
acccgaaggaaaagggaaga

SEQ ID NO: 6366 - DNA, 20 bp, synthetic construct
  misc_feature 1..20: note = CRISPR gRNA sequence
  source 1..20: mol_type = other DNA
cgaaggaaaagggaagaaag

SEQ ID NO: 6367 - DNA, 20 bp, synthetic construct
  misc_feature 1..20: note = CRISPR gRNA sequence
  source 1..20: mol_type = other DNA
gaaggaaaagggaagaaagc

SEQ ID NO: 6368 - DNA, 20 bp, synthetic construct
  misc_feature 1..20: note = CRISPR gRNA sequence
  source 1..20: mol_type = other DNA
aaggaaaagggaagaaagca

SEQ ID NO: 6369 - DNA, 20 bp, synthetic construct
  misc_feature 1..20: note = CRISPR gRNA sequence
  source 1..20: mol_type = other DNA
aaaagggaagaaagcagggt

SEQ ID NO: 6370 - DNA, 20 bp, synthetic construct
  misc_feature 1..20: note = CRISPR gRNA sequence
  source 1..20: mol_type = other DNA
aaagggaagaaagcagggtt

SEQ ID NO: 6371 - DNA, 20 bp, synthetic construct
  misc_feature 1..20: note = CRISPR gRNA sequence
  source 1..20: mol_type = other DNA
gggaagaaagcagggttggg

SEQ ID NO: 6372 - DNA, 20 bp, synthetic construct
  misc_feature 1..20: note = CRISPR gRNA sequence
  source 1..20: mol_type = other DNA
aagaaagcagggttgggaag

SEQ ID NO: 6373 - DNA, 20 bp, synthetic construct
  misc_feature 1..20: note = CRISPR gRNA sequence
  source 1..20: mol_type = other DNA
aaagcagggttgggaagcag

SEQ ID NO: 6374 - DNA, 20 bp, synthetic construct
  misc_feature 1..20: note = CRISPR gRNA sequence
  source 1..20: mol_type = other DNA
aagcagggttgggaagcagc

SEQ ID NO: 6375 - DNA, 20 bp, synthetic construct
  misc_feature 1..20: note = CRISPR gRNA sequence
  source 1..20: mol_type = other DNA
gcagggttgggaagcagcag

SEQ ID NO: 6376 - DNA, 20 bp, synthetic construct
  misc_feature 1..20: note = CRISPR gRNA sequence
  source 1..20: mol_type = other DNA
gttgggaagcagcaggagtt

SEQ ID NO: 6377 - DNA, 20 bp, synthetic construct
  misc_feature 1..20: note = CRISPR gRNA sequence
  source 1..20: mol_type = other DNA
ttgggaagcagcaggagttg

SEQ ID NO: 6378 - DNA, 20 bp, synthetic construct
  misc_feature 1..20: note = CRISPR gRNA sequence
  source 1..20: mol_type = other DNA
gcaggagttgaggtgcaatg

SEQ ID NO: 6379 - DNA, 20 bp, synthetic construct
  misc_feature 1..20: note = CRISPR gRNA sequence
  source 1..20: mol_type = other DNA
gaggtgcaatgcagtcacaa

SEQ ID NO: 6380 - DNA, 20 bp, synthetic construct
  misc_feature 1..20: note = CRISPR gRNA sequence
  source 1..20: mol_type = other DNA
ggtgcaatgcagtcacaaca

SEQ ID NO: 6381 - DNA, 20 bp, synthetic construct
  misc_feature 1..20: note = CRISPR gRNA sequence
  source 1..20: mol_type = other DNA
gtgcaatgcagtcacaacag

SEQ ID NO: 6382 - DNA, 20 bp, synthetic construct
  misc_feature 1..20: note = CRISPR gRNA sequence
  source 1..20: mol_type = other DNA
tgcagtcacaacagaggtct

SEQ ID NO: 6383 - DNA, 20 bp, synthetic construct
  misc_feature 1..20: note = CRISPR gRNA sequence
  source 1..20: mol_type = other DNA
agaggtcttagccaatccca

SEQ ID NO: 6384 - DNA, 20 bp, synthetic construct
  misc_feature 1..20: note = CRISPR gRNA sequence
  source 1..20: mol_type = other DNA
gaggtcttagccaatcccat

SEQ ID NO: 6385 - DNA, 20 bp, synthetic construct
  misc_feature 1..20: note = CRISPR gRNA sequence
  source 1..20: mol_type = other DNA
aggtcttagccaatcccata

SEQ ID NO: 6386 - DNA, 20 bp, synthetic construct
  misc_feature 1..20: note = CRISPR gRNA sequence
  source 1..20: mol_type = other DNA
gtcttagccaatcccatagg

SEQ ID NO: 6387 - DNA, 20 bp, synthetic construct
  misc_feature 1..20: note = CRISPR gRNA sequence
  source 1..20: mol_type = other DNA
caatcccatagggagcactc

SEQ ID NO: 6388 - DNA, 20 bp, synthetic construct
  misc_feature 1..20: note = CRISPR gRNA sequence
  source 1..20: mol_type = other DNA
cccatagggagcactcaagc

SEQ ID NO: 6389 - DNA, 20 bp, synthetic construct
  misc_feature 1..20: note = CRISPR gRNA sequence
  source 1..20: mol_type = other DNA
ccatagggagcactcaagct

SEQ ID NO: 6390 - DNA, 20 bp, synthetic construct
  misc_feature 1..20: note = CRISPR gRNA sequence
  source 1..20: mol_type = other DNA
agggagcactcaagctggga

SEQ ID NO: 6391 - DNA, 20 bp, synthetic construct
  misc_feature 1..20: note = CRISPR gRNA sequence
  source 1..20: mol_type = other DNA
agcactcaagctgggacagc

SEQ ID NO: 6392 - DNA, 20 bp, synthetic construct
  misc_feature 1..20: note = CRISPR gRNA sequence
  source 1..20: mol_type = other DNA
gcactcaagctgggacagca

SEQ ID NO: 6393 - DNA, 20 bp, synthetic construct
  misc_feature 1..20: note = CRISPR gRNA sequence
  source 1..20: mol_type = other DNA
ctcaagctgggacagcaagg

SEQ ID NO: 6394 - DNA, 20 bp, synthetic construct
  misc_feature 1..20: note = CRISPR gRNA sequence
  source 1..20: mol_type = other DNA
agctgggacagcaaggaagc

SEQ ID NO: 6395 - DNA, 20 bp, synthetic construct
  misc_feature 1..20: note = CRISPR gRNA sequence
  source 1..20: mol_type = other DNA
tctacctccgtcctcccata

SEQ ID NO: 6396 - DNA, 20 bp, synthetic construct
  misc_feature 1..20: note = CRISPR gRNA sequence
  source 1..20: mol_type = other DNA
ctacctccgtcctcccatac

SEQ ID NO: 6397 - DNA, 20 bp, synthetic construct
  misc_feature 1..20: note = CRISPR gRNA sequence
  source 1..20: mol_type = other DNA
tccgtcctcccatacaggca

SEQ ID NO: 6398 - DNA, 20 bp, synthetic construct
  misc_feature 1..20: note = CRISPR gRNA sequence
  source 1..20: mol_type = other DNA
cctcccccatgatgaacact

SEQ ID NO: 6399 - DNA, 20 bp, synthetic construct
  misc_feature 1..20: note = CRISPR gRNA sequence
  source 1..20: mol_type = other DNA
ccatgatgaacactcagcac

SEQ ID NO: 6400 - DNA, 20 bp, synthetic construct
  misc_feature 1..20: note = CRISPR gRNA sequence
  source 1..20: mol_type = other DNA
ttgatgcatcattattaccc

SEQ ID NO: 6401 - DNA, 20 bp, synthetic construct
  misc_feature 1..20: note = CRISPR gRNA sequence
  source 1..20: mol_type = other DNA
tgatgcatcattattaccca

SEQ ID NO: 6402 - DNA, 20 bp, synthetic construct
  misc_feature 1..20: note = CRISPR gRNA sequence
  source 1..20: mol_type = other DNA
tcattattacccaaggtcca

SEQ ID NO: 6403 - DNA, 20 bp, synthetic construct
  misc_feature 1..20: note = CRISPR gRNA sequence
  source 1..20: mol_type = other DNA
ggtccatggtttgtttacat

SEQ ID NO: 6404 - DNA, 20 bp, synthetic construct
  misc_feature 1..20: note = CRISPR gRNA sequence
  source 1..20: mol_type = other DNA
gtccatggtttgtttacatg

SEQ ID NO: 6405 - DNA, 20 bp, synthetic construct
  misc_feature 1..20: note = CRISPR gRNA sequence
  source 1..20: mol_type = other DNA
tccatggtttgtttacatga

SEQ ID NO: 6406 - DNA, 20 bp, synthetic construct
  misc_feature 1..20: note = CRISPR gRNA sequence
  source 1..20: mol_type = other DNA
tttacatgagggtttactct

SEQ ID NO: 6407 - DNA, 20 bp, synthetic construct
  misc_feature 1..20: note = CRISPR gRNA sequence
  source 1..20: mol_type = other DNA
tcttggtgttgtacattctg

SEQ ID NO: 6408 - DNA, 20 bp, synthetic construct
  misc_feature 1..20: note = CRISPR gRNA sequence
  source 1..20: mol_type = other DNA
cttggtgttgtacattctgt

SEQ ID NO: 6409 - DNA, 20 bp, synthetic construct
  misc_feature 1..20: note = CRISPR gRNA sequence
  source 1..20: mol_type = other DNA
tgttgtacattctgtgggtt

SEQ ID NO: 6410 - DNA, 20 bp, synthetic construct
  misc_feature 1..20: note = CRISPR gRNA sequence
  source 1..20: mol_type = other DNA
gtacattctgtgggtttgga

SEQ ID NO: 6411 - DNA, 20 bp, synthetic construct
  misc_feature 1..20: note = CRISPR gRNA sequence
  source 1..20: mol_type = other DNA
atgtaatgtatatgacatta

SEQ ID NO: 6412 - DNA, 20 bp, synthetic construct
  misc_feature 1..20: note = CRISPR gRNA sequence
  source 1..20: mol_type = other DNA
tatgacattatagtatcaca

SEQ ID NO: 6413 - DNA, 20 bp, synthetic construct
  misc_feature 1..20: note = CRISPR gRNA sequence
  source 1..20: mol_type = other DNA
gactcatttcacttgtgact

SEQ ID NO: 6414 - DNA, 20 bp, synthetic construct
  misc_feature 1..20: note = CRISPR gRNA sequence
  source 1..20: mol_type = other DNA
ttaacctgcctccaactgct

SEQ ID NO: 6415 - DNA, 20 bp, synthetic construct
  misc_feature 1..20: note = CRISPR gRNA sequence
  source 1..20: mol_type = other DNA
acctgcctccaactgctgag

SEQ ID NO: 6416 - DNA, 20 bp, synthetic construct
  misc_feature 1..20: note = CRISPR gRNA sequence
  source 1..20: mol_type = other DNA
ccaactgctgagaagccctt

SEQ ID NO: 6417 - DNA, 20 bp, synthetic construct
  misc_feature 1..20: note = CRISPR gRNA sequence
  source 1..20: mol_type = other DNA
ctgctgagaagccctttggc

SEQ ID NO: 6418 - DNA, 20 bp, synthetic construct
  misc_feature 1..20: note = CRISPR gRNA sequence
  source 1..20: mol_type = other DNA
tgctgagaagccctttggct

SEQ ID NO: 6419 - DNA, 20 bp, synthetic construct
  misc_feature 1..20: note = CRISPR gRNA sequence
  source 1..20: mol_type = other DNA
gctgagaagccctttggcta

SEQ ID NO: 6420 - DNA, 20 bp, synthetic construct
  misc_feature 1..20: note = CRISPR gRNA sequence
  source 1..20: mol_type = other DNA
agccctttggctagggattg

SEQ ID NO: 6421 - DNA, 20 bp, synthetic construct
  misc_feature 1..20: note = CRISPR gRNA sequence
  source 1..20: mol_type = other DNA
ttttccactttcctgctctg

SEQ ID NO: 6422 - DNA, 20 bp, synthetic construct
  misc_feature 1..20: note = CRISPR gRNA sequence
  source 1..20: mol_type = other DNA
tctgaagttactttgtttgc

SEQ ID NO: 6423 - DNA, 20 bp, synthetic construct
  misc_feature 1..20: note = CRISPR gRNA sequence
  source 1..20: mol_type = other DNA
tgaagttactttgtttgcca

SEQ ID NO: 6424 - DNA, 20 bp, synthetic construct
  misc_feature 1..20: note = CRISPR gRNA sequence
  source 1..20: mol_type = other DNA
gaagttactttgtttgccag

SEQ ID NO: 6425 - DNA, 20 bp, synthetic construct
  misc_feature 1..20: note = CRISPR gRNA sequence
  source 1..20: mol_type = other DNA
ttactttgtttgccagaggc

SEQ ID NO: 6426 - DNA, 20 bp, synthetic construct
  misc_feature 1..20: note = CRISPR gRNA sequence
  source 1..20: mol_type = other DNA
tttgtttgccagaggctggt

SEQ ID NO: 6427 - DNA, 20 bp, synthetic construct
  misc_feature 1..20: note = CRISPR gRNA sequence
  source 1..20: mol_type = other DNA
ggctggttggttcaaaccca

SEQ ID NO: 6428 - DNA, 20 bp, synthetic construct
  misc_feature 1..20: note = CRISPR gRNA sequence
  source 1..20: mol_type = other DNA
gctggttggttcaaacccaa

SEQ ID NO: 6429 - DNA, 20 bp, synthetic construct
  misc_feature 1..20: note = CRISPR gRNA sequence
  source 1..20: mol_type = other DNA
ctggttggttcaaacccaaa

SEQ ID NO: 6430 - DNA, 20 bp, synthetic construct
  misc_feature 1..20: note = CRISPR gRNA sequence
  source 1..20: mol_type = other DNA
gttggttcaaacccaaaggg

SEQ ID NO: 6431 - DNA, 20 bp, synthetic construct
  misc_feature 1..20: note = CRISPR gRNA sequence
  source 1..20: mol_type = other DNA
ttggttcaaacccaaagggc

SEQ ID NO: 6432 - DNA, 20 bp, synthetic construct
  misc_feature 1..20: note = CRISPR gRNA sequence
  source 1..20: mol_type = other DNA
tggttcaaacccaaagggca

SEQ ID NO: 6433 - DNA, 20 bp, synthetic construct
  misc_feature 1..20: note = CRISPR gRNA sequence
  source 1..20: mol_type = other DNA
gttcaaacccaaagggcagg

SEQ ID NO: 6434 - DNA, 20 bp, synthetic construct
  misc_feature 1..20: note = CRISPR gRNA sequence
  source 1..20: mol_type = other DNA
caaagggcagggagctgcaa

SEQ ID NO: 6435 - DNA, 20 bp, synthetic construct
  misc_feature 1..20: note = CRISPR gRNA sequence
  source 1..20: mol_type = other DNA
tgcaatggaaatccattcaa

SEQ ID NO: 6436 - DNA, 20 bp, synthetic construct
  misc_feature 1..20: note = CRISPR gRNA sequence
  source 1..20: mol_type = other DNA
ggaaatccattcaacggtgc

SEQ ID NO: 6437 - DNA, 20 bp, synthetic construct
  misc_feature 1..20: note = CRISPR gRNA sequence
  source 1..20: mol_type = other DNA
ccattcaacggtgctggaat

SEQ ID NO: 6438 - DNA, 20 bp, synthetic construct
  misc_feature 1..20: note = CRISPR gRNA sequence
  source 1..20: mol_type = other DNA
cattcaacggtgctggaatt

SEQ ID NO: 6439 - DNA, 20 bp, synthetic construct
  misc_feature 1..20: note = CRISPR gRNA sequence
  source 1..20: mol_type = other DNA
caacggtgctggaattggga

SEQ ID NO: 6440 - DNA, 20 bp, synthetic construct
  misc_feature 1..20: note = CRISPR gRNA sequence
  source 1..20: mol_type = other DNA
gctggaattgggatggcaaa

SEQ ID NO: 6441 - DNA, 20 bp, synthetic construct
  misc_feature 1..20: note = CRISPR gRNA sequence
  source 1..20: mol_type = other DNA
ctggaattgggatggcaaaa

SEQ ID NO: 6442 - DNA, 20 bp, synthetic construct
  misc_feature 1..20: note = CRISPR gRNA sequence
  source 1..20: mol_type = other DNA
ggaattgggatggcaaaaag

SEQ ID NO: 6443 - DNA, 20 bp, synthetic construct
  misc_feature 1..20: note = CRISPR gRNA sequence
  source 1..20: mol_type = other DNA
attgggatggcaaaaaggag

SEQ ID NO: 6444 - DNA, 20 bp, synthetic construct
  misc_feature 1..20: note = CRISPR gRNA sequence
  source 1..20: mol_type = other DNA
gggatggcaaaaaggagcag

SEQ ID NO: 6445 - DNA, 20 bp, synthetic construct
  misc_feature 1..20: note = CRISPR gRNA sequence
  source 1..20: mol_type = other DNA
ggatggcaaaaaggagcagc

SEQ ID NO: 6446 - DNA, 20 bp, synthetic construct
  misc_feature 1..20: note = CRISPR gRNA sequence
  source 1..20: mol_type = other DNA
tggcaaaaaggagcagcagg

SEQ ID NO: 6447 - DNA, 20 bp, synthetic construct
  misc_feature 1..20: note = CRISPR gRNA sequence
  source 1..20: mol_type = other DNA
ggcaaaaaggagcagcaggc

SEQ ID NO: 6448 - DNA, 20 bp, synthetic construct
  misc_feature 1..20: note = CRISPR gRNA sequence
  source 1..20: mol_type = other DNA
aaggagcagcaggcaggtgt

SEQ ID NO: 6449 - DNA, 20 bp, synthetic construct
  misc_feature 1..20: note = CRISPR gRNA sequence
  source 1..20: mol_type = other DNA
gagcagcaggcaggtgtcag

SEQ ID NO: 6450 - DNA, 20 bp, synthetic construct
  misc_feature 1..20: note = CRISPR gRNA sequence
  source 1..20: mol_type = other DNA
agcagcaggcaggtgtcagc

SEQ ID NO: 6451 - DNA, 20 bp, synthetic construct
  misc_feature 1..20: note = CRISPR gRNA sequence
  source 1..20: mol_type = other DNA
gcagcaggcaggtgtcagca

SEQ ID NO: 6452 - DNA, 20 bp, synthetic construct
  misc_feature 1..20: note = CRISPR gRNA sequence
  source 1..20: mol_type = other DNA
agcaggcaggtgtcagcagg

SEQ ID NO: 6453 - DNA, 20 bp, synthetic construct
  misc_feature 1..20: note = CRISPR gRNA sequence
  source 1..20: mol_type = other DNA
aggcaggtgtcagcagggag

SEQ ID NO: 6454 - DNA, 20 bp, synthetic construct
  misc_feature 1..20: note = CRISPR gRNA sequence
  source 1..20: mol_type = other DNA
gagcagctctttgcatccca

SEQ ID NO: 6455 - DNA, 20 bp, synthetic construct
  misc_feature 1..20: note = CRISPR gRNA sequence
  source 1..20: mol_type = other DNA
tctttgcatcccacagttcc

SEQ ID NO: 6456 - DNA, 20 bp, synthetic construct
  misc_feature 1..20: note = CRISPR gRNA sequence
  source 1..20: mol_type = other DNA
ctttgcatcccacagttccc

SEQ ID NO: 6457 - DNA, 20 bp, synthetic construct
  misc_feature 1..20: note = CRISPR gRNA sequence
  source 1..20: mol_type = other DNA
tttgcatcccacagttccca

SEQ ID NO: 6458 - DNA, 20 bp, synthetic construct
  misc_feature 1..20: note = CRISPR gRNA sequence
  source 1..20: mol_type = other DNA
tgcatcccacagttcccagg

SEQ ID NO: 6459 - DNA, 20 bp, synthetic construct
  misc_feature 1..20: note = CRISPR gRNA sequence
  source 1..20: mol_type = other DNA
tcattcatcctttcatttat

SEQ ID NO: 6460 - DNA, 20 bp, synthetic construct
  misc_feature 1..20: note = CRISPR gRNA sequence
  source 1..20: mol_type = other DNA
atcctttcatttatgagaca

SEQ ID NO: 6461 - DNA, 20 bp, synthetic construct
  misc_feature 1..20: note = CRISPR gRNA sequence
  source 1..20: mol_type = other DNA
caaagtctcactctgttgcc

SEQ ID NO: 6462 - DNA, 20 bp, synthetic construct
  misc_feature 1..20: note = CRISPR gRNA sequence
  source 1..20: mol_type = other DNA
aaagtctcactctgttgccc

SEQ ID NO: 6463 - DNA, 20 bp, synthetic construct
  misc_feature 1..20: note = CRISPR gRNA sequence
  source 1..20: mol_type = other DNA
tctcactctgttgcccaggt

SEQ ID NO: 6464 - DNA, 20 bp, synthetic construct
  misc_feature 1..20: note = CRISPR gRNA sequence
  source 1..20: mol_type = other DNA
tcactctgttgcccaggttg

SEQ ID NO: 6465 - DNA, 20 bp, synthetic construct
  misc_feature 1..20: note = CRISPR gRNA sequence
  source 1..20: mol_type = other DNA
ctgttgcccaggttggagtg

SEQ ID NO: 6466 - DNA, 20 bp, synthetic construct
  misc_feature 1..20: note = CRISPR gRNA sequence
  source 1..20: mol_type = other DNA
ttgcccaggttggagtgcag

SEQ ID NO: 6467 - DNA, 20 bp, synthetic construct
  misc_feature 1..20: note = CRISPR gRNA sequence
  source 1..20: mol_type = other DNA
caggttggagtgcagtggca

SEQ ID NO: 6468 - DNA, 20 bp, synthetic construct
  misc_feature 1..20: note = CRISPR gRNA sequence
  source 1..20: mol_type = other DNA
ggcacagtcattgctcactg

SEQ ID NO: 6469 - DNA, 20 bp, synthetic construct
  misc_feature 1..20: note = CRISPR gRNA sequence
  source 1..20: mol_type = other DNA
tcattgctcactgcagcctc

SEQ ID NO: 6470 - DNA, 20 bp, synthetic construct
  misc_feature 1..20: note = CRISPR gRNA sequence
  source 1..20: mol_type = other DNA
cactgcagcctcaagctcct

SEQ ID NO: 6471 - DNA, 20 bp, synthetic construct
  misc_feature 1..20: note = CRISPR gRNA sequence
  source 1..20: mol_type = other DNA
agcctcaagctcctgagctc

SEQ ID NO: 6472 - DNA, 20 bp, synthetic construct
  misc_feature 1..20: note = CRISPR gRNA sequence
  source 1..20: mol_type = other DNA
ctcaagccatcctcctgcct

SEQ ID NO: 6473 - DNA, 20 bp, synthetic construct
  misc_feature 1..20: note = CRISPR gRNA sequence
  source 1..20: mol_type = other DNA
tcctcctgcctcagcctccc

SEQ ID NO: 6474 - DNA, 20 bp, synthetic construct
  misc_feature 1..20: note = CRISPR gRNA sequence
  source 1..20: mol_type = other DNA
tcctgcctcagcctcccaag

SEQ ID NO: 6475 - DNA, 20 bp, synthetic construct
  misc_feature 1..20: note = CRISPR gRNA sequence
  source 1..20: mol_type = other DNA
cctcagcctcccaagtagcc

SEQ ID NO: 6476 - DNA, 20 bp, synthetic construct
  misc_feature 1..20: note = CRISPR gRNA sequence
  source 1..20: mol_type = other DNA
tcccaagtagccgagactac

SEQ ID NO: 6477 - DNA, 20 bp, synthetic construct
  misc_feature 1..20: note = CRISPR gRNA sequence
  source 1..20: mol_type = other DNA
cccaagtagccgagactaca

SEQ ID NO: 6478 - DNA, 20 bp, synthetic construct
  misc_feature 1..20: note = CRISPR gRNA sequence
  source 1..20: mol_type = other DNA
ccaagtagccgagactacaa

SEQ ID NO: 6479 - DNA, 20 bp, synthetic construct
  misc_feature 1..20: note = CRISPR gRNA sequence
  source 1..20: mol_type = other DNA
caagggcactccaccacacc

SEQ ID NO: 6480 - DNA, 20 bp, synthetic construct
  misc_feature 1..20: note = CRISPR gRNA sequence
  source 1..20: mol_type = other DNA
ttttgtatcttttatttctg

SEQ ID NO: 6481 - DNA, 20 bp, synthetic construct
  misc_feature 1..20: note = CRISPR gRNA sequence
  source 1..20: mol_type = other DNA
ttgtatcttttatttctgaa

SEQ ID NO: 6482 - DNA, 20 bp, synthetic construct
  misc_feature 1..20: note = CRISPR gRNA sequence
  source 1..20: mol_type = other DNA
atcttttatttctgaagaga

SEQ ID NO: 6483 - DNA, 20 bp, synthetic construct
  misc_feature 1..20: note = CRISPR gRNA sequence
  source 1..20: mol_type = other DNA
tcttttatttctgaagagat

SEQ ID NO: 6484 - DNA, 20 bp, synthetic construct
  misc_feature 1..20: note = CRISPR gRNA sequence
  source 1..20: mol_type = other DNA
cttttatttctgaagagatg

SEQ ID NO: 6485 - DNA, 20 bp, synthetic construct
  misc_feature 1..20: note = CRISPR gRNA sequence
  source 1..20: mol_type = other DNA
tggggtttcactatgttgcc

SEQ ID NO: 6486 - DNA, 20 bp, synthetic construct
  misc_feature 1..20: note = CRISPR gRNA sequence
  source 1..20: mol_type = other DNA
ggggtttcactatgttgccc

SEQ ID NO: 6487 - DNA, 20 bp, synthetic construct
  misc_feature 1..20: note = CRISPR gRNA sequence
  source 1..20: mol_type = other DNA
tttcactatgttgcccaggc

SEQ ID NO: 6488 - DNA, 20 bp, synthetic construct
  misc_feature 1..20: note = CRISPR gRNA sequence
  source 1..20: mol_type = other DNA
ccaggctggtctcaaactcc

SEQ ID NO: 6489 - DNA, 20 bp, synthetic construct
  misc_feature 1..20: note = CRISPR gRNA sequence
  source 1..20: mol_type = other DNA
ggtctcaaactcctggcctc

SEQ ID NO: 6490 - DNA, 20 bp, synthetic construct
  misc_feature 1..20: note = CRISPR gRNA sequence
  source 1..20: mol_type = other DNA
ctcaagtcatcctccctcct

SEQ ID NO: 6491 - DNA, 20 bp, synthetic construct
  misc_feature 1..20: note = CRISPR gRNA sequence
  source 1..20: mol_type = other DNA
cctccctcctcagcctccca

SEQ ID NO: 6492 - DNA, 20 bp, synthetic construct
  misc_feature 1..20: note = CRISPR gRNA sequence
  source 1..20: mol_type = other DNA
tcctcagcctcccaaagtgc

SEQ ID NO: 6493 - DNA, 20 bp, synthetic construct
  misc_feature 1..20: note = CRISPR gRNA sequence
  source 1..20: mol_type = other DNA
cctcagcctcccaaagtgct

SEQ ID NO: 6494 - DNA, 20 bp, synthetic construct
  misc_feature 1..20: note = CRISPR gRNA sequence
  source 1..20: mol_type = other DNA
ctcccaaagtgctgggatta

SEQ ID NO: 6495 - DNA, 20 bp, synthetic construct
  misc_feature 1..20: note = CRISPR gRNA sequence
  source 1..20: mol_type = other DNA
tcccaaagtgctgggattac

SEQ ID NO: 6496 - DNA, 20 bp, synthetic construct
  misc_feature 1..20: note = CRISPR gRNA sequence
  source 1..20: mol_type = other DNA
tgggattacaggtgtgatct

SEQ ID NO: 6497 - DNA, 20 bp, synthetic construct
  misc_feature 1..20: note = CRISPR gRNA sequence
  source 1..20: mol_type = other DNA
attacaggtgtgatctcaga

SEQ ID NO: 6498 - DNA, 20 bp, synthetic construct
  misc_feature 1..20: note = CRISPR gRNA sequence
  source 1..20: mol_type = other DNA
tcttaatcacctttccatct

SEQ ID NO: 6499 - DNA, 20 bp, synthetic construct
  misc_feature 1..20: note = CRISPR gRNA sequence
  source 1..20: mol_type = other DNA
aatcacctttccatctgagc

SEQ ID NO: 6500 - DNA, 20 bp, synthetic construct
  misc_feature 1..20: note = CRISPR gRNA sequence
  source 1..20: mol_type = other DNA
cacctttccatctgagctgg

SEQ ID NO: 6501 - DNA, 20 bp, synthetic construct
  misc_feature 1..20: note = CRISPR gRNA sequence
  source 1..20: mol_type = other DNA
ctttccatctgagctggcag

SEQ ID NO: 6502 - DNA, 20 bp, synthetic construct
  misc_feature 1..20: note = CRISPR gRNA sequence
  source 1..20: mol_type = other DNA
ttccatctgagctggcagca

SEQ ID NO: 6503 - DNA, 20 bp, synthetic construct
  misc_feature 1..20: note = CRISPR gRNA sequence
  source 1..20: mol_type = other DNA
atctgagctggcagcagagc

SEQ ID NO: 6504 - DNA, 20 bp, synthetic construct
  misc_feature 1..20: note = CRISPR gRNA sequence
  source 1..20: mol_type = other DNA
tctgagctggcagcagagct

SEQ ID NO: 6505 - DNA, 20 bp, synthetic construct
  misc_feature 1..20: note = CRISPR gRNA sequence
  source 1..20: mol_type = other DNA
agctggcagcagagctggga

SEQ ID NO: 6506 - DNA, 20 bp, synthetic construct
  misc_feature 1..20: note = CRISPR gRNA sequence
  source 1..20: mol_type = other DNA
ggaaagtgcacccaacaccc

SEQ ID NO: 6507 - DNA, 20 bp, synthetic construct
  misc_feature 1..20: note = CRISPR gRNA sequence
  source 1..20: mol_type = other DNA
caccccagatgctgcaactt

SEQ ID NO: 6508 - DNA, 20 bp, synthetic construct
  misc_feature 1..20: note = CRISPR gRNA sequence
  source 1..20: mol_type = other DNA
cttcctgctccttctctgtg

SEQ ID NO: 6509 - DNA, 20 bp, synthetic construct
  misc_feature 1..20: note = CRISPR gRNA sequence
  source 1..20: mol_type = other DNA
gctccttctctgtgtggaac

SEQ ID NO: 6510 - DNA, 20 bp, synthetic construct
  misc_feature 1..20: note = CRISPR gRNA sequence
  source 1..20: mol_type = other DNA
ctgtgtggaactggcctgtt

SEQ ID NO: 6511 - DNA, 20 bp, synthetic construct
  misc_feature 1..20: note = CRISPR gRNA sequence
  source 1..20: mol_type = other DNA
tgtgtggaactggcctgttt

SEQ ID NO: 6512 - DNA, 20 bp, synthetic construct
  misc_feature 1..20: note = CRISPR gRNA sequence
  source 1..20: mol_type = other DNA
aactggcctgtttgggtacc

SEQ ID NO: 6513 - DNA, 20 bp, synthetic construct
  misc_feature 1..20: note = CRISPR gRNA sequence
  source 1..20: mol_type = other DNA
actggcctgtttgggtaccc

SEQ ID NO: 6514 - DNA, 20 bp, synthetic construct
  misc_feature 1..20: note = CRISPR gRNA sequence
  source 1..20: mol_type = other DNA
ctggcctgtttgggtaccca

SEQ ID NO: 6515 - DNA, 20 bp, synthetic construct
  misc_feature 1..20: note = CRISPR gRNA sequence
  source 1..20: mol_type = other DNA
cctgtttgggtacccagggc

SEQ ID NO: 6516 - DNA, 20 bp, synthetic construct
  misc_feature 1..20: note = CRISPR gRNA sequence
  source 1..20: mol_type = other DNA
acccagggccagtcccctcc

SEQ ID NO: 6517 - DNA, 20 bp, synthetic construct
  misc_feature 1..20: note = CRISPR gRNA sequence
  source 1..20: mol_type = other DNA
gtcccctccaagaccctctg

SEQ ID NO: 6518 - DNA, 20 bp, synthetic construct
  misc_feature 1..20: note = CRISPR gRNA sequence
  source 1..20: mol_type = other DNA
tccaagaccctctgtagaaa

SEQ ID NO: 6519 - DNA, 20 bp, synthetic construct
  misc_feature 1..20: note = CRISPR gRNA sequence
  source 1..20: mol_type = other DNA
tgtacacctcaattccattg

SEQ ID NO: 6520 - DNA, 20 bp, synthetic construct
  misc_feature 1..20: note = CRISPR gRNA sequence
  source 1..20: mol_type = other DNA
gtacacctcaattccattgc

SEQ ID NO: 6521 - DNA, 20 bp, synthetic construct
  misc_feature 1..20: note = CRISPR gRNA sequence
  source 1..20: mol_type = other DNA
acctcaattccattgcagga

SEQ ID NO: 6522 - DNA, 20 bp, synthetic construct
  misc_feature 1..20: note = CRISPR gRNA sequence
  source 1..20: mol_type = other DNA
cctcaattccattgcaggac

SEQ ID NO: 6523 - DNA, 20 bp, synthetic construct
  misc_feature 1..20: note = CRISPR gRNA sequence
  source 1..20: mol_type = other DNA
aatcctgcctctccctgccc

SEQ ID NO: 6524 - DNA, 20 bp, synthetic construct
  misc_feature 1..20: note = CRISPR gRNA sequence
  source 1..20: mol_type = other DNA
cccagtcacccatccctccc

SEQ ID NO: 6525 - DNA, 20 bp, synthetic construct
  misc_feature 1..20: note = CRISPR gRNA sequence
  source 1..20: mol_type = other DNA
tccctcccaagccattatct

SEQ ID NO: 6526 - DNA, 20 bp, synthetic construct
  misc_feature 1..20: note = CRISPR gRNA sequence
  source 1..20: mol_type = other DNA
ccctcccaagccattatctt

SEQ ID NO: 6527 - DNA, 20 bp, synthetic construct
  misc_feature 1..20: note = CRISPR gRNA sequence
  source 1..20: mol_type = other DNA
gccattatcttgggacctgc

SEQ ID NO: 6528 - DNA, 20 bp, synthetic construct
  misc_feature 1..20: note = CRISPR gRNA sequence
  source 1..20: mol_type = other DNA
ccattatcttgggacctgca

SEQ ID NO: 6529 - DNA, 20 bp, synthetic construct
  misc_feature 1..20: note = CRISPR gRNA sequence
  source 1..20: mol_type = other DNA
cattatcttgggacctgcaa

SEQ ID NO: 6530 - DNA, 20 bp, synthetic construct
  misc_feature 1..20: note = CRISPR gRNA sequence
  source 1..20: mol_type = other DNA
tgggacctgcaagggcctcc

SEQ ID NO: 6531 - DNA, 20 bp, synthetic construct
  misc_feature 1..20: note = CRISPR gRNA sequence
  source 1..20: mol_type = other DNA
cctgcaagggcctccaagcc

SEQ ID NO: 6532 - DNA, 20 bp, synthetic construct
  misc_feature 1..20: note = CRISPR gRNA sequence
  source 1..20: mol_type = other DNA
ctgcaagggcctccaagcca

SEQ ID NO: 6533 - DNA, 20 bp, synthetic construct
  misc_feature 1..20: note = CRISPR gRNA sequence
  source 1..20: mol_type = other DNA
tgcaagggcctccaagccaa

SEQ ID NO: 6534 - DNA, 20 bp, synthetic construct
  misc_feature 1..20: note = CRISPR gRNA sequence
  source 1..20: mol_type = other DNA
aagggcctccaagccaaggg

SEQ ID NO: 6535 - DNA, 20 bp, synthetic construct
  misc_feature 1..20: note = CRISPR gRNA sequence
  source 1..20: mol_type = other DNA
ggtggcaaatccaaatacca

SEQ ID NO: 6536 - DNA, 20 bp, synthetic construct
  misc_feature 1..20: note = CRISPR gRNA sequence
  source 1..20: mol_type = other DNA
gtggcaaatccaaataccaa

SEQ ID NO: 6537 - DNA, 20 bp, synthetic construct
  misc_feature 1..20: note = CRISPR gRNA sequence
  source 1..20: mol_type = other DNA
tggcaaatccaaataccaaa

SEQ ID NO: 6538 - DNA, 20 bp, synthetic construct
  misc_feature 1..20: note = CRISPR gRNA sequence
  source 1..20: mol_type = other DNA
ggcaaatccaaataccaaag

SEQ ID NO: 6539 - DNA, 20 bp, synthetic construct
  misc_feature 1..20: note = CRISPR gRNA sequence
  source 1..20: mol_type = other DNA
ataatgatgtaaaatgtgtc

SEQ ID NO: 6540 - DNA, 20 bp, synthetic construct
  misc_feature 1..20: note = CRISPR gRNA sequence
  source 1..20: mol_type = other DNA
taatgatgtaaaatgtgtcc

SEQ ID NO: 6541 - DNA, 20 bp, synthetic construct
  misc_feature 1..20: note = CRISPR gRNA sequence
  source 1..20: mol_type = other DNA
tgatgtaaaatgtgtccagg

SEQ ID NO: 6542 - DNA, 20 bp, synthetic construct
  misc_feature 1..20: note = CRISPR gRNA sequence
  source 1..20: mol_type = other DNA
tgtaaaatgtgtccaggcag

SEQ ID NO: 6543 - DNA, 20 bp, synthetic construct
  misc_feature 1..20: note = CRISPR gRNA sequence
  source 1..20: mol_type = other DNA
gtaaaatgtgtccaggcaga

SEQ ID NO: 6544 - DNA, 20 bp, synthetic construct
  misc_feature 1..20: note = CRISPR gRNA sequence
  source 1..20: mol_type = other DNA
tgtgtccaggcagaaggcaa

SEQ ID NO: 6545 - DNA, 20 bp, synthetic construct
  misc_feature 1..20: note = CRISPR gRNA sequence
  source 1..20: mol_type = other DNA
gtgtccaggcagaaggcaat

SEQ ID NO: 6546 - DNA, 20 bp, synthetic construct
  misc_feature 1..20: note = CRISPR gRNA sequence
  source 1..20: mol_type = other DNA
tgtccaggcagaaggcaata

SEQ ID NO: 6547 - DNA, 20 bp, synthetic construct
  misc_feature 1..20: note = CRISPR gRNA sequence
  source 1..20: mol_type = other DNA
tccaggcagaaggcaatagg

SEQ ID NO: 6548 - DNA, 20 bp, synthetic construct
  misc_feature 1..20: note = CRISPR gRNA sequence
  source 1..20: mol_type = other DNA
aggcagaaggcaatagggag

SEQ ID NO: 6549 - DNA, 20 bp, synthetic construct
  misc_feature 1..20: note = CRISPR gRNA sequence
  source 1..20: mol_type = other DNA
cagaaggcaatagggagtag

SEQ ID NO: 6550 - DNA, 20 bp, synthetic construct
  misc_feature 1..20: note = CRISPR gRNA sequence
  source 1..20: mol_type = other DNA
agaaggcaatagggagtagt

SEQ ID NO: 6551 - DNA, 20 bp, synthetic construct
  misc_feature 1..20: note = CRISPR gRNA sequence
  source 1..20: mol_type = other DNA
gaaggcaatagggagtagtg

SEQ ID NO: 6552 - DNA, 20 bp, synthetic construct
  misc_feature 1..20: note = CRISPR gRNA sequence
  source 1..20: mol_type = other DNA
atagggagtagtggggcctc

SEQ ID NO: 6553 - DNA, 20 bp, synthetic construct
  misc_feature 1..20: note = CRISPR gRNA sequence
  source 1..20: mol_type = other DNA
acaattgtgtgtactctata

SEQ ID NO: 6554 - DNA, 20 bp, synthetic construct
  misc_feature 1..20: note = CRISPR gRNA sequence
  source 1..20: mol_type = other DNA
aattgtgtgtactctatata

SEQ ID NO: 6555 - DNA, 20 bp, synthetic construct
  misc_feature 1..20: note = CRISPR gRNA sequence
  source 1..20: mol_type = other DNA
tctatatagagacattgtga

SEQ ID NO: 6556 - DNA, 20 bp, synthetic construct
  misc_feature 1..20: note = CRISPR gRNA sequence
  source 1..20: mol_type = other DNA
gagacattgtgatggtgatt

SEQ ID NO: 6557 - DNA, 20 bp, synthetic construct
  misc_feature 1..20: note = CRISPR gRNA sequence
  source 1..20: mol_type = other DNA
agacacacacacacttatat

SEQ ID NO: 6558 - DNA, 20 bp, synthetic construct
  misc_feature 1..20: note = CRISPR gRNA sequence
  source 1..20: mol_type = other DNA
cacacacacttatattggct

SEQ ID NO: 6559 - DNA, 20 bp, synthetic construct
  misc_feature 1..20: note = CRISPR gRNA sequence
  source 1..20: mol_type = other DNA
acacacacttatattggctt

SEQ ID NO: 6560 - DNA, 20 bp, synthetic construct
  misc_feature 1..20: note = CRISPR gRNA sequence
  source 1..20: mol_type = other DNA
ggcttgggaaacaaaacaaa

SEQ ID NO: 6561 - DNA, 20 bp, synthetic construct
  misc_feature 1..20: note = CRISPR gRNA sequence
  source 1..20: mol_type = other DNA
gcttgggaaacaaaacaaat

SEQ ID NO: 6562 - DNA, 20 bp, synthetic construct
  misc_feature 1..20: note = CRISPR gRNA sequence
  source 1..20: mol_type = other DNA
aaacaaataggcctatcgac

SEQ ID NO: 6563 - DNA, 20 bp, synthetic construct
  misc_feature 1..20: note = CRISPR gRNA sequence
  source 1..20: mol_type = other DNA
ggattcaacttttgattttg

SEQ ID NO: 6564 - DNA, 20 bp, synthetic construct
  misc_feature 1..20: note = CRISPR gRNA sequence
  source 1..20: mol_type = other DNA
caacttttgattttgcagcc

SEQ ID NO: 6565 - DNA, 20 bp, synthetic construct
  misc_feature 1..20: note = CRISPR gRNA sequence
  source 1..20: mol_type = other DNA
attttgcagccaagcccctg

SEQ ID NO: 6566 - DNA, 20 bp, synthetic construct
  misc_feature 1..20: note = CRISPR gRNA sequence
  source 1..20: mol_type = other DNA
gcagccaagcccctgtggca

SEQ ID NO: 6567 - DNA, 20 bp, synthetic construct
  misc_feature 1..20: note = CRISPR gRNA sequence
  source 1..20: mol_type = other DNA
caagcccctgtggcacagct

SEQ ID NO: 6568 - DNA, 20 bp, synthetic construct
  misc_feature 1..20: note = CRISPR gRNA sequence
  source 1..20: mol_type = other DNA
aagcccctgtggcacagctg

SEQ ID NO: 6569 - DNA, 20 bp, synthetic construct
  misc_feature 1..20: note = CRISPR gRNA sequence
  source 1..20: mol_type = other DNA
gcccctgtggcacagctgag

SEQ ID NO: 6570 - DNA, 20 bp, synthetic construct
  misc_feature 1..20: note = CRISPR gRNA sequence
  source 1..20: mol_type = other DNA
tggcacagctgaggagcttg

SEQ ID NO: 6571 - DNA, 20 bp, synthetic construct
  misc_feature 1..20: note = CRISPR gRNA sequence
  source 1..20: mol_type = other DNA
ggcacagctgaggagcttgc

SEQ ID NO: 6572 - DNA, 20 bp, synthetic construct
  misc_feature 1..20: note = CRISPR gRNA sequence
  source 1..20: mol_type = other DNA
cagctgaggagcttgcaggt

SEQ ID NO: 6573 - DNA, 20 bp, synthetic construct
  misc_feature 1..20: note = CRISPR gRNA sequence
  source 1..20: mol_type = other DNA
tgaggagcttgcaggtcaga

SEQ ID NO: 6574 - DNA, 20 bp, synthetic construct
  misc_feature 1..20: note = CRISPR gRNA sequence
  source 1..20: mol_type = other DNA
gaggagcttgcaggtcagaa

SEQ ID NO: 6575 - DNA, 20 bp, synthetic construct
  misc_feature 1..20: note = CRISPR gRNA sequence
  source 1..20: mol_type = other DNA
aggagcttgcaggtcagaaa

SEQ ID NO: 6576 - DNA, 20 bp, synthetic construct
  misc_feature 1..20: note = CRISPR gRNA sequence
  source 1..20: mol_type = other DNA
ggagcttgcaggtcagaaag

SEQ ID NO: 6577 - DNA, 20 bp, synthetic construct
  misc_feature 1..20: note = CRISPR gRNA sequence
  source 1..20: mol_type = other DNA
tgcaggtcagaaaggggatt

SEQ ID NO: 6578 - DNA, 20 bp, synthetic construct
  misc_feature 1..20: note = CRISPR gRNA sequence
  source 1..20: mol_type = other DNA
caggtcagaaaggggattta

SEQ ID NO: 6579 - DNA, 20 bp, synthetic construct
  misc_feature 1..20: note = CRISPR gRNA sequence
  source 1..20: mol_type = other DNA
ggggatttagagccaaccaa

SEQ ID NO: 6580 - DNA, 20 bp, synthetic construct
  misc_feature 1..20: note = CRISPR gRNA sequence
  source 1..20: mol_type = other DNA
ccaaccaatagcaatatctc

SEQ ID NO: 6581 - DNA, 20 bp, synthetic construct
  misc_feature 1..20: note = CRISPR gRNA sequence
  source 1..20: mol_type = other DNA
tccagacctctcctgacacg

SEQ ID NO: 6582 - DNA, 20 bp, synthetic construct
  misc_feature 1..20: note = CRISPR gRNA sequence
  source 1..20: mol_type = other DNA
cacatgcacacacatgcatg

SEQ ID NO: 6583 - DNA, 20 bp, synthetic construct
  misc_feature 1..20: note = CRISPR gRNA sequence
  source 1..20: mol_type = other DNA
acatgcacacacatgcatgc

SEQ ID NO: 6584 - DNA, 20 bp, synthetic construct
  misc_feature 1..20: note = CRISPR gRNA sequence
  source 1..20: mol_type = other DNA
gcacatgcacgcacgtcttc

SEQ ID NO: 6585 - DNA, 20 bp, synthetic construct
  misc_feature 1..20: note = CRISPR gRNA sequence
  source 1..20: mol_type = other DNA
tcttctagtctccctgcctt

SEQ ID NO: 6586 - DNA, 20 bp, synthetic construct
  misc_feature 1..20: note = CRISPR gRNA sequence
  source 1..20: mol_type = other DNA
cttctagtctccctgccttg

SEQ ID NO: 6587 - DNA, 20 bp, synthetic construct
  misc_feature 1..20: note = CRISPR gRNA sequence
  source 1..20: mol_type = other DNA
ctgccttgaggacaaatgat

SEQ ID NO: 6588 - DNA, 20 bp, synthetic construct
  misc_feature 1..20: note = CRISPR gRNA sequence
  source 1..20: mol_type = other DNA
tcagatcctgcaactgtttc

SEQ ID NO: 6589 - DNA, 20 bp, synthetic construct
  misc_feature 1..20: note = CRISPR gRNA sequence
  source 1..20: mol_type = other DNA
cagatcctgcaactgtttcc

SEQ ID NO: 6590 - DNA, 20 bp, synthetic construct
  misc_feature 1..20: note = CRISPR gRNA sequence
  source 1..20: mol_type = other DNA
gcaactgtttccaggcccat

SEQ ID NO: 6591 - DNA, 20 bp, synthetic construct
  misc_feature 1..20: note = CRISPR gRNA sequence
  source 1..20: mol_type = other DNA
ttccaggcccataagcccct

SEQ ID NO: 6592 - DNA, 20 bp, synthetic construct
  misc_feature 1..20: note = CRISPR gRNA sequence
  source 1..20: mol_type = other DNA
ccataagcccctgagcattg

SEQ ID NO: 6593 - DNA, 20 bp, synthetic construct
  misc_feature 1..20: note = CRISPR gRNA sequence
  source 1..20: mol_type = other DNA
tgcagtgttgctacatgcct

SEQ ID NO: 6594 - DNA, 20 bp, synthetic construct
  misc_feature 1..20: note = CRISPR gRNA sequence
  source 1..20: mol_type = other DNA
gtgacctcctcgtgccactc

SEQ ID NO: 6595 - DNA, 20 bp, synthetic construct
  misc_feature 1..20: note = CRISPR gRNA sequence
  source 1..20: mol_type = other DNA
tgacctcctcgtgccactcc

SEQ ID NO: 6596 - DNA, 20 bp, synthetic construct
  misc_feature 1..20: note = CRISPR gRNA sequence
  source 1..20: mol_type = other DNA
cctcctcgtgccactccagg

SEQ ID NO: 6597 - DNA, 20 bp, synthetic construct
  misc_feature 1..20: note = CRISPR gRNA sequence
  source 1..20: mol_type = other DNA
cgtgccactccaggaagtga

SEQ ID NO: 6598 - DNA, 20 bp, synthetic construct
  misc_feature 1..20: note = CRISPR gRNA sequence
  source 1..20: mol_type = other DNA
ctccaggaagtgaaagtctt

SEQ ID NO: 6599 - DNA, 20 bp, synthetic construct
  misc_feature 1..20: note = CRISPR gRNA sequence
  source 1..20: mol_type = other DNA
aggaagtgaaagtcttgagt

SEQ ID NO: 6600 - DNA, 20 bp, synthetic construct
  misc_feature 1..20: note = CRISPR gRNA sequence
  source 1..20: mol_type = other DNA
gtgaaagtcttgagtgagac

SEQ ID NO: 6601 - DNA, 20 bp, synthetic construct
  misc_feature 1..20: note = CRISPR gRNA sequence
  source 1..20: mol_type = other DNA
aaagtcttgagtgagaccag

SEQ ID NO: 6602 - DNA, 20 bp, synthetic construct
  misc_feature 1..20: note = CRISPR gRNA sequence
  source 1..20: mol_type = other DNA
tgagaccagtagtttctctt

SEQ ID NO: 6603 - DNA, 20 bp, synthetic construct
  misc_feature 1..20: note = CRISPR gRNA sequence
  source 1..20: mol_type = other DNA
ctctctctgtctcgttctcc

SEQ ID NO: 6604 - DNA, 20 bp, synthetic construct
  misc_feature 1..20: note = CRISPR gRNA sequence
  source 1..20: mol_type = other DNA
tctctctgtctcgttctcct

SEQ ID NO: 6605 - DNA, 20 bp, synthetic construct
  misc_feature 1..20: note = CRISPR gRNA sequence
  source 1..20: mol_type = other DNA
tctcctgggatatctacact

SEQ ID NO: 6606 - DNA, 20 bp, synthetic construct
  misc_feature 1..20: note = CRISPR gRNA sequence
  source 1..20: mol_type = other DNA
atctacacttggtttgcaaa

SEQ ID NO: 6607 - DNA, 20 bp, synthetic construct
  misc_feature 1..20: note = CRISPR gRNA sequence
  source 1..20: mol_type = other DNA
tacacttggtttgcaaacag

SEQ ID NO: 6608 - DNA, 20 bp, synthetic construct
  misc_feature 1..20: note = CRISPR gRNA sequence
  source 1..20: mol_type = other DNA
acacttggtttgcaaacagc

SEQ ID NO: 6609 - DNA, 20 bp, synthetic construct
  misc_feature 1..20: note = CRISPR gRNA sequence
  source 1..20: mol_type = other DNA
ttggtttgcaaacagcaggc

SEQ ID NO: 6610 - DNA, 20 bp, synthetic construct
  misc_feature 1..20: note = CRISPR gRNA sequence
  source 1..20: mol_type = other DNA
ggtttgcaaacagcaggctg

SEQ ID NO: 6611 - DNA, 20 bp, synthetic construct
  misc_feature 1..20: note = CRISPR gRNA sequence
  source 1..20: mol_type = other DNA
tttgcaaacagcaggctgga

SEQ ID NO: 6612 - DNA, 20 bp, synthetic construct
  misc_feature 1..20: note = CRISPR gRNA sequence
  source 1..20: mol_type = other DNA
caaacagcaggctggagagt

SEQ ID NO: 6613 - DNA, 20 bp, synthetic construct
  misc_feature 1..20: note = CRISPR gRNA sequence
  source 1..20: mol_type = other DNA
aaacagcaggctggagagtg

SEQ ID NO: 6614 - DNA, 20 bp, synthetic construct
  misc_feature 1..20: note = CRISPR gRNA sequence
  source 1..20: mol_type = other DNA
aacagcaggctggagagtga

SEQ ID NO: 6615 - DNA, 20 bp, synthetic construct
  misc_feature 1..20: note = CRISPR gRNA sequence
  source 1..20: mol_type = other DNA
acagcaggctggagagtgag

SEQ ID NO: 6616 - DNA, 20 bp, synthetic construct
  misc_feature 1..20: note = CRISPR gRNA sequence
  source 1..20: mol_type = other DNA
ggggcttcttcctctacatc

SEQ ID NO: 6617 - DNA, 20 bp, synthetic construct
  misc_feature 1..20: note = CRISPR gRNA sequence
  source 1..20: mol_type = other DNA
ctcctcccccatcctgctcc

SEQ ID NO: 6618 - DNA, 20 bp, synthetic construct
  misc_feature 1..20: note = CRISPR gRNA sequence
  source 1..20: mol_type = other DNA
cccccatcctgctccaagtc

SEQ ID NO: 6619 - DNA, 20 bp, synthetic construct
  misc_feature 1..20: note = CRISPR gRNA sequence
  source 1..20: mol_type = other DNA
gcatgttcctatctcttccc

SEQ ID NO: 6620 - DNA, 20 bp, synthetic construct
  misc_feature 1..20: note = CRISPR gRNA sequence
  source 1..20: mol_type = other DNA
catgttcctatctcttcccc

SEQ ID NO: 6621 - DNA, 20 bp, synthetic construct
  misc_feature 1..20: note = CRISPR gRNA sequence
  source 1..20: mol_type = other DNA
ctatctcttccccaggaccc

SEQ ID NO: 6622 - DNA, 20 bp, synthetic construct
  misc_feature 1..20: note = CRISPR gRNA sequence
  source 1..20: mol_type = other DNA
tatctcttccccaggaccct

SEQ ID NO: 6623 - DNA, 20 bp, synthetic construct
  misc_feature 1..20: note = CRISPR gRNA sequence
  source 1..20: mol_type = other DNA
tccccaggaccctgggctct

SEQ ID NO: 6624 - DNA, 20 bp, synthetic construct
  misc_feature 1..20: note = CRISPR gRNA sequence
  source 1..20: mol_type = other DNA
ccccaggaccctgggctctt

SEQ ID NO: 6625 - DNA, 20 bp, synthetic construct
  misc_feature 1..20: note = CRISPR gRNA sequence
  source 1..20: mol_type = other DNA
tgggctcttgggcacaaatc

SEQ ID NO: 6626 - DNA, 20 bp, synthetic construct
  misc_feature 1..20: note = CRISPR gRNA sequence
  source 1..20: mol_type = other DNA
ggcacaaatcaagccatcac

SEQ ID NO: 6627 - DNA, 20 bp, synthetic construct
  misc_feature 1..20: note = CRISPR gRNA sequence
  source 1..20: mol_type = other DNA
caaatcaagccatcaccaga

SEQ ID NO: 6628 - DNA, 20 bp, synthetic construct
  misc_feature 1..20: note = CRISPR gRNA sequence
  source 1..20: mol_type = other DNA
agccatcaccagacagcctg

SEQ ID NO: 6629 - DNA, 20 bp, synthetic construct
  misc_feature 1..20: note = CRISPR gRNA sequence
  source 1..20: mol_type = other DNA
gccatcaccagacagcctgt

SEQ ID NO: 6630 - DNA, 20 bp, synthetic construct
  misc_feature 1..20: note = CRISPR gRNA sequence
  source 1..20: mol_type = other DNA
ccatcaccagacagcctgtg

SEQ ID NO: 6631 - DNA, 20 bp, synthetic construct
  misc_feature 1..20: note = CRISPR gRNA sequence
  source 1..20: mol_type = other DNA
tcaccagacagcctgtgggg

SEQ ID NO: 6632 - DNA, 20 bp, synthetic construct
  misc_feature 1..20: note = CRISPR gRNA sequence
  source 1..20: mol_type = other DNA
cagacagcctgtggggtggc

SEQ ID NO: 6633 - DNA, 20 bp, synthetic construct
  misc_feature 1..20: note = CRISPR gRNA sequence
  source 1..20: mol_type = other DNA
gacagcctgtggggtggcaa

SEQ ID NO: 6634 - DNA, 20 bp, synthetic construct
  misc_feature 1..20: note = CRISPR gRNA sequence
  source 1..20: mol_type = other DNA
agcctgtggggtggcaagag

SEQ ID NO: 6635 - DNA, 20 bp, synthetic construct
  misc_feature 1..20: note = CRISPR gRNA sequence
  source 1..20: mol_type = other DNA
cctgtggggtggcaagagca

SEQ ID NO: 6636 - DNA, 20 bp, synthetic construct
  misc_feature 1..20: note = CRISPR gRNA sequence
  source 1..20: mol_type = other DNA
ctgtggggtggcaagagcag

SEQ ID NO: 6637 - DNA, 20 bp, synthetic construct
  misc_feature 1..20: note = CRISPR gRNA sequence
  source 1..20: mol_type = other DNA
tgtttctttgtgaacatcta

SEQ ID NO: 6638 - DNA, 20 bp, synthetic construct
  misc_feature 1..20: note = CRISPR gRNA sequence
  source 1..20: mol_type = other DNA
gtttctttgtgaacatctat

SEQ ID NO: 6639 - DNA, 20 bp, synthetic construct
  misc_feature 1..20: note = CRISPR gRNA sequence
  source 1..20: mol_type = other DNA
ttgtgaacatctataggtac

SEQ ID NO: 6640 - DNA, 20 bp, synthetic construct
  misc_feature 1..20: note = CRISPR gRNA sequence
  source 1..20: mol_type = other DNA
tgtgaacatctataggtacc

SEQ ID NO: 6641 - DNA, 20 bp, synthetic construct
  misc_feature 1..20: note = CRISPR gRNA sequence
  source 1..20: mol_type = other DNA
tataggtaccaggctctgtg

SEQ ID NO: 6642 - DNA, 20 bp, synthetic construct
  misc_feature 1..20: note = CRISPR gRNA sequence
  source 1..20: mol_type = other DNA
ataggtaccaggctctgtgc

SEQ ID NO: 6643 - DNA, 20 bp, synthetic construct
  misc_feature 1..20: note = CRISPR gRNA sequence
  source 1..20: mol_type = other DNA
ctctgtgcaggccctattgt

SEQ ID NO: 6644 - DNA, 20 bp, synthetic construct
  misc_feature 1..20: note = CRISPR gRNA sequence
  source 1..20: mol_type = other DNA
gtgcaggccctattgttggt

SEQ ID NO: 6645 - DNA, 20 bp, synthetic construct
  misc_feature 1..20: note = CRISPR gRNA sequence
  source 1..20: mol_type = other DNA
gccctattgttggtgagcca

SEQ ID NO: 6646 - DNA, 20 bp, synthetic construct
  misc_feature 1..20: note = CRISPR gRNA sequence
  source 1..20: mol_type = other DNA
cctattgttggtgagccata

SEQ ID NO: 6647 - DNA, 20 bp, synthetic construct
  misc_feature 1..20: note = CRISPR gRNA sequence
  source 1..20: mol_type = other DNA
ctattgttggtgagccatag

SEQ ID NO: 6648 - DNA, 20 bp, synthetic construct
  misc_feature 1..20: note = CRISPR gRNA sequence
  source 1..20: mol_type = other DNA
tttcttttcttttcaacccc

SEQ ID NO: 6649 - DNA, 20 bp, synthetic construct
  misc_feature 1..20: note = CRISPR gRNA sequence
  source 1..20: mol_type = other DNA
ttcttttcttttcaacccct

SEQ ID NO: 6650 - DNA, 20 bp, synthetic construct
  misc_feature 1..20: note = CRISPR gRNA sequence
  source 1..20: mol_type = other DNA
taaaccttcgattaactgcc

SEQ ID NO: 6651 - DNA, 20 bp, synthetic construct
  misc_feature 1..20: note = CRISPR gRNA sequence
  source 1..20: mol_type = other DNA
cttcgattaactgcccagtg

SEQ ID NO: 6652 - DNA, 20 bp, synthetic construct
  misc_feature 1..20: note = CRISPR gRNA sequence
  source 1..20: mol_type = other DNA
attaactgcccagtgcagcc

SEQ ID NO: 6653 - DNA, 20 bp, synthetic construct
  misc_feature 1..20: note = CRISPR gRNA sequence
  source 1..20: mol_type = other DNA
ttaactgcccagtgcagccc

SEQ ID NO: 6654 - DNA, 20 bp, synthetic construct
  misc_feature 1..20: note = CRISPR gRNA sequence
  source 1..20: mol_type = other DNA
gcccagtgcagcccaggtca

SEQ ID NO: 6655 - DNA, 20 bp, synthetic construct
  misc_feature 1..20: note = CRISPR gRNA sequence
  source 1..20: mol_type = other DNA
tcatggtacactatgatctt

SEQ ID NO: 6656 - DNA, 20 bp, synthetic construct
  misc_feature 1..20: note = CRISPR gRNA sequence
  source 1..20: mol_type = other DNA
ctatgatctttggttcacat

SEQ ID NO: 6657 - DNA, 20 bp, synthetic construct
  misc_feature 1..20: note = CRISPR gRNA sequence
  source 1..20: mol_type = other DNA
tatgatctttggttcacatg

SEQ ID NO: 6658 - DNA, 20 bp, synthetic construct
  misc_feature 1..20: note = CRISPR gRNA sequence
  source 1..20: mol_type = other DNA
atgatctttggttcacatga

SEQ ID NO: 6659 - DNA, 20 bp, synthetic construct
  misc_feature 1..20: note = CRISPR gRNA sequence
  source 1..20: mol_type = other DNA
aatgtccctatttcccatac

SEQ ID NO: 6660 - DNA, 20 bp, synthetic construct
  misc_feature 1..20: note = CRISPR gRNA sequence
  source 1..20: mol_type = other DNA
atgtccctatttcccatact

SEQ ID NO: 6661 - DNA, 20 bp, synthetic construct
  misc_feature 1..20: note = CRISPR gRNA sequence
  source 1..20: mol_type = other DNA
gtgcccattctaatgcattt

SEQ ID NO: 6662 - DNA, 20 bp, synthetic construct
  misc_feature 1..20: note = CRISPR gRNA sequence
  source 1..20: mol_type = other DNA
tgcccattctaatgcatttc

SEQ ID NO: 6663 - DNA, 20 bp, synthetic construct
  misc_feature 1..20: note = CRISPR gRNA sequence
  source 1..20: mol_type = other DNA
ttgccttttttttttttttt

SEQ ID NO: 6664 - DNA, 20 bp, synthetic construct
  misc_feature 1..20: note = CRISPR gRNA sequence
  source 1..20: mol_type = other DNA
cttttttttttttttttaga

SEQ ID NO: 6665 - DNA, 20 bp, synthetic construct
  misc_feature 1..20: note = CRISPR gRNA sequence
  source 1..20: mol_type = other DNA
tttttttttttttttagatg

SEQ ID NO: 6666 - DNA, 20 bp, synthetic construct
  misc_feature 1..20: note = CRISPR gRNA sequence
  source 1..20: mol_type = other DNA
tggagtctcactctgtcacc

SEQ ID NO: 6667 - DNA, 20 bp, synthetic construct
  misc_feature 1..20: note = CRISPR gRNA sequence
  source 1..20: mol_type = other DNA
ggagtctcactctgtcaccc

SEQ ID NO: 6668 - DNA, 20 bp, synthetic construct
  misc_feature 1..20: note = CRISPR gRNA sequence
  source 1..20: mol_type = other DNA
ctcactctgtcacccaggct

SEQ ID NO: 6669 - DNA, 20 bp, synthetic construct
  misc_feature 1..20: note = CRISPR gRNA sequence
  source 1..20: mol_type = other DNA
caggctgagttttctatttt

SEQ ID NO: 6670 - DNA, 20 bp, synthetic construct
  misc_feature 1..20: note = CRISPR gRNA sequence
  source 1..20: mol_type = other DNA
gctgagttttctatttttag

SEQ ID NO: 6671 - DNA, 20 bp, synthetic construct
  misc_feature 1..20: note = CRISPR gRNA sequence
  source 1..20: mol_type = other DNA
tgagttttctatttttagta

SEQ ID NO: 6672 - DNA, 20 bp, synthetic construct
  misc_feature 1..20: note = CRISPR gRNA sequence
  source 1..20: mol_type = other DNA
ttttctatttttagtagaga

SEQ ID NO: 6673 - DNA, 20 bp, synthetic construct
  misc_feature 1..20: note = CRISPR gRNA sequence
  source 1..20: mol_type = other DNA
tttctatttttagtagagat

SEQ ID NO: 6674 - DNA, 20 bp, synthetic construct
  misc_feature 1..20: note = CRISPR gRNA sequence
  source 1..20: mol_type = other DNA
ttctatttttagtagagatg

SEQ ID NO: 6675 - DNA, 20 bp, synthetic construct
  misc_feature 1..20: note = CRISPR gRNA sequence
  source 1..20: mol_type = other DNA
gagatggggttttaccacct

SEQ ID NO: 6676 - DNA, 20 bp, synthetic construct
  misc_feature 1..20: note = CRISPR gRNA sequence
  source 1..20: mol_type = other DNA
tggggttttaccaccttggc

SEQ ID NO: 6677 - DNA, 20 bp, synthetic construct
  misc_feature 1..20: note = CRISPR gRNA sequence
  source 1..20: mol_type = other DNA
ggggttttaccaccttggcc

SEQ ID NO: 6678 - DNA, 20 bp, synthetic construct
  misc_feature 1..20: note = CRISPR gRNA sequence
  source 1..20: mol_type = other DNA
ttttaccaccttggccaggc

SEQ ID NO: 6679 - DNA, 20 bp, synthetic construct
  misc_feature 1..20: note = CRISPR gRNA sequence
  source 1..20: mol_type = other DNA
tggtctcaaactcctgacct

SEQ ID NO: 6680 - DNA, 20 bp, synthetic construct
  misc_feature 1..20: note = CRISPR gRNA sequence
  source 1..20: mol_type = other DNA
ggtctcaaactcctgacctc

SEQ ID NO: 6681 - DNA, 20 bp, synthetic construct
  misc_feature 1..20: note = CRISPR gRNA sequence
  source 1..20: mol_type = other DNA
ctcaggtgatccacccgcct

SEQ ID NO: 6682 - DNA, 20 bp, synthetic construct
  misc_feature 1..20: note = CRISPR gRNA sequence
  source 1..20: mol_type = other DNA
ccacccgcctcggcctccca

SEQ ID NO: 6683 - DNA, 20 bp, synthetic construct
  misc_feature 1..20: note = CRISPR gRNA sequence
  source 1..20: mol_type = other DNA
gcctcggcctcccaaagtgc

SEQ ID NO: 6684 - DNA, 20 bp, synthetic construct
  misc_feature 1..20: note = CRISPR gRNA sequence
  source 1..20: mol_type = other DNA
ctcccaaagtgctggaatta

SEQ ID NO: 6685 - DNA, 20 bp, synthetic construct
  misc_feature 1..20: note = CRISPR gRNA sequence
  source 1..20: mol_type = other DNA
tcccaaagtgctggaattac

SEQ ID NO: 6686 - DNA, 20 bp, synthetic construct
  misc_feature 1..20: note = CRISPR gRNA sequence
  source 1..20: mol_type = other DNA
agtgctggaattacaggtgc

SEQ ID NO: 6687 - DNA, 20 bp, synthetic construct
  misc_feature 1..20: note = CRISPR gRNA sequence
  source 1..20: mol_type = other DNA
caggtgcgagtcaccacgcc

SEQ ID NO: 6688 - DNA, 20 bp, synthetic construct
  misc_feature 1..20: note = CRISPR gRNA sequence
  source 1..20: mol_type = other DNA
cgagtcaccacgcctggcca

SEQ ID NO: 6689 - DNA, 20 bp, synthetic construct
  misc_feature 1..20: note = CRISPR gRNA sequence
  source 1..20: mol_type = other DNA
tgcattctgtactatgtttt

SEQ ID NO: 6690 - DNA, 20 bp, synthetic construct
  misc_feature 1..20: note = CRISPR gRNA sequence
  source 1..20: mol_type = other DNA
gcattctgtactatgttttt

SEQ ID NO: 6691 - DNA, 20 bp, synthetic construct
  misc_feature 1..20: note = CRISPR gRNA sequence
  source 1..20: mol_type = other DNA
ttgatctttgcttctaatca

SEQ ID NO: 6692 - DNA, 20 bp, synthetic construct
  misc_feature 1..20: note = CRISPR gRNA sequence
  source 1..20: mol_type = other DNA
atcacggacattgttctcta

SEQ ID NO: 6693 - DNA, 20 bp, synthetic construct
  misc_feature 1..20: note = CRISPR gRNA sequence
  source 1..20: mol_type = other DNA
cacggacattgttctctatg

SEQ ID NO: 6694 - DNA, 20 bp, synthetic construct
  misc_feature 1..20: note = CRISPR gRNA sequence
  source 1..20: mol_type = other DNA
acattgttctctatggagtg

SEQ ID NO: 6695 - DNA, 20 bp, synthetic construct
  misc_feature 1..20: note = CRISPR gRNA sequence
  source 1..20: mol_type = other DNA
cattgttctctatggagtgc

SEQ ID NO: 6696 - DNA, 20 bp, synthetic construct
  misc_feature 1..20: note = CRISPR gRNA sequence
  source 1..20: mol_type = other DNA
attgttctctatggagtgca

SEQ ID NO: 6697 - DNA, 20 bp, synthetic construct
  misc_feature 1..20: note = CRISPR gRNA sequence
  source 1..20: mol_type = other DNA
ttgttctctatggagtgcag

SEQ ID NO: 6698 - DNA, 20 bp, synthetic construct
  misc_feature 1..20: note = CRISPR gRNA sequence
  source 1..20: mol_type = other DNA
ttttcacctgtccacacccc

SEQ ID NO: 6699 - DNA, 20 bp, synthetic construct
  misc_feature 1..20: note = CRISPR gRNA sequence
  source 1..20: mol_type = other DNA
cctgtccacacccccagtga

SEQ ID NO: 6700 - DNA, 20 bp, synthetic construct
  misc_feature 1..20: note = CRISPR gRNA sequence
  source 1..20: mol_type = other DNA
cacccccagtgatggacacc

SEQ ID NO: 6701 - DNA, 20 bp, synthetic construct
  misc_feature 1..20: note = CRISPR gRNA sequence
  source 1..20: mol_type = other DNA
acccccagtgatggacacct

SEQ ID NO: 6702 - DNA, 20 bp, synthetic construct
  misc_feature 1..20: note = CRISPR gRNA sequence
  source 1..20: mol_type = other DNA
ctctgtcaccacaaataaca

SEQ ID NO: 6703 - DNA, 20 bp, synthetic construct
  misc_feature 1..20: note = CRISPR gRNA sequence
  source 1..20: mol_type = other DNA
tgtcaccacaaataacacag

SEQ ID NO: 6704 - DNA, 20 bp, synthetic construct
  misc_feature 1..20: note = CRISPR gRNA sequence
  source 1..20: mol_type = other DNA
aacacagcagtaaccatcct

SEQ ID NO: 6705 - DNA, 20 bp, synthetic construct
  misc_feature 1..20: note = CRISPR gRNA sequence
  source 1..20: mol_type = other DNA
cagcagtaaccatcctcaga

SEQ ID NO: 6706 - DNA, 20 bp, synthetic construct
  misc_feature 1..20: note = CRISPR gRNA sequence
  source 1..20: mol_type = other DNA
agcagtaaccatcctcagat

SEQ ID NO: 6707 - DNA, 20 bp, synthetic construct
  misc_feature 1..20: note = CRISPR gRNA sequence
  source 1..20: mol_type = other DNA
catcctcagatgggttctcc

SEQ ID NO: 6708 - DNA, 20 bp, synthetic construct
  misc_feature 1..20: note = CRISPR gRNA sequence
  source 1..20: mol_type = other DNA
atcctcagatgggttctcct

SEQ ID NO: 6709 - DNA, 20 bp, synthetic construct
  misc_feature 1..20: note = CRISPR gRNA sequence
  source 1..20: mol_type = other DNA
tcctcagatgggttctcctg

SEQ ID NO: 6710 - DNA, 20 bp, synthetic construct
  misc_feature 1..20: note = CRISPR gRNA sequence
  source 1..20: mol_type = other DNA
ctcagatgggttctcctggg

SEQ ID NO: 6711 - DNA, 20 bp, synthetic construct
  misc_feature 1..20: note = CRISPR gRNA sequence
  source 1..20: mol_type = other DNA
tgggttctcctggggagttg

SEQ ID NO: 6712 - DNA, 20 bp, synthetic construct
  misc_feature 1..20: note = CRISPR gRNA sequence
  source 1..20: mol_type = other DNA
gggttctcctggggagttgt

SEQ ID NO: 6713 - DNA, 20 bp, synthetic construct
  misc_feature 1..20: note = CRISPR gRNA sequence
  source 1..20: mol_type = other DNA
gagttgtgggaacatttctt

SEQ ID NO: 6714 - DNA, 20 bp, synthetic construct
  misc_feature 1..20: note = CRISPR gRNA sequence
  source 1..20: mol_type = other DNA
agttgtgggaacatttcttc

SEQ ID NO: 6715 - DNA, 20 bp, synthetic construct
  misc_feature 1..20: note = CRISPR gRNA sequence
  source 1..20: mol_type = other DNA
gaacatttcttcaggatata

SEQ ID NO: 6716 - DNA, 20 bp, synthetic construct
  misc_feature 1..20: note = CRISPR gRNA sequence
  source 1..20: mol_type = other DNA
tcttcaggatatatagaccc

SEQ ID NO: 6717 - DNA, 20 bp, synthetic construct
  misc_feature 1..20: note = CRISPR gRNA sequence
  source 1..20: mol_type = other DNA
ttcaggatatatagacccaa

SEQ ID NO: 6718 - DNA, 20 bp, synthetic construct
  misc_feature 1..20: note = CRISPR gRNA sequence
  source 1..20: mol_type = other DNA
agacccaagagctgaattgc

SEQ ID NO: 6719 - DNA, 20 bp, synthetic construct
  misc_feature 1..20: note = CRISPR gRNA sequence
  source 1..20: mol_type = other DNA
gacccaagagctgaattgcc

SEQ ID NO: 6720 - DNA, 20 bp, synthetic construct
  misc_feature 1..20: note = CRISPR gRNA sequence
  source 1..20: mol_type = other DNA
ccaagagctgaattgccagg

SEQ ID NO: 6721 - DNA, 20 bp, synthetic construct
  misc_feature 1..20: note = CRISPR gRNA sequence
  source 1..20: mol_type = other DNA
agagctgaattgccaggtgg

SEQ ID NO: 6722 - DNA, 20 bp, synthetic construct
  misc_feature 1..20: note = CRISPR gRNA sequence
  source 1..20: mol_type = other DNA
gagctgaattgccaggtggt

SEQ ID NO: 6723 - DNA, 20 bp, synthetic construct
  misc_feature 1..20: note = CRISPR gRNA sequence
  source 1..20: mol_type = other DNA
tggtaggatctacatatcct

SEQ ID NO: 6724 - DNA, 20 bp, synthetic construct
  misc_feature 1..20: note = CRISPR gRNA sequence
  source 1..20: mol_type = other DNA
ttagatattctacatgatgc

SEQ ID NO: 6725 - DNA, 20 bp, synthetic construct
  misc_feature 1..20: note = CRISPR gRNA sequence
  source 1..20: mol_type = other DNA
tagatattctacatgatgcc

SEQ ID NO: 6726 - DNA, 20 bp, synthetic construct
  misc_feature 1..20: note = CRISPR gRNA sequence
  source 1..20: mol_type = other DNA
catgatgccaggtcgttctc

SEQ ID NO: 6727 - DNA, 20 bp, synthetic construct
  misc_feature 1..20: note = CRISPR gRNA sequence
  source 1..20: mol_type = other DNA
tgatgccaggtcgttctcca

SEQ ID NO: 6728 - DNA, 20 bp, synthetic construct
  misc_feature 1..20: note = CRISPR gRNA sequence
  source 1..20: mol_type = other DNA
tgccaggtcgttctccagag

SEQ ID NO: 6729 - DNA, 20 bp, synthetic construct
  misc_feature 1..20: note = CRISPR gRNA sequence
  source 1..20: mol_type = other DNA
aaacccgtgtaaccaacact

SEQ ID NO: 6730 - DNA, 20 bp, synthetic construct
  misc_feature 1..20: note = CRISPR gRNA sequence
  source 1..20: mol_type = other DNA
aaccaacacttggcatttcc

SEQ ID NO: 6731 - DNA, 20 bp, synthetic construct
  misc_feature 1..20: note = CRISPR gRNA sequence
  source 1..20: mol_type = other DNA
cccagatgtctaacttttgc

SEQ ID NO: 6732 - DNA, 20 bp, synthetic construct
  misc_feature 1..20: note = CRISPR gRNA sequence
  source 1..20: mol_type = other DNA
tctaacttttgccagttgta

SEQ ID NO: 6733 - DNA, 20 bp, synthetic construct
  misc_feature 1..20: note = CRISPR gRNA sequence
  source 1..20: mol_type = other DNA
tttgccagttgtacagtatc

SEQ ID NO: 6734 - DNA, 20 bp, synthetic construct
  misc_feature 1..20: note = CRISPR gRNA sequence
  source 1..20: mol_type = other DNA
tcactttgctgttttatttt

SEQ ID NO: 6735 - DNA, 20 bp, synthetic construct
  misc_feature 1..20: note = CRISPR gRNA sequence
  source 1..20: mol_type = other DNA
actttgctgttttatttttg

SEQ ID NO: 6736 - DNA, 20 bp, synthetic construct
  misc_feature 1..20: note = CRISPR gRNA sequence
  source 1..20: mol_type = other DNA
tatttttggagtttacatct

SEQ ID NO: 6737 - DNA, 20 bp, synthetic construct
  misc_feature 1..20: note = CRISPR gRNA sequence
  source 1..20: mol_type = other DNA
cttagtaccacttactcgct

SEQ ID NO: 6738 - DNA, 20 bp, synthetic construct
  misc_feature 1..20: note = CRISPR gRNA sequence
  source 1..20: mol_type = other DNA
acttactcgctaagtcactt

SEQ ID NO: 6739 - DNA, 20 bp, synthetic construct
  misc_feature 1..20: note = CRISPR gRNA sequence
  source 1..20: mol_type = other DNA
cttactcgctaagtcacttt

SEQ ID NO: 6740 - DNA, 20 bp, synthetic construct
  misc_feature 1..20: note = CRISPR gRNA sequence
  source 1..20: mol_type = other DNA
ctcgctaagtcactttaggt

SEQ ID NO: 6741 - DNA, 20 bp, synthetic construct
  misc_feature 1..20: note = CRISPR gRNA sequence
  source 1..20: mol_type = other DNA
ttaggtaagtcacaacaacc

SEQ ID NO: 6742 - DNA, 20 bp, synthetic construct
  misc_feature 1..20: note = CRISPR gRNA sequence
  source 1..20: mol_type = other DNA
tcacaacaacccagtgacat

SEQ ID NO: 6743 - DNA, 20 bp, synthetic construct
  misc_feature 1..20: note = CRISPR gRNA sequence
  source 1..20: mol_type = other DNA
agcactgtgccaacaaaatg

SEQ ID NO: 6744 - DNA, 20 bp, synthetic construct
  misc_feature 1..20: note = CRISPR gRNA sequence
  source 1..20: mol_type = other DNA
atgcagtcgattctgtgact

SEQ ID NO: 6745 - DNA, 20 bp, synthetic construct
  misc_feature 1..20: note = CRISPR gRNA sequence
  source 1..20: mol_type = other DNA
gcagtcgattctgtgactca

SEQ ID NO: 6746 - DNA, 20 bp, synthetic construct
  misc_feature 1..20: note = CRISPR gRNA sequence
  source 1..20: mol_type = other DNA
agtcgattctgtgactcaga

SEQ ID NO: 6747 - DNA, 20 bp, synthetic construct
  misc_feature 1..20: note = CRISPR gRNA sequence
  source 1..20: mol_type = other DNA
gtcgattctgtgactcagag

SEQ ID NO: 6748 - DNA, 20 bp, synthetic construct
  misc_feature 1..20: note = CRISPR gRNA sequence
  source 1..20: mol_type = other DNA
ttctgtgactcagagaggtt

SEQ ID NO: 6749 - DNA, 20 bp, synthetic construct
  misc_feature 1..20: note = CRISPR gRNA sequence
  source 1..20: mol_type = other DNA
gaggttgagtaacatttgca

SEQ ID NO: 6750 - DNA, 20 bp, synthetic construct
  misc_feature 1..20: note = CRISPR gRNA sequence
  source 1..20: mol_type = other DNA
gtaacatttgcaaagtcaca

SEQ ID NO: 6751 - DNA, 20 bp, synthetic construct
  misc_feature 1..20: note = CRISPR gRNA sequence
  source 1..20: mol_type = other DNA
catttgcaaagtcacacagc

SEQ ID NO: 6752 - DNA, 20 bp, synthetic construct
  misc_feature 1..20: note = CRISPR gRNA sequence
  source 1..20: mol_type = other DNA
gcaaagtcacacagcaagtg

SEQ ID NO: 6753 - DNA, 20 bp, synthetic construct
  misc_feature 1..20: note = CRISPR gRNA sequence
  source 1..20: mol_type = other DNA
cacacagcaagtgtggaact

SEQ ID NO: 6754 - DNA, 20 bp, synthetic construct
  misc_feature 1..20: note = CRISPR gRNA sequence
  source 1..20: mol_type = other DNA
gtggaactaagatttgaacc

SEQ ID NO: 6755 - DNA, 20 bp, synthetic construct
  misc_feature 1..20: note = CRISPR gRNA sequence
  source 1..20: mol_type = other DNA
ggaactaagatttgaaccca

SEQ ID NO: 6756 - DNA, 20 bp, synthetic construct
  misc_feature 1..20: note = CRISPR gRNA sequence
  source 1..20: mol_type = other DNA
ctctctcctaaaatatcatc

SEQ ID NO: 6757 - DNA, 20 bp, synthetic construct
  misc_feature 1..20: note = CRISPR gRNA sequence
  source 1..20: mol_type = other DNA
tctctcctaaaatatcatct

SEQ ID NO: 6758 - DNA, 20 bp, synthetic construct
  misc_feature 1..20: note = CRISPR gRNA sequence
  source 1..20: mol_type = other DNA
atcatctgggtctacattgc

SEQ ID NO: 6759 - DNA, 20 bp, synthetic construct
  misc_feature 1..20: note = CRISPR gRNA sequence
  source 1..20: mol_type = other DNA
gtctacattgcaagcctctt

SEQ ID NO: 6760 - DNA, 20 bp, synthetic construct
  misc_feature 1..20: note = CRISPR gRNA sequence
  source 1..20: mol_type = other DNA
tacattgcaagcctctttgg

SEQ ID NO: 6761 - DNA, 20 bp, synthetic construct
  misc_feature 1..20: note = CRISPR gRNA sequence
  source 1..20: mol_type = other DNA
acattgcaagcctctttggc

SEQ ID NO: 6762 - DNA, 20 bp, synthetic construct
  misc_feature 1..20: note = CRISPR gRNA sequence
  source 1..20: mol_type = other DNA
cattgcaagcctctttggca

SEQ ID NO: 6763 - DNA, 20 bp, synthetic construct
  misc_feature 1..20: note = CRISPR gRNA sequence
  source 1..20: mol_type = other DNA
cctctttggcagggactgtg

SEQ ID NO: 6764 - DNA, 20 bp, synthetic construct
  misc_feature 1..20: note = CRISPR gRNA sequence
  source 1..20: mol_type = other DNA
gactgtgtggtaaacctctt

SEQ ID NO: 6765 - DNA, 20 bp, synthetic construct
  misc_feature 1..20: note = CRISPR gRNA sequence
  source 1..20: mol_type = other DNA
actgtgtggtaaacctcttt

SEQ ID NO: 6766 - DNA, 20 bp, synthetic construct
  misc_feature 1..20: note = CRISPR gRNA sequence
  source 1..20: mol_type = other DNA
ctgtgtggtaaacctctttg

SEQ ID NO: 6767 - DNA, 20 bp, synthetic construct
  misc_feature 1..20: note = CRISPR gRNA sequence
  source 1..20: mol_type = other DNA
gtggtaaacctctttggggc

SEQ ID NO: 6768 - DNA, 20 bp, synthetic construct
  misc_feature 1..20: note = CRISPR gRNA sequence
  source 1..20: mol_type = other DNA
taaacctctttggggccagt

SEQ ID NO: 6769 - DNA, 20 bp, synthetic construct
  misc_feature 1..20: note = CRISPR gRNA sequence
  source 1..20: mol_type = other DNA
aaacctctttggggccagta

SEQ ID NO: 6770 - DNA, 20 bp, synthetic construct
  misc_feature 1..20: note = CRISPR gRNA sequence
  source 1..20: mol_type = other DNA
tttggggccagtaaggaact

SEQ ID NO: 6771 - DNA, 20 bp, synthetic construct
  misc_feature 1..20: note = CRISPR gRNA sequence
  source 1..20: mol_type = other DNA
ggccagtaaggaactgagct

SEQ ID NO: 6772 - DNA, 20 bp, synthetic construct
  misc_feature 1..20: note = CRISPR gRNA sequence
  source 1..20: mol_type = other DNA
tgagctcagtgactttctta

SEQ ID NO: 6773 - DNA, 20 bp, synthetic construct
  misc_feature 1..20: note = CRISPR gRNA sequence
  source 1..20: mol_type = other DNA
gagctcagtgactttcttac

SEQ ID NO: 6774 - DNA, 20 bp, synthetic construct
  misc_feature 1..20: note = CRISPR gRNA sequence
  source 1..20: mol_type = other DNA
agctcagtgactttcttacg

SEQ ID NO: 6775 - DNA, 20 bp, synthetic construct
  misc_feature 1..20: note = CRISPR gRNA sequence
  source 1..20: mol_type = other DNA
tgactttcttacggggtgct

SEQ ID NO: 6776 - DNA, 20 bp, synthetic construct
  misc_feature 1..20: note = CRISPR gRNA sequence
  source 1..20: mol_type = other DNA
ctcagtgaatcattgtttta

SEQ ID NO: 6777 - DNA, 20 bp, synthetic construct
  misc_feature 1..20: note = CRISPR gRNA sequence
  source 1..20: mol_type = other DNA
gaatcattgttttacagctt

SEQ ID NO: 6778 - DNA, 20 bp, synthetic construct
  misc_feature 1..20: note = CRISPR gRNA sequence
  source 1..20: mol_type = other DNA
atcattgttttacagcttta

SEQ ID NO: 6779 - DNA, 20 bp, synthetic construct
  misc_feature 1..20: note = CRISPR gRNA sequence
  source 1..20: mol_type = other DNA
tcattgttttacagctttag

SEQ ID NO: 6780 - DNA, 20 bp, synthetic construct
  misc_feature 1..20: note = CRISPR gRNA sequence
  source 1..20: mol_type = other DNA
cattgttttacagctttaga

SEQ ID NO: 6781 - DNA, 20 bp, synthetic construct
  misc_feature 1..20: note = CRISPR gRNA sequence
  source 1..20: mol_type = other DNA
attgttttacagctttagag

SEQ ID NO: 6782 - DNA, 20 bp, synthetic construct
  misc_feature 1..20: note = CRISPR gRNA sequence
  source 1..20: mol_type = other DNA
tttacagctttagaggggaa

SEQ ID NO: 6783 - DNA, 20 bp, synthetic construct
  misc_feature 1..20: note = CRISPR gRNA sequence
  source 1..20: mol_type = other DNA
cagctttagaggggaaaagt

SEQ ID NO: 6784 - DNA, 20 bp, synthetic construct
  misc_feature 1..20: note = CRISPR gRNA sequence
  source 1..20: mol_type = other DNA
gctttagaggggaaaagtga

SEQ ID NO: 6785 - DNA, 20 bp, synthetic construct
  misc_feature 1..20: note = CRISPR gRNA sequence
  source 1..20: mol_type = other DNA
gaaaagtgagagatgtttct

SEQ ID NO: 6786 - DNA, 20 bp, synthetic construct
  misc_feature 1..20: note = CRISPR gRNA sequence
  source 1..20: mol_type = other DNA
aaagtgagagatgtttctta

SEQ ID NO: 6787 - DNA, 20 bp, synthetic construct
  misc_feature 1..20: note = CRISPR gRNA sequence
  source 1..20: mol_type = other DNA
gatgtttcttagagtttatc

SEQ ID NO: 6788 - DNA, 20 bp, synthetic construct
  misc_feature 1..20: note = CRISPR gRNA sequence
  source 1..20: mol_type = other DNA
tgtttcttagagtttatctg

SEQ ID NO: 6789 - DNA, 20 bp, synthetic construct
  misc_feature 1..20: note = CRISPR gRNA sequence
  source 1..20: mol_type = other DNA
gtttcttagagtttatctgg

SEQ ID NO: 6790 - DNA, 20 bp, synthetic construct
  misc_feature 1..20: note = CRISPR gRNA sequence
  source 1..20: mol_type = other DNA
agagtttatctggaggacta

SEQ ID NO: 6791 - DNA, 20 bp, synthetic construct
  misc_feature 1..20: note = CRISPR gRNA sequence
  source 1..20: mol_type = other DNA
gagtttatctggaggactac

SEQ ID NO: 6792 - DNA, 20 bp, synthetic construct
  misc_feature 1..20: note = CRISPR gRNA sequence
  source 1..20: mol_type = other DNA
agtttatctggaggactaca

SEQ ID NO: 6793 - DNA, 20 bp, synthetic construct
  misc_feature 1..20: note = CRISPR gRNA sequence
  source 1..20: mol_type = other DNA
tggaggactacagggtgcat

SEQ ID NO: 6794 - DNA, 20 bp, synthetic construct
  misc_feature 1..20: note = CRISPR gRNA sequence
  source 1..20: mol_type = other DNA
actacagggtgcatgagcaa

SEQ ID NO: 6795 - DNA, 20 bp, synthetic construct
  misc_feature 1..20: note = CRISPR gRNA sequence
  source 1..20: mol_type = other DNA
acagggtgcatgagcaaaag

SEQ ID NO: 6796 - DNA, 20 bp, synthetic construct
  misc_feature 1..20: note = CRISPR gRNA sequence
  source 1..20: mol_type = other DNA
agcaaaagcggaactcattt

SEQ ID NO: 6797 - DNA, 20 bp, synthetic construct
  misc_feature 1..20: note = CRISPR gRNA sequence
  source 1..20: mol_type = other DNA
tttgagctactacccccaca

SEQ ID NO: 6798 - DNA, 20 bp, synthetic construct
  misc_feature 1..20: note = CRISPR gRNA sequence
  source 1..20: mol_type = other DNA
gagctactacccccacaaag

SEQ ID NO: 6799 - DNA, 20 bp, synthetic construct
  misc_feature 1..20: note = CRISPR gRNA sequence
  source 1..20: mol_type = other DNA
acccccacaaagaagctgtt

SEQ ID NO: 6800 - DNA, 20 bp, synthetic construct
  misc_feature 1..20: note = CRISPR gRNA sequence
  source 1..20: mol_type = other DNA
cccccacaaagaagctgttt

SEQ ID NO: 6801 - DNA, 20 bp, synthetic construct
  misc_feature 1..20: note = CRISPR gRNA sequence
  source 1..20: mol_type = other DNA
ccccacaaagaagctgtttg

SEQ ID NO: 6802 - DNA, 20 bp, synthetic construct
  misc_feature 1..20: note = CRISPR gRNA sequence
  source 1..20: mol_type = other DNA
caaagaagctgtttggggtc

SEQ ID NO: 6803 - DNA, 20 bp, synthetic construct
  misc_feature 1..20: note = CRISPR gRNA sequence
  source 1..20: mol_type = other DNA
agctgtttggggtctggtca

SEQ ID NO: 6804 - DNA, 20 bp, synthetic construct
  misc_feature 1..20: note = CRISPR gRNA sequence
  source 1..20: mol_type = other DNA
tgtttggggtctggtcatgg

SEQ ID NO: 6805 - DNA, 20 bp, synthetic construct
  misc_feature 1..20: note = CRISPR gRNA sequence
  source 1..20: mol_type = other DNA
tggggtctggtcatggtaga

SEQ ID NO: 6806 - DNA, 20 bp, synthetic construct
  misc_feature 1..20: note = CRISPR gRNA sequence
  source 1..20: mol_type = other DNA
ggggtctggtcatggtagat

SEQ ID NO: 6807 - DNA, 20 bp, synthetic construct
  misc_feature 1..20: note = CRISPR gRNA sequence
  source 1..20: mol_type = other DNA
tcatggtagataggcattcc

SEQ ID NO: 6808 - DNA, 20 bp, synthetic construct
  misc_feature 1..20: note = CRISPR gRNA sequence
  source 1..20: mol_type = other DNA
catggtagataggcattcct

SEQ ID NO: 6809 - DNA, 20 bp, synthetic construct
  misc_feature 1..20: note = CRISPR gRNA sequence
  source 1..20: mol_type = other DNA
gataggcattcctaggcccc

SEQ ID NO: 6810 - DNA, 20 bp, synthetic construct
  misc_feature 1..20: note = CRISPR gRNA sequence
  source 1..20: mol_type = other DNA
cctggcttcccaacaccatt

SEQ ID NO: 6811 - DNA, 20 bp, synthetic construct
  misc_feature 1..20: note = CRISPR gRNA sequence
  source 1..20: mol_type = other DNA
tcccaacaccatttggcccc

SEQ ID NO: 6812 - DNA, 20 bp, synthetic construct
  misc_feature 1..20: note = CRISPR gRNA sequence
  source 1..20: mol_type = other DNA
caacaccatttggcccccgg

SEQ ID NO: 6813 - DNA, 20 bp, synthetic construct
  misc_feature 1..20: note = CRISPR gRNA sequence
  source 1..20: mol_type = other DNA
caccatttggcccccggaag

SEQ ID NO: 6814 - DNA, 20 bp, synthetic construct
  misc_feature 1..20: note = CRISPR gRNA sequence
  source 1..20: mol_type = other DNA
ccccggaagcagcttgtcat

SEQ ID NO: 6815 - DNA, 20 bp, synthetic construct
  misc_feature 1..20: note = CRISPR gRNA sequence
  source 1..20: mol_type = other DNA
cccggaagcagcttgtcatg

SEQ ID NO: 6816 - DNA, 20 bp, synthetic construct
  misc_feature 1..20: note = CRISPR gRNA sequence
  source 1..20: mol_type = other DNA
gaagcagcttgtcatgaggt

SEQ ID NO: 6817 - DNA, 20 bp, synthetic construct
  misc_feature 1..20: note = CRISPR gRNA sequence
  source 1..20: mol_type = other DNA
aagcagcttgtcatgaggtt

SEQ ID NO: 6818 - DNA, 20 bp, synthetic construct
  misc_feature 1..20: note = CRISPR gRNA sequence
  source 1..20: mol_type = other DNA
agcagcttgtcatgaggttg

SEQ ID NO: 6819 - DNA, 20 bp, synthetic construct
  misc_feature 1..20: note = CRISPR gRNA sequence
  source 1..20: mol_type = other DNA
cagcttgtcatgaggttggg

SEQ ID NO: 6820 - DNA, 20 bp, synthetic construct
  misc_feature 1..20: note = CRISPR gRNA sequence
  source 1..20: mol_type = other DNA
cttgtcatgaggttggggag

SEQ ID NO: 6821 - DNA, 20 bp, synthetic construct
  misc_feature 1..20: note = CRISPR gRNA sequence
  source 1..20: mol_type = other DNA
ttgtcatgaggttggggagc

SEQ ID NO: 6822 - DNA, 20 bp, synthetic construct
  misc_feature 1..20: note = CRISPR gRNA sequence
  source 1..20: mol_type = other DNA
catgaggttggggagcaggt

SEQ ID NO: 6823 - DNA, 20 bp, synthetic construct
  misc_feature 1..20: note = CRISPR gRNA sequence
  source 1..20: mol_type = other DNA
gttggggagcaggttggtgt

SEQ ID NO: 6824 - DNA, 20 bp, synthetic construct
  misc_feature 1..20: note = CRISPR gRNA sequence
  source 1..20: mol_type = other DNA
ttggggagcaggttggtgtt

SEQ ID NO: 6825 - DNA, 20 bp, synthetic construct
  misc_feature 1..20: note = CRISPR gRNA sequence
  source 1..20: mol_type = other DNA
tggggagcaggttggtgttg

SEQ ID NO: 6826 - DNA, 20 bp, synthetic construct
  misc_feature 1..20: note = CRISPR gRNA sequence
  source 1..20: mol_type = other DNA
ggggagcaggttggtgttgg

SEQ ID NO: 6827 - DNA, 20 bp, synthetic construct
  misc_feature 1..20: note = CRISPR gRNA sequence
  source 1..20: mol_type = other DNA
gggagcaggttggtgttggg

SEQ ID NO: 6828 - DNA, 20 bp, synthetic construct
  misc_feature 1..20: note = CRISPR gRNA sequence
  source 1..20: mol_type = other DNA
ggagcaggttggtgttgggg

SEQ ID NO: 6829 - DNA, 20 bp, synthetic construct
  misc_feature 1..20: note = CRISPR gRNA sequence
  source 1..20: mol_type = other DNA
gagcaggttggtgttggggg

SEQ ID NO: 6830 - DNA, 20 bp, synthetic construct
  misc_feature 1..20: note = CRISPR gRNA sequence
  source 1..20: mol_type = other DNA
gttggtgttggggggggcct

SEQ ID NO: 6831 - DNA, 20 bp, synthetic construct
  misc_feature 1..20: note = CRISPR gRNA sequence
  source 1..20: mol_type = other DNA
ttggtgttggggggggcctt

SEQ ID NO: 6832 - DNA, 20 bp, synthetic construct
  misc_feature 1..20: note = CRISPR gRNA sequence
  source 1..20: mol_type = other DNA
tggtgttggggggggccttg

SEQ ID NO: 6833 - DNA, 20 bp, synthetic construct
  misc_feature 1..20: note = CRISPR gRNA sequence
  source 1..20: mol_type = other DNA
ggtgttggggggggccttgg

SEQ ID NO: 6834 - DNA, 20 bp, synthetic construct
  misc_feature 1..20: note = CRISPR gRNA sequence
  source 1..20: mol_type = other DNA
ttggggggggccttggggga

SEQ ID NO: 6835 - DNA, 20 bp, synthetic construct
  misc_feature 1..20: note = CRISPR gRNA sequence
  source 1..20: mol_type = other DNA
tggggggggccttgggggaa

SEQ ID NO: 6836 - DNA, 20 bp, synthetic construct
  misc_feature 1..20: note = CRISPR gRNA sequence
  source 1..20: mol_type = other DNA
ggggccttgggggaaaggaa

SEQ ID NO: 6837 - DNA, 20 bp, synthetic construct
  misc_feature 1..20: note = CRISPR gRNA sequence
  source 1..20: mol_type = other DNA
gggccttgggggaaaggaaa

SEQ ID NO: 6838 - DNA, 20 bp, synthetic construct
  misc_feature 1..20: note = CRISPR gRNA sequence
  source 1..20: mol_type = other DNA
gccttgggggaaaggaaaag

SEQ ID NO: 6839 - DNA, 20 bp, synthetic construct
  misc_feature 1..20: note = CRISPR gRNA sequence
  source 1..20: mol_type = other DNA
ttgggggaaaggaaaaggag

SEQ ID NO: 6840 - DNA, 20 bp, synthetic construct
  misc_feature 1..20: note = CRISPR gRNA sequence
  source 1..20: mol_type = other DNA
aaggaaaaggagaagactgc

SEQ ID NO: 6841 - DNA, 20 bp, synthetic construct
  misc_feature 1..20: note = CRISPR gRNA sequence
  source 1..20: mol_type = other DNA
aggaaaaggagaagactgcc

SEQ ID NO: 6842 - DNA, 20 bp, synthetic construct
  misc_feature 1..20: note = CRISPR gRNA sequence
  source 1..20: mol_type = other DNA
ggagaagactgccaggcaac

SEQ ID NO: 6843 - DNA, 20 bp, synthetic construct
  misc_feature 1..20: note = CRISPR gRNA sequence
  source 1..20: mol_type = other DNA
gagaagactgccaggcaacg

SEQ ID NO: 6844 - DNA, 20 bp, synthetic construct
  misc_feature 1..20: note = CRISPR gRNA sequence
  source 1..20: mol_type = other DNA
actgccaggcaacgaggaat

SEQ ID NO: 6845 - DNA, 20 bp, synthetic construct
  misc_feature 1..20: note = CRISPR gRNA sequence
  source 1..20: mol_type = other DNA
cgaggaatcagaatctcaaa

SEQ ID NO: 6846 - DNA, 20 bp, synthetic construct
  misc_feature 1..20: note = CRISPR gRNA sequence
  source 1..20: mol_type = other DNA
atctcaaaaagactcaattg

SEQ ID NO: 6847 - DNA, 20 bp, synthetic construct
  misc_feature 1..20: note = CRISPR gRNA sequence
  source 1..20: mol_type = other DNA
tctcaaaaagactcaattga

SEQ ID NO: 6848 - DNA, 20 bp, synthetic construct
  misc_feature 1..20: note = CRISPR gRNA sequence
  source 1..20: mol_type = other DNA
ctcaaaaagactcaattgaa

SEQ ID NO: 6849 - DNA, 20 bp, synthetic construct
  misc_feature 1..20: note = CRISPR gRNA sequence
  source 1..20: mol_type = other DNA
tcaaaaagactcaattgaag

SEQ ID NO: 6850 - DNA, 20 bp, synthetic construct
  misc_feature 1..20: note = CRISPR gRNA sequence
  source 1..20: mol_type = other DNA
ggctccaacactcgttgaaa

SEQ ID NO: 6851 - DNA, 20 bp, synthetic construct
  misc_feature 1..20: note = CRISPR gRNA sequence
  source 1..20: mol_type = other DNA
ctccaacactcgttgaaacg

SEQ ID NO: 6852 - DNA, 20 bp, synthetic construct
  misc_feature 1..20: note = CRISPR gRNA sequence
  source 1..20: mol_type = other DNA
tccaacactcgttgaaacgg

SEQ ID NO: 6853 - DNA, 20 bp, synthetic construct
  misc_feature 1..20: note = CRISPR gRNA sequence
  source 1..20: mol_type = other DNA
cactcgttgaaacggaggct

SEQ ID NO: 6854 - DNA, 20 bp, synthetic construct
  misc_feature 1..20: note = CRISPR gRNA sequence
  source 1..20: mol_type = other DNA
ctcgttgaaacggaggctca

SEQ ID NO: 6855 - DNA, 20 bp, synthetic construct
  misc_feature 1..20: note = CRISPR gRNA sequence
  source 1..20: mol_type = other DNA
tcgttgaaacggaggctcag

SEQ ID NO: 6856 - DNA, 20 bp, synthetic construct
  misc_feature 1..20: note = CRISPR gRNA sequence
  source 1..20: mol_type = other DNA
cgttgaaacggaggctcaga

SEQ ID NO: 6857 - DNA, 20 bp, synthetic construct
  misc_feature 1..20: note = CRISPR gRNA sequence
  source 1..20: mol_type = other DNA
aaacggaggctcagagggct

SEQ ID NO: 6858 - DNA, 20 bp, synthetic construct
  misc_feature 1..20: note = CRISPR gRNA sequence
  source 1..20: mol_type = other DNA
aacggaggctcagagggcta

SEQ ID NO: 6859 - DNA, 20 bp, synthetic construct
  misc_feature 1..20: note = CRISPR gRNA sequence
  source 1..20: mol_type = other DNA
gagggctaaggtaatgtact

SEQ ID NO: 6860 - DNA, 20 bp, synthetic construct
  misc_feature 1..20: note = CRISPR gRNA sequence
  source 1..20: mol_type = other DNA
agggctaaggtaatgtactc

SEQ ID NO: 6861 - DNA, 20 bp, synthetic construct
  misc_feature 1..20: note = CRISPR gRNA sequence
  source 1..20: mol_type = other DNA
aggtaatgtactcaggatca

SEQ ID NO: 6862 - DNA, 20 bp, synthetic construct
  misc_feature 1..20: note = CRISPR gRNA sequence
  source 1..20: mol_type = other DNA
ggtaatgtactcaggatcaa

SEQ ID NO: 6863 - DNA, 20 bp, synthetic construct
  misc_feature 1..20: note = CRISPR gRNA sequence
  source 1..20: mol_type = other DNA
aatgtactcaggatcaaagg

SEQ ID NO: 6864 - DNA, 20 bp, synthetic construct
  misc_feature 1..20: note = CRISPR gRNA sequence
  source 1..20: mol_type = other DNA
tgtactcaggatcaaaggca

SEQ ID NO: 6865 - DNA, 20 bp, synthetic construct
  misc_feature 1..20: note = CRISPR gRNA sequence
  source 1..20: mol_type = other DNA
actcaggatcaaaggcagag

SEQ ID NO: 6866 - DNA, 20 bp, synthetic construct
  misc_feature 1..20: note = CRISPR gRNA sequence
  source 1..20: mol_type = other DNA
agaaactcaaaccatgtctc

SEQ ID NO: 6867 - DNA, 20 bp, synthetic construct
  misc_feature 1..20: note = CRISPR gRNA sequence
  source 1..20: mol_type = other DNA
gaaactcaaaccatgtctct

SEQ ID NO: 6868 - DNA, 20 bp, synthetic construct
  misc_feature 1..20: note = CRISPR gRNA sequence
  source 1..20: mol_type = other DNA
aaaccatgtctctaggcaca

SEQ ID NO: 6869 - DNA, 20 bp, synthetic construct
  misc_feature 1..20: note = CRISPR gRNA sequence
  source 1..20: mol_type = other DNA
atgtctctaggcacacagtt

SEQ ID NO: 6870 - DNA, 20 bp, synthetic construct
  misc_feature 1..20: note = CRISPR gRNA sequence
  source 1..20: mol_type = other DNA
gtctctaggcacacagttca

SEQ ID NO: 6871 - DNA, 20 bp, synthetic construct
  misc_feature 1..20: note = CRISPR gRNA sequence
  source 1..20: mol_type = other DNA
tctctaggcacacagttcag

SEQ ID NO: 6872 - DNA, 20 bp, synthetic construct
  misc_feature 1..20: note = CRISPR gRNA sequence
  source 1..20: mol_type = other DNA
gaggtcttcccattattcct

SEQ ID NO: 6873 - DNA, 20 bp, synthetic construct
  misc_feature 1..20: note = CRISPR gRNA sequence
  source 1..20: mol_type = other DNA
aggtcttcccattattcctc

SEQ ID NO: 6874 - DNA, 20 bp, synthetic construct
  misc_feature 1..20: note = CRISPR gRNA sequence
  source 1..20: mol_type = other DNA
gtcttcccattattcctcag

SEQ ID NO: 6875 - DNA, 20 bp, synthetic construct
  misc_feature 1..20: note = CRISPR gRNA sequence
  source 1..20: mol_type = other DNA
tcttcccattattcctcagg

SEQ ID NO: 6876 - DNA, 20 bp, synthetic construct
  misc_feature 1..20: note = CRISPR gRNA sequence
  source 1..20: mol_type = other DNA
ttcccattattcctcaggag

SEQ ID NO: 6877 - DNA, 20 bp, synthetic construct
  misc_feature 1..20: note = CRISPR gRNA sequence
  source 1..20: mol_type = other DNA
ccattattcctcaggaggag

SEQ ID NO: 6878 - DNA, 20 bp, synthetic construct
  misc_feature 1..20: note = CRISPR gRNA sequence
  source 1..20: mol_type = other DNA
tcctcaggaggagaagttca

SEQ ID NO: 6879 - DNA, 20 bp, synthetic construct
  misc_feature 1..20: note = CRISPR gRNA sequence
  source 1..20: mol_type = other DNA
aggaggagaagttcatggtc

SEQ ID NO: 6880 - DNA, 20 bp, synthetic construct
  misc_feature 1..20: note = CRISPR gRNA sequence
  source 1..20: mol_type = other DNA
gaggagaagttcatggtcaa

SEQ ID NO: 6881 - DNA, 20 bp, synthetic construct
  misc_feature 1..20: note = CRISPR gRNA sequence
  source 1..20: mol_type = other DNA
gagaagttcatggtcaagag

SEQ ID NO: 6882 - DNA, 20 bp, synthetic construct
  misc_feature 1..20: note = CRISPR gRNA sequence
  source 1..20: mol_type = other DNA
agaagttcatggtcaagagt

SEQ ID NO: 6883 - DNA, 20 bp, synthetic construct
  misc_feature 1..20: note = CRISPR gRNA sequence
  source 1..20: mol_type = other DNA
gaagttcatggtcaagagta

SEQ ID NO: 6884 - DNA, 20 bp, synthetic construct
  misc_feature 1..20: note = CRISPR gRNA sequence
  source 1..20: mol_type = other DNA
gttcatggtcaagagtaggg

SEQ ID NO: 6885 - DNA, 20 bp, synthetic construct
  misc_feature 1..20: note = CRISPR gRNA sequence
  source 1..20: mol_type = other DNA
gtagggaagtattccttctc

SEQ ID NO: 6886 - DNA, 20 bp, synthetic construct
  misc_feature 1..20: note = CRISPR gRNA sequence
  source 1..20: mol_type = other DNA
agctttttttttttttgtct

SEQ ID NO: 6887 - DNA, 20 bp, synthetic construct
  misc_feature 1..20: note = CRISPR gRNA sequence
  source 1..20: mol_type = other DNA
ttttttttttttgtctgaga

SEQ ID NO: 6888 - DNA, 20 bp, synthetic construct
  misc_feature 1..20: note = CRISPR gRNA sequence
  source 1..20: mol_type = other DNA
ttttttttttgtctgagaca

SEQ ID NO: 6889 - DNA, 20 bp, synthetic construct
  misc_feature 1..20: note = CRISPR gRNA sequence
  source 1..20: mol_type = other DNA
cagagtcttgctctgtcacc

SEQ ID NO: 6890 - DNA, 20 bp, synthetic construct
  misc_feature 1..20: note = CRISPR gRNA sequence
  source 1..20: mol_type = other DNA
agagtcttgctctgtcaccg

SEQ ID NO: 6891 - DNA, 20 bp, synthetic construct
  misc_feature 1..20: note = CRISPR gRNA sequence
  source 1..20: mol_type = other DNA
tcttgctctgtcaccgaggc

SEQ ID NO: 6892 - DNA, 20 bp, synthetic construct
  misc_feature 1..20: note = CRISPR gRNA sequence
  source 1..20: mol_type = other DNA
ttgctctgtcaccgaggctg

SEQ ID NO: 6893 - DNA, 20 bp, synthetic construct
  misc_feature 1..20: note = CRISPR gRNA sequence
  source 1..20: mol_type = other DNA
ctgtcaccgaggctggagtg

SEQ ID NO: 6894 - DNA, 20 bp, synthetic construct
  misc_feature 1..20: note = CRISPR gRNA sequence
  source 1..20: mol_type = other DNA
tcaccgaggctggagtgcag

SEQ ID NO: 6895 - DNA, 20 bp, synthetic construct
  misc_feature 1..20: note = CRISPR gRNA sequence
  source 1..20: mol_type = other DNA
ggagtgcagtggcgtgatct

SEQ ID NO: 6896 - DNA, 20 bp, synthetic construct
  misc_feature 1..20: note = CRISPR gRNA sequence
  source 1..20: mol_type = other DNA
tcactgcaacctccgcctcc

SEQ ID NO: 6897 - DNA, 20 bp, synthetic construct
  misc_feature 1..20: note = CRISPR gRNA sequence
  source 1..20: mol_type = other DNA
cactgcaacctccgcctccc

SEQ ID NO: 6898 - DNA, 20 bp, synthetic construct
  misc_feature 1..20: note = CRISPR gRNA sequence
  source 1..20: mol_type = other DNA
aacctccgcctcccaggttc

SEQ ID NO: 6899 - DNA, 20 bp, synthetic construct
  misc_feature 1..20: note = CRISPR gRNA sequence
  source 1..20: mol_type = other DNA
ttcaagcaattttcctgcct

SEQ ID NO: 6900 - DNA, 20 bp, synthetic construct
  misc_feature 1..20: note = CRISPR gRNA sequence
  source 1..20: mol_type = other DNA
ttttcctgcctcagcctccc

SEQ ID NO: 6901 - DNA, 20 bp, synthetic construct
  misc_feature 1..20: note = CRISPR gRNA sequence
  source 1..20: mol_type = other DNA
tcctgcctcagcctcccaag

SEQ ID NO: 6902 - DNA, 20 bp, synthetic construct
  misc_feature 1..20: note = CRISPR gRNA sequence
  source 1..20: mol_type = other DNA
gcctcagcctcccaagtagc

SEQ ID NO: 6903 - DNA, 20 bp, synthetic construct
  misc_feature 1..20: note = CRISPR gRNA sequence
  source 1..20: mol_type = other DNA
cctcagcctcccaagtagct

SEQ ID NO: 6904 - DNA, 20 bp, synthetic construct
  misc_feature 1..20: note = CRISPR gRNA sequence
  source 1..20: mol_type = other DNA
ctcccaagtagctgggatta

SEQ ID NO: 6905 - DNA, 20 bp, synthetic construct
  misc_feature 1..20: note = CRISPR gRNA sequence
  source 1..20: mol_type = other DNA
tcccaagtagctgggattat

SEQ ID NO: 6906 - DNA, 20 bp, synthetic construct
  misc_feature 1..20: note = CRISPR gRNA sequence
  source 1..20: mol_type = other DNA
taggcacccaccaccacgcc

SEQ ID NO: 6907 - DNA, 20 bp, synthetic construct
  misc_feature 1..20: note = CRISPR gRNA sequence
  source 1..20: mol_type = other DNA
agctcatttttgtatttttg

SEQ ID NO: 6908 - DNA, 20 bp, synthetic construct
  misc_feature 1..20: note = CRISPR gRNA sequence
  source 1..20: mol_type = other DNA
ctcatttttgtatttttgca

SEQ ID NO: 6909 - DNA, 20 bp, synthetic construct
  misc_feature 1..20: note = CRISPR gRNA sequence
  source 1..20: mol_type = other DNA
tttttgtatttttgcagaga

SEQ ID NO: 6910 - DNA, 20 bp, synthetic construct
  misc_feature 1..20: note = CRISPR gRNA sequence
  source 1..20: mol_type = other DNA
ttttgtatttttgcagagac

SEQ ID NO: 6911 - DNA, 20 bp, synthetic construct
  misc_feature 1..20: note = CRISPR gRNA sequence
  source 1..20: mol_type = other DNA
tttgtatttttgcagagacg

SEQ ID NO: 6912 - DNA, 20 bp, synthetic construct
  misc_feature 1..20: note = CRISPR gRNA sequence
  source 1..20: mol_type = other DNA
gagacggggtttcaccatgc

SEQ ID NO: 6913 - DNA, 20 bp, synthetic construct
  misc_feature 1..20: note = CRISPR gRNA sequence
  source 1..20: mol_type = other DNA
cggggtttcaccatgctggt

SEQ ID NO: 6914 - DNA, 20 bp, synthetic construct
  misc_feature 1..20: note = CRISPR gRNA sequence
  source 1..20: mol_type = other DNA
ggggtttcaccatgctggtc

SEQ ID NO: 6915 - DNA, 20 bp, synthetic construct
  misc_feature 1..20: note = CRISPR gRNA sequence
  source 1..20: mol_type = other DNA
tttcaccatgctggtcaggc

SEQ ID NO: 6916 - DNA, 20 bp, synthetic construct
  misc_feature 1..20: note = CRISPR gRNA sequence
  source 1..20: mol_type = other DNA
ggtcttgaactcctgacctc

SEQ ID NO: 6917 - DNA, 20 bp, synthetic construct
  misc_feature 1..20: note = CRISPR gRNA sequence
  source 1..20: mol_type = other DNA
cctgacctcaagtaatccgc

SEQ ID NO: 6918 - DNA, 20 bp, synthetic construct
  misc_feature 1..20: note = CRISPR gRNA sequence
  source 1..20: mol_type = other DNA
ctcaagtaatccgccagcct

SEQ ID NO: 6919 - DNA, 20 bp, synthetic construct
  misc_feature 1..20: note = CRISPR gRNA sequence
  source 1..20: mol_type = other DNA
ccgccagcctcggcctctca

SEQ ID NO: 6920 - DNA, 20 bp, synthetic construct
  misc_feature 1..20: note = CRISPR gRNA sequence
  source 1..20: mol_type = other DNA
gcctcggcctctcaaagtgc

SEQ ID NO: 6921 - DNA, 20 bp, synthetic construct
  misc_feature 1..20: note = CRISPR gRNA sequence
  source 1..20: mol_type = other DNA
cctcggcctctcaaagtgct

SEQ ID NO: 6922 - DNA, 20 bp, synthetic construct
  misc_feature 1..20: note = CRISPR gRNA sequence
  source 1..20: mol_type = other DNA
ctctcaaagtgctaggatta

SEQ ID NO: 6923 - DNA, 20 bp, synthetic construct
  misc_feature 1..20: note = CRISPR gRNA sequence
  source 1..20: mol_type = other DNA
tctcaaagtgctaggattat

SEQ ID NO: 6924 - DNA, 20 bp, synthetic construct
  misc_feature 1..20: note = CRISPR gRNA sequence
  source 1..20: mol_type = other DNA
agtgctaggattataggcgt

SEQ ID NO: 6925 - DNA, 20 bp, synthetic construct
  misc_feature 1..20: note = CRISPR gRNA sequence
  source 1..20: mol_type = other DNA
taggcgtgagccaccacccc

SEQ ID NO: 6926 - DNA, 20 bp, synthetic construct
  misc_feature 1..20: note = CRISPR gRNA sequence
  source 1..20: mol_type = other DNA
cttctcatgctctttaatca

SEQ ID NO: 6927 - DNA, 20 bp, synthetic construct
  misc_feature 1..20: note = CRISPR gRNA sequence
  source 1..20: mol_type = other DNA
catgctctttaatcacagtt

SEQ ID NO: 6928 - DNA, 20 bp, synthetic construct
  misc_feature 1..20: note = CRISPR gRNA sequence
  source 1..20: mol_type = other DNA
tgctctttaatcacagttca

SEQ ID NO: 6929 - DNA, 20 bp, synthetic construct
  misc_feature 1..20: note = CRISPR gRNA sequence
  source 1..20: mol_type = other DNA
tctttaatcacagttcagag

SEQ ID NO: 6930 - DNA, 20 bp, synthetic construct
  misc_feature 1..20: note = CRISPR gRNA sequence
  source 1..20: mol_type = other DNA
atcacagttcagagcagtgc

SEQ ID NO: 6931 - DNA, 20 bp, synthetic construct
  misc_feature 1..20: note = CRISPR gRNA sequence
  source 1..20: mol_type = other DNA
cacagttcagagcagtgctg

SEQ ID NO: 6932 - DNA, 20 bp, synthetic construct
  misc_feature 1..20: note = CRISPR gRNA sequence
  source 1..20: mol_type = other DNA
acagttcagagcagtgctgg

SEQ ID NO: 6933 - DNA, 20 bp, synthetic construct
  misc_feature 1..20: note = CRISPR gRNA sequence
  source 1..20: mol_type = other DNA
agagcagtgctggaggcttt

SEQ ID NO: 6934 - DNA, 20 bp, synthetic construct
  misc_feature 1..20: note = CRISPR gRNA sequence
  source 1..20: mol_type = other DNA
gagcagtgctggaggctttt

SEQ ID NO: 6935 - DNA, 20 bp, synthetic construct
  misc_feature 1..20: note = CRISPR gRNA sequence
  source 1..20: mol_type = other DNA
agcagtgctggaggctttta

SEQ ID NO: 6936 - DNA, 20 bp, synthetic construct
  misc_feature 1..20: note = CRISPR gRNA sequence
  source 1..20: mol_type = other DNA
gcagtgctggaggcttttag

SEQ ID NO: 6937 - DNA, 20 bp, synthetic construct
  misc_feature 1..20: note = CRISPR gRNA sequence
  source 1..20: mol_type = other DNA
gtgctggaggcttttagggg

SEQ ID NO: 6938 - DNA, 20 bp, synthetic construct
  misc_feature 1..20: note = CRISPR gRNA sequence
  source 1..20: mol_type = other DNA
gaggcttttaggggtagcaa

SEQ ID NO: 6939 - DNA, 20 bp, synthetic construct
  misc_feature 1..20: note = CRISPR gRNA sequence
  source 1..20: mol_type = other DNA
ggcttttaggggtagcaaaa

SEQ ID NO: 6940 - DNA, 20 bp, synthetic construct
  misc_feature 1..20: note = CRISPR gRNA sequence
  source 1..20: mol_type = other DNA
aagagccttcttctcccttt

SEQ ID NO: 6941 - DNA, 20 bp, synthetic construct
  misc_feature 1..20: note = CRISPR gRNA sequence
  source 1..20: mol_type = other DNA
tctccctttcagtgcctcct

SEQ ID NO: 6942 - DNA, 20 bp, synthetic construct
  misc_feature 1..20: note = CRISPR gRNA sequence
  source 1..20: mol_type = other DNA
agtgcctccttagaccctca

SEQ ID NO: 6943 - DNA, 20 bp, synthetic construct
  misc_feature 1..20: note = CRISPR gRNA sequence
  source 1..20: mol_type = other DNA
cctccttagaccctcaaaga

SEQ ID NO: 6944 - DNA, 20 bp, synthetic construct
  misc_feature 1..20: note = CRISPR gRNA sequence
  source 1..20: mol_type = other DNA
aaagatagactccccgcctc

SEQ ID NO: 6945 - DNA, 20 bp, synthetic construct
  misc_feature 1..20: note = CRISPR gRNA sequence
  source 1..20: mol_type = other DNA
aagatagactccccgcctct

SEQ ID NO: 6946 - DNA, 20 bp, synthetic construct
  misc_feature 1..20: note = CRISPR gRNA sequence
  source 1..20: mol_type = other DNA
atagactccccgcctctggg

SEQ ID NO: 6947 - DNA, 20 bp, synthetic construct
  misc_feature 1..20: note = CRISPR gRNA sequence
  source 1..20: mol_type = other DNA
gaagaaaacatctaatgaac

SEQ ID NO: 6948 - DNA, 20 bp, synthetic construct
  misc_feature 1..20: note = CRISPR gRNA sequence
  source 1..20: mol_type = other DNA
taatgaactggacgtaatct

SEQ ID NO: 6949 - DNA, 20 bp, synthetic construct
  misc_feature 1..20: note = CRISPR gRNA sequence
  source 1..20: mol_type = other DNA
cagcgcctgcgtctgtaaaa

SEQ ID NO: 6950 - DNA, 20 bp, synthetic construct
  misc_feature 1..20: note = CRISPR gRNA sequence
  source 1..20: mol_type = other DNA
ctataataacaacaatctcc

SEQ ID NO: 6951 - DNA, 20 bp, synthetic construct
  misc_feature 1..20: note = CRISPR gRNA sequence
  source 1..20: mol_type = other DNA
ataataacaacaatctccca

SEQ ID NO: 6952 - DNA, 20 bp, synthetic construct
  misc_feature 1..20: note = CRISPR gRNA sequence
  source 1..20: mol_type = other DNA
tctcccagagttgccgttaa

SEQ ID NO: 6953 - DNA, 20 bp, synthetic construct
  misc_feature 1..20: note = CRISPR gRNA sequence
  source 1..20: mol_type = other DNA
gttgccgttaacagttgaaa

SEQ ID NO: 6954 - DNA, 20 bp, synthetic construct
  misc_feature 1..20: note = CRISPR gRNA sequence
  source 1..20: mol_type = other DNA
cgttaacagttgaaacagaa

SEQ ID NO: 6955 - DNA, 20 bp, synthetic construct
  misc_feature 1..20: note = CRISPR gRNA sequence
  source 1..20: mol_type = other DNA
tgaaacagaatagtaaatgc

SEQ ID NO: 6956 - DNA, 20 bp, synthetic construct
  misc_feature 1..20: note = CRISPR gRNA sequence
  source 1..20: mol_type = other DNA
gaaacagaatagtaaatgca

SEQ ID NO: 6957 - DNA, 20 bp, synthetic construct
  misc_feature 1..20: note = CRISPR gRNA sequence
  source 1..20: mol_type = other DNA
aatagtaaatgcaaggcatc

SEQ ID NO: 6958 - DNA, 20 bp, synthetic construct
  misc_feature 1..20: note = CRISPR gRNA sequence
  source 1..20: mol_type = other DNA
taaatgcaaggcatctagca

SEQ ID NO: 6959 - DNA, 20 bp, synthetic construct
  misc_feature 1..20: note = CRISPR gRNA sequence
  source 1..20: mol_type = other DNA
caaggcatctagcacagccc

SEQ ID NO: 6960 - DNA, 20 bp, synthetic construct
  misc_feature 1..20: note = CRISPR gRNA sequence
  source 1..20: mol_type = other DNA
atctagcacagccccagaca

SEQ ID NO: 6961 - DNA, 20 bp, synthetic construct
  misc_feature 1..20: note = CRISPR gRNA sequence
  source 1..20: mol_type = other DNA
ctagcacagccccagacaca

SEQ ID NO: 6962 - DNA, 20 bp, synthetic construct
  misc_feature 1..20: note = CRISPR gRNA sequence
  source 1..20: mol_type = other DNA
agacacagagaaatctcccc

SEQ ID NO: 6963 - DNA, 20 bp, synthetic construct
  misc_feature 1..20: note = CRISPR gRNA sequence
  source 1..20: mol_type = other DNA
atctcccctggtcactctca

SEQ ID NO: 6964 - DNA, 20 bp, synthetic construct
  misc_feature 1..20: note = CRISPR gRNA sequence
  source 1..20: mol_type = other DNA
ctcccctggtcactctcaca

SEQ ID NO: 6965 - DNA, 20 bp, synthetic construct
  misc_feature 1..20: note = CRISPR gRNA sequence
  source 1..20: mol_type = other DNA
tcccctggtcactctcacag

SEQ ID NO: 6966 - DNA, 20 bp, synthetic construct
  misc_feature 1..20: note = CRISPR gRNA sequence
  source 1..20: mol_type = other DNA
ctggtcactctcacagaggt

SEQ ID NO: 6967 - DNA, 20 bp, synthetic construct
  misc_feature 1..20: note = CRISPR gRNA sequence
  source 1..20: mol_type = other DNA
gtcactctcacagaggtaag

SEQ ID NO: 6968 - DNA, 20 bp, synthetic construct
  misc_feature 1..20: note = CRISPR gRNA sequence
  source 1..20: mol_type = other DNA
aagcacattaataataaaaa

SEQ ID NO: 6969 - DNA, 20 bp, synthetic construct
  misc_feature 1..20: note = CRISPR gRNA sequence
  source 1..20: mol_type = other DNA
cgcatattgtactcaccatg

SEQ ID NO: 6970 - DNA, 20 bp, synthetic construct
  misc_feature 1..20: note = CRISPR gRNA sequence
  source 1..20: mol_type = other DNA
atattgtactcaccatgcag

SEQ ID NO: 6971 - DNA, 20 bp, synthetic construct
  misc_feature 1..20: note = CRISPR gRNA sequence
  source 1..20: mol_type = other DNA
tgcagaagttgtgctgcctt

SEQ ID NO: 6972 - DNA, 20 bp, synthetic construct
  misc_feature 1..20: note = CRISPR gRNA sequence
  source 1..20: mol_type = other DNA
gccttaagctactgttcatt

SEQ ID NO: 6973 - DNA, 20 bp, synthetic construct
  misc_feature 1..20: note = CRISPR gRNA sequence
  source 1..20: mol_type = other DNA
actgttcattgagcacttac

SEQ ID NO: 6974 - DNA, 20 bp, synthetic construct
  misc_feature 1..20: note = CRISPR gRNA sequence
  source 1..20: mol_type = other DNA
attgagcacttactggtcgc

SEQ ID NO: 6975 - DNA, 20 bp, synthetic construct
  misc_feature 1..20: note = CRISPR gRNA sequence
  source 1..20: mol_type = other DNA
tggtcgccagtcccctttct

SEQ ID NO: 6976 - DNA, 20 bp, synthetic construct
  misc_feature 1..20: note = CRISPR gRNA sequence
  source 1..20: mol_type = other DNA
ggtcgccagtcccctttcta

SEQ ID NO: 6977 - DNA, 20 bp, synthetic construct
  misc_feature 1..20: note = CRISPR gRNA sequence
  source 1..20: mol_type = other DNA
gtcgccagtcccctttctaa

SEQ ID NO: 6978 - DNA, 20 bp, synthetic construct
  misc_feature 1..20: note = CRISPR gRNA sequence
  source 1..20: mol_type = other DNA
cttaactcccctaatcctat

SEQ ID NO: 6979 - DNA, 20 bp, synthetic construct
  misc_feature 1..20: note = CRISPR gRNA sequence
  source 1..20: mol_type = other DNA
aattattatcccccacttta

SEQ ID NO: 6980 - DNA, 20 bp, synthetic construct
  misc_feature 1..20: note = CRISPR gRNA sequence
  source 1..20: mol_type = other DNA
ttatcccccactttacagat

SEQ ID NO: 6981 - DNA, 20 bp, synthetic construct
  misc_feature 1..20: note = CRISPR gRNA sequence
  source 1..20: mol_type = other DNA
tatcccccactttacagata

SEQ ID NO: 6982 - DNA, 20 bp, synthetic construct
  misc_feature 1..20: note = CRISPR gRNA sequence
  source 1..20: mol_type = other DNA
actttacagataaggaaact

SEQ ID NO: 6983 - DNA, 20 bp, synthetic construct
  misc_feature 1..20: note = CRISPR gRNA sequence
  source 1..20: mol_type = other DNA
ctttacagataaggaaactg

SEQ ID NO: 6984 - DNA, 20 bp, synthetic construct
  misc_feature 1..20: note = CRISPR gRNA sequence
  source 1..20: mol_type = other DNA
gataaggaaactgaggctcc

SEQ ID NO: 6985 - DNA, 20 bp, synthetic construct
  misc_feature 1..20: note = CRISPR gRNA sequence
  source 1..20: mol_type = other DNA
aaggaaactgaggctccaag

SEQ ID NO: 6986 - DNA, 20 bp, synthetic construct
  misc_feature 1..20: note = CRISPR gRNA sequence
  source 1..20: mol_type = other DNA
gtttaaaaaatgaacttacc

SEQ ID NO: 6987 - DNA, 20 bp, synthetic construct
  misc_feature 1..20: note = CRISPR gRNA sequence
  source 1..20: mol_type = other DNA
aaatgaacttacccagattg

SEQ ID NO: 6988 - DNA, 20 bp, synthetic construct
  misc_feature 1..20: note = CRISPR gRNA sequence
  source 1..20: mol_type = other DNA
ttacccagattgtagtgcgt

SEQ ID NO: 6989 - DNA, 20 bp, synthetic construct
  misc_feature 1..20: note = CRISPR gRNA sequence
  source 1..20: mol_type = other DNA
cccagattgtagtgcgttgg

SEQ ID NO: 6990 - DNA, 20 bp, synthetic construct
  misc_feature 1..20: note = CRISPR gRNA sequence
  source 1..20: mol_type = other DNA
ccagattgtagtgcgttggt

SEQ ID NO: 6991 - DNA, 20 bp, synthetic construct
  misc_feature 1..20: note = CRISPR gRNA sequence
  source 1..20: mol_type = other DNA
gattgtagtgcgttggtagg

SEQ ID NO: 6992 - DNA, 20 bp, synthetic construct
  misc_feature 1..20: note = CRISPR gRNA sequence
  source 1..20: mol_type = other DNA
attgtagtgcgttggtaggt

SEQ ID NO: 6993 - DNA, 20 bp, synthetic construct
  misc_feature 1..20: note = CRISPR gRNA sequence
  source 1..20: mol_type = other DNA
ttgtagtgcgttggtaggta

SEQ ID NO: 6994 - DNA, 20 bp, synthetic construct
  misc_feature 1..20: note = CRISPR gRNA sequence
  source 1..20: mol_type = other DNA
ggtaggtagggataacctga

SEQ ID NO: 6995 - DNA, 20 bp, synthetic construct
  misc_feature 1..20: note = CRISPR gRNA sequence
  source 1..20: mol_type = other DNA
ggtagggataacctgaaagt

SEQ ID NO: 6996 - DNA, 20 bp, synthetic construct
  misc_feature 1..20: note = CRISPR gRNA sequence
  source 1..20: mol_type = other DNA
gtagggataacctgaaagtt

SEQ ID NO: 6997 - DNA, 20 bp, synthetic construct
  misc_feature 1..20: note = CRISPR gRNA sequence
  source 1..20: mol_type = other DNA
agttgggaaatttcacccca

SEQ ID NO: 6998 - DNA, 20 bp, synthetic construct
  misc_feature 1..20: note = CRISPR gRNA sequence
  source 1..20: mol_type = other DNA
caccccaaagctcaccatct

SEQ ID NO: 6999 - DNA, 20 bp, synthetic construct
  misc_feature 1..20: note = CRISPR gRNA sequence
  source 1..20: mol_type = other DNA
gagctccattcatctcccac

SEQ ID NO: 7000 - DNA, 20 bp, synthetic construct
  misc_feature 1..20: note = CRISPR gRNA sequence
  source 1..20: mol_type = other DNA
ccattcatctcccaccagct

SEQ ID NO: 7001 - DNA, 20 bp, synthetic construct
  misc_feature 1..20: note = CRISPR gRNA sequence
  source 1..20: mol_type = other DNA
tcatctcccaccagctgaga

SEQ ID NO: 7002 - DNA, 20 bp, synthetic construct
  misc_feature 1..20: note = CRISPR gRNA sequence
  source 1..20: mol_type = other DNA
atggaacgttatgctgttcc

SEQ ID NO: 7003 - DNA, 20 bp, synthetic construct
  misc_feature 1..20: note = CRISPR gRNA sequence
  source 1..20: mol_type = other DNA
gaacgttatgctgttcccag

SEQ ID NO: 7004 - DNA, 20 bp, synthetic construct
  misc_feature 1..20: note = CRISPR gRNA sequence
  source 1..20: mol_type = other DNA
acgttatgctgttcccagaa

SEQ ID NO: 7005 - DNA, 20 bp, synthetic construct
  misc_feature 1..20: note = CRISPR gRNA sequence
  source 1..20: mol_type = other DNA
gagatgcatgcactgatctt

SEQ ID NO: 7006 - DNA, 20 bp, synthetic construct
  misc_feature 1..20: note = CRISPR gRNA sequence
  source 1..20: mol_type = other DNA
tgcatgcactgatcttcaga

SEQ ID NO: 7007 - DNA, 20 bp, synthetic construct
  misc_feature 1..20: note = CRISPR gRNA sequence
  source 1..20: mol_type = other DNA
cactgatcttcagatagttt

SEQ ID NO: 7008 - DNA, 20 bp, synthetic construct
  misc_feature 1..20: note = CRISPR gRNA sequence
  source 1..20: mol_type = other DNA
tcttcagatagtttaagtct

SEQ ID NO: 7009 - DNA, 20 bp, synthetic construct
  misc_feature 1..20: note = CRISPR gRNA sequence
  source 1..20: mol_type = other DNA
cagatagtttaagtctgagt

SEQ ID NO: 7010 - DNA, 20 bp, synthetic construct
  misc_feature 1..20: note = CRISPR gRNA sequence
  source 1..20: mol_type = other DNA
aagtctgagttagaacattg

SEQ ID NO: 7011 - DNA, 20 bp, synthetic construct
  misc_feature 1..20: note = CRISPR gRNA sequence
  source 1..20: mol_type = other DNA
tggcgacacctgatttccct

SEQ ID NO: 7012 - DNA, 20 bp, synthetic construct
  misc_feature 1..20: note = CRISPR gRNA sequence
  source 1..20: mol_type = other DNA
ggcgacacctgatttccctc

SEQ ID NO: 7013 - DNA, 20 bp, synthetic construct
  misc_feature 1..20: note = CRISPR gRNA sequence
  source 1..20: mol_type = other DNA
gcgacacctgatttccctcg

SEQ ID NO: 7014 - DNA, 20 bp, synthetic construct
  misc_feature 1..20: note = CRISPR gRNA sequence
  source 1..20: mol_type = other DNA
cgacacctgatttccctcgg

SEQ ID NO: 7015 - DNA, 20 bp, synthetic construct
  misc_feature 1..20: note = CRISPR gRNA sequence
  source 1..20: mol_type = other DNA
acacctgatttccctcgggg

SEQ ID NO: 7016 - DNA, 20 bp, synthetic construct
  misc_feature 1..20: note = CRISPR gRNA sequence
  source 1..20: mol_type = other DNA
acctgatttccctcggggga

SEQ ID NO: 7017 - DNA, 20 bp, synthetic construct
  misc_feature 1..20: note = CRISPR gRNA sequence
  source 1..20: mol_type = other DNA
ctgatttccctcgggggaga

SEQ ID NO: 7018 - DNA, 20 bp, synthetic construct
  misc_feature 1..20: note = CRISPR gRNA sequence
  source 1..20: mol_type = other DNA
gatttccctcgggggagaga

SEQ ID NO: 7019 - DNA, 20 bp, synthetic construct
  misc_feature 1..20: note = CRISPR gRNA sequence
  source 1..20: mol_type = other DNA
atttccctcgggggagagag

SEQ ID NO: 7020 - DNA, 20 bp, synthetic construct
  misc_feature 1..20: note = CRISPR gRNA sequence
  source 1..20: mol_type = other DNA
agagaggtgaattgttattt

SEQ ID NO: 7021 - DNA, 20 bp, synthetic construct
  misc_feature 1..20: note = CRISPR gRNA sequence
  source 1..20: mol_type = other DNA
tgttatttcagacacctgtt

SEQ ID NO: 7022 - DNA, 20 bp, synthetic construct
  misc_feature 1..20: note = CRISPR gRNA sequence
  source 1..20: mol_type = other DNA
acctgtttagtgtctacact

SEQ ID NO: 7023 - DNA, 20 bp, synthetic construct
  misc_feature 1..20: note = CRISPR gRNA sequence
  source 1..20: mol_type = other DNA
agcctttcaaatcctgcatg

SEQ ID NO: 7024 - DNA, 20 bp, synthetic construct
  misc_feature 1..20: note = CRISPR gRNA sequence
  source 1..20: mol_type = other DNA
caaatcctgcatgcagtgtg

SEQ ID NO: 7025 - DNA, 20 bp, synthetic construct
  misc_feature 1..20: note = CRISPR gRNA sequence
  source 1..20: mol_type = other DNA
atcctgcatgcagtgtgaag

SEQ ID NO: 7026 - DNA, 20 bp, synthetic construct
  misc_feature 1..20: note = CRISPR gRNA sequence
  source 1..20: mol_type = other DNA
tcctgcatgcagtgtgaagt

SEQ ID NO: 7027 - DNA, 20 bp, synthetic construct
  misc_feature 1..20: note = CRISPR gRNA sequence
  source 1..20: mol_type = other DNA
cctgcatgcagtgtgaagtg

SEQ ID NO: 7028 - DNA, 20 bp, synthetic construct
  misc_feature 1..20: note = CRISPR gRNA sequence
  source 1..20: mol_type = other DNA
ggatgaaaataaaccccaaa

SEQ ID NO: 7029 - DNA, 20 bp, synthetic construct
  misc_feature 1..20: note = CRISPR gRNA sequence
  source 1..20: mol_type = other DNA
gatgaaaataaaccccaaaa

SEQ ID NO: 7030 - DNA, 20 bp, synthetic construct
  misc_feature 1..20: note = CRISPR gRNA sequence
  source 1..20: mol_type = other DNA
accccaaaaaggacttttga

SEQ ID NO: 7031 - DNA, 20 bp, synthetic construct
  misc_feature 1..20: note = CRISPR gRNA sequence
  source 1..20: mol_type = other DNA
aaaggacttttgatggcaaa

SEQ ID NO: 7032 - DNA, 20 bp, synthetic construct
  misc_feature 1..20: note = CRISPR gRNA sequence
  source 1..20: mol_type = other DNA
acttttgatggcaaaaagat

SEQ ID NO: 7033 - DNA, 20 bp, synthetic construct
  misc_feature 1..20: note = CRISPR gRNA sequence
  source 1..20: mol_type = other DNA
cttttgatggcaaaaagatc

SEQ ID NO: 7034 - DNA, 20 bp, synthetic construct
  misc_feature 1..20: note = CRISPR gRNA sequence
  source 1..20: mol_type = other DNA
aagatcaggaatattttctc

SEQ ID NO: 7035 - DNA, 20 bp, synthetic construct
  misc_feature 1..20: note = CRISPR gRNA sequence
  source 1..20: mol_type = other DNA
tcaggaatattttctcgagt

SEQ ID NO: 7036 - DNA, 20 bp, synthetic construct
  misc_feature 1..20: note = CRISPR gRNA sequence
  source 1..20: mol_type = other DNA
atattttctcgagttggatg

SEQ ID NO: 7037 - DNA, 20 bp, synthetic construct
  misc_feature 1..20: note = CRISPR gRNA sequence
  source 1..20: mol_type = other DNA
ttttctcgagttggatgtgg

SEQ ID NO: 7038 - DNA, 20 bp, synthetic construct
  misc_feature 1..20: note = CRISPR gRNA sequence
  source 1..20: mol_type = other DNA
tttctcgagttggatgtgga

SEQ ID NO: 7039 - DNA, 20 bp, synthetic construct
  misc_feature 1..20: note = CRISPR gRNA sequence
  source 1..20: mol_type = other DNA
ctcgagttggatgtggaagg

SEQ ID NO: 7040 - DNA, 20 bp, synthetic construct
  misc_feature 1..20: note = CRISPR gRNA sequence
  source 1..20: mol_type = other DNA
gagttggatgtggaaggtgg

SEQ ID NO: 7041 - DNA, 20 bp, synthetic construct
  misc_feature 1..20: note = CRISPR gRNA sequence
  source 1..20: mol_type = other DNA
ggatgtggaaggtggtggcc

SEQ ID NO: 7042 - DNA, 20 bp, synthetic construct
  misc_feature 1..20: note = CRISPR gRNA sequence
  source 1..20: mol_type = other DNA
gatgtggaaggtggtggccc

SEQ ID NO: 7043 - DNA, 20 bp, synthetic construct
  misc_feature 1..20: note = CRISPR gRNA sequence
  source 1..20: mol_type = other DNA
atgtggaaggtggtggccca

SEQ ID NO: 7044 - DNA, 20 bp, synthetic construct
  misc_feature 1..20: note = CRISPR gRNA sequence
  source 1..20: mol_type = other DNA
tgtggaaggtggtggcccag

SEQ ID NO: 7045 - DNA, 20 bp, synthetic construct
  misc_feature 1..20: note = CRISPR gRNA sequence
  source 1..20: mol_type = other DNA
gtggaaggtggtggcccagg

SEQ ID NO: 7046 - DNA, 20 bp, synthetic construct
  misc_feature 1..20: note = CRISPR gRNA sequence
  source 1..20: mol_type = other DNA
gaaggtggtggcccaggggg

SEQ ID NO: 7047 - DNA, 20 bp, synthetic construct
  misc_feature 1..20: note = CRISPR gRNA sequence
  source 1..20: mol_type = other DNA
tggtggcccagggggaagca

SEQ ID NO: 7048 - DNA, 20 bp, synthetic construct
  misc_feature 1..20: note = CRISPR gRNA sequence
  source 1..20: mol_type = other DNA
cagggggaagcacagtttca

SEQ ID NO: 7049 - DNA, 20 bp, synthetic construct
  misc_feature 1..20: note = CRISPR gRNA sequence
  source 1..20: mol_type = other DNA
gggggaagcacagtttcaaa

SEQ ID NO: 7050 - DNA, 20 bp, synthetic construct
  misc_feature 1..20: note = CRISPR gRNA sequence
  source 1..20: mol_type = other DNA
ggggaagcacagtttcaaag

SEQ ID NO: 7051 - DNA, 20 bp, synthetic construct
  misc_feature 1..20: note = CRISPR gRNA sequence
  source 1..20: mol_type = other DNA
aatactgcccatttaccaaa

SEQ ID NO: 7052 - DNA, 20 bp, synthetic construct
  misc_feature 1..20: note = CRISPR gRNA sequence
  source 1..20: mol_type = other DNA
gcccatttaccaaaaagaca

SEQ ID NO: 7053 - DNA, 20 bp, synthetic construct
  misc_feature 1..20: note = CRISPR gRNA sequence
  source 1..20: mol_type = other DNA
gcctctgccctgcccccaca

SEQ ID NO: 7054 - DNA, 20 bp, synthetic construct
  misc_feature 1..20: note = CRISPR gRNA sequence
  source 1..20: mol_type = other DNA
gcccccacatggctcctcaa

SEQ ID NO: 7055 - DNA, 20 bp, synthetic construct
  misc_feature 1..20: note = CRISPR gRNA sequence
  source 1..20: mol_type = other DNA
cccccacatggctcctcaaa

SEQ ID NO: 7056 - DNA, 20 bp, synthetic construct
  misc_feature 1..20: note = CRISPR gRNA sequence
  source 1..20: mol_type = other DNA
cccacatggctcctcaaaag

SEQ ID NO: 7057 - DNA, 20 bp, synthetic construct
  misc_feature 1..20: note = CRISPR gRNA sequence
  source 1..20: mol_type = other DNA
ccacccacgccttccctcgc

SEQ ID NO: 7058 - DNA, 20 bp, synthetic construct
  misc_feature 1..20: note = CRISPR gRNA sequence
  source 1..20: mol_type = other DNA
cacccacgccttccctcgcc

SEQ ID NO: 7059 - DNA, 20 bp, synthetic construct
  misc_feature 1..20: note = CRISPR gRNA sequence
  source 1..20: mol_type = other DNA
acccacgccttccctcgccg

SEQ ID NO: 7060 - DNA, 20 bp, synthetic construct
  misc_feature 1..20: note = CRISPR gRNA sequence
  source 1..20: mol_type = other DNA
gccttccctcgccggggtgc

SEQ ID NO: 7061 - DNA, 20 bp, synthetic construct
  misc_feature 1..20: note = CRISPR gRNA sequence
  source 1..20: mol_type = other DNA
ccttccctcgccggggtgct

SEQ ID NO: 7062 - DNA, 20 bp, synthetic construct
  misc_feature 1..20: note = CRISPR gRNA sequence
  source 1..20: mol_type = other DNA
cttccctcgccggggtgctg

SEQ ID NO: 7063 - DNA, 20 bp, synthetic construct
  misc_feature 1..20: note = CRISPR gRNA sequence
  source 1..20: mol_type = other DNA
ttccctcgccggggtgctgg

SEQ ID NO: 7064 - DNA, 20 bp, synthetic construct
  misc_feature 1..20: note = CRISPR gRNA sequence
  source 1..20: mol_type = other DNA
tccctcgccggggtgctggg

SEQ ID NO: 7065 - DNA, 20 bp, synthetic construct
  misc_feature 1..20: note = CRISPR gRNA sequence
  source 1..20: mol_type = other DNA
ccggggtgctggggggccaa

SEQ ID NO: 7066 - DNA, 20 bp, synthetic construct
  misc_feature 1..20: note = CRISPR gRNA sequence
  source 1..20: mol_type = other DNA
ggggccaacagcaattcaaa

SEQ ID NO: 7067 - DNA, 20 bp, synthetic construct
  misc_feature 1..20: note = CRISPR gRNA sequence
  source 1..20: mol_type = other DNA
gggccaacagcaattcaaaa

SEQ ID NO: 7068 - DNA, 20 bp, synthetic construct
  misc_feature 1..20: note = CRISPR gRNA sequence
  source 1..20: mol_type = other DNA
acagcaattcaaaaaggcta

SEQ ID NO: 7069 - DNA, 20 bp, synthetic construct
  misc_feature 1..20: note = CRISPR gRNA sequence
  source 1..20: mol_type = other DNA
agcaattcaaaaaggctata

SEQ ID NO: 7070 - DNA, 20 bp, synthetic construct
  misc_feature 1..20: note = CRISPR gRNA sequence
  source 1..20: mol_type = other DNA
aattcaaaaaggctatagag

SEQ ID NO: 7071 - DNA, 20 bp, synthetic construct
  misc_feature 1..20: note = CRISPR gRNA sequence
  source 1..20: mol_type = other DNA
attcaaaaaggctatagagt

SEQ ID NO: 7072 - DNA, 20 bp, synthetic construct
  misc_feature 1..20: note = CRISPR gRNA sequence
  source 1..20: mol_type = other DNA
aaaaggctatagagtgggct

SEQ ID NO: 7073 - DNA, 20 bp, synthetic construct
  misc_feature 1..20: note = CRISPR gRNA sequence
  source 1..20: mol_type = other DNA
tatagagtgggctgagactt

SEQ ID NO: 7074 - DNA, 20 bp, synthetic construct
  misc_feature 1..20: note = CRISPR gRNA sequence
  source 1..20: mol_type = other DNA
tagagtgggctgagactttg

SEQ ID NO: 7075 - DNA, 20 bp, synthetic construct
  misc_feature 1..20: note = CRISPR gRNA sequence
  source 1..20: mol_type = other DNA
gtgggctgagactttggaga

SEQ ID NO: 7076 - DNA, 20 bp, synthetic construct
  misc_feature 1..20: note = CRISPR gRNA sequence
  source 1..20: mol_type = other DNA
tgggctgagactttggagat

SEQ ID NO: 7077 - DNA, 20 bp, synthetic construct
  misc_feature 1..20: note = CRISPR gRNA sequence
  source 1..20: mol_type = other DNA
gctgagactttggagatggg

SEQ ID NO: 7078 - DNA, 20 bp, synthetic construct
  misc_feature 1..20: note = CRISPR gRNA sequence
  source 1..20: mol_type = other DNA
gactttggagatgggtagtt

SEQ ID NO: 7079 - DNA, 20 bp, synthetic construct
  misc_feature 1..20: note = CRISPR gRNA sequence
  source 1..20: mol_type = other DNA
gggtagtttggttcaaatct

SEQ ID NO: 7080 - DNA, 20 bp, synthetic construct
  misc_feature 1..20: note = CRISPR gRNA sequence
  source 1..20: mol_type = other DNA
ctcagcccactaatccctct

SEQ ID NO: 7081 - DNA, 20 bp, synthetic construct
  misc_feature 1..20: note = CRISPR gRNA sequence
  source 1..20: mol_type = other DNA
ctgtctcttcatctgaaaaa

SEQ ID NO: 7082 - DNA, 20 bp, synthetic construct
  misc_feature 1..20: note = CRISPR gRNA sequence
  source 1..20: mol_type = other DNA
tgtctcttcatctgaaaaac

SEQ ID NO: 7083 - DNA, 20 bp, synthetic construct
  misc_feature 1..20: note = CRISPR gRNA sequence
  source 1..20: mol_type = other DNA
ctgaaaaacaggaatacaaa

SEQ ID NO: 7084 - DNA, 20 bp, synthetic construct
  misc_feature 1..20: note = CRISPR gRNA sequence
  source 1..20: mol_type = other DNA
aatacaaatagctgatgtgt

SEQ ID NO: 7085 - DNA, 20 bp, synthetic construct
  misc_feature 1..20: note = CRISPR gRNA sequence
  source 1..20: mol_type = other DNA
caaatagctgatgtgtaagt

SEQ ID NO: 7086 - DNA, 20 bp, synthetic construct
  misc_feature 1..20: note = CRISPR gRNA sequence
  source 1..20: mol_type = other DNA
gatgtgtaagttagaccaaa

SEQ ID NO: 7087 - DNA, 20 bp, synthetic construct
  misc_feature 1..20: note = CRISPR gRNA sequence
  source 1..20: mol_type = other DNA
atgtgtaagttagaccaaat

SEQ ID NO: 7088 - DNA, 20 bp, synthetic construct
  misc_feature 1..20: note = CRISPR gRNA sequence
  source 1..20: mol_type = other DNA
tgtgtaagttagaccaaatg

SEQ ID NO: 7089 - DNA, 20 bp, synthetic construct
  misc_feature 1..20: note = CRISPR gRNA sequence
  source 1..20: mol_type = other DNA
ccaaatggggtaatgcctac

SEQ ID NO: 7090 - DNA, 20 bp, synthetic construct
  misc_feature 1..20: note = CRISPR gRNA sequence
  source 1..20: mol_type = other DNA
tgcctacgagtcatgtcatt

SEQ ID NO: 7091 - DNA, 20 bp, synthetic construct
  misc_feature 1..20: note = CRISPR gRNA sequence
  source 1..20: mol_type = other DNA
gagtcatgtcatttggtacc

SEQ ID NO: 7092 - DNA, 20 bp, synthetic construct
  misc_feature 1..20: note = CRISPR gRNA sequence
  source 1..20: mol_type = other DNA
atttggtacctggcacttgc

SEQ ID NO: 7093 - DNA, 20 bp, synthetic construct
  misc_feature 1..20: note = CRISPR gRNA sequence
  source 1..20: mol_type = other DNA
ttgctggacactgtgaattc

SEQ ID NO: 7094 - DNA, 20 bp, synthetic construct
  misc_feature 1..20: note = CRISPR gRNA sequence
  source 1..20: mol_type = other DNA
ctagttctatatcattgcca

SEQ ID NO: 7095 - DNA, 20 bp, synthetic construct
  misc_feature 1..20: note = CRISPR gRNA sequence
  source 1..20: mol_type = other DNA
ctatatcattgccacggatg

SEQ ID NO: 7096 - DNA, 20 bp, synthetic construct
  misc_feature 1..20: note = CRISPR gRNA sequence
  source 1..20: mol_type = other DNA
atatcattgccacggatgaa

SEQ ID NO: 7097 - DNA, 20 bp, synthetic construct
  misc_feature 1..20: note = CRISPR gRNA sequence
  source 1..20: mol_type = other DNA
atcattgccacggatgaaga

SEQ ID NO: 7098 - DNA, 20 bp, synthetic construct
  misc_feature 1..20: note = CRISPR gRNA sequence
  source 1..20: mol_type = other DNA
tcattgccacggatgaagag

SEQ ID NO: 7099 - DNA, 20 bp, synthetic construct
  misc_feature 1..20: note = CRISPR gRNA sequence
  source 1..20: mol_type = other DNA
tgaagagaggctgccatgcg

SEQ ID NO: 7100 - DNA, 20 bp, synthetic construct
  misc_feature 1..20: note = CRISPR gRNA sequence
  source 1..20: mol_type = other DNA
gccatgcgcagaaacatgct

SEQ ID NO: 7101 - DNA, 20 bp, synthetic construct
  misc_feature 1..20: note = CRISPR gRNA sequence
  source 1..20: mol_type = other DNA
catgcgcagaaacatgctga

SEQ ID NO: 7102 - DNA, 20 bp, synthetic construct
  misc_feature 1..20: note = CRISPR gRNA sequence
  source 1..20: mol_type = other DNA
cgcagaaacatgctgagagc

SEQ ID NO: 7103 - DNA, 20 bp, synthetic construct
  misc_feature 1..20: note = CRISPR gRNA sequence
  source 1..20: mol_type = other DNA
gcagaaacatgctgagagct

SEQ ID NO: 7104 - DNA, 20 bp, synthetic construct
  misc_feature 1..20: note = CRISPR gRNA sequence
  source 1..20: mol_type = other DNA
agaaacatgctgagagctgg

SEQ ID NO: 7105 - DNA, 20 bp, synthetic construct
  misc_feature 1..20: note = CRISPR gRNA sequence
  source 1..20: mol_type = other DNA
aacatgctgagagctgggag

SEQ ID NO: 7106 - DNA, 20 bp, synthetic construct
  misc_feature 1..20: note = CRISPR gRNA sequence
  source 1..20: mol_type = other DNA
acatgctgagagctgggaga

SEQ ID NO: 7107 - DNA, 20 bp, synthetic construct
  misc_feature 1..20: note = CRISPR gRNA sequence
  source 1..20: mol_type = other DNA
gctgagagctgggagaaggt

SEQ ID NO: 7108 - DNA, 20 bp, synthetic construct
  misc_feature 1..20: note = CRISPR gRNA sequence
  source 1..20: mol_type = other DNA
agagctgggagaaggtgagc

SEQ ID NO: 7109 - DNA, 20 bp, synthetic construct
  misc_feature 1..20: note = CRISPR gRNA sequence
  source 1..20: mol_type = other DNA
agctgggagaaggtgagcta

SEQ ID NO: 7110 - DNA, 20 bp, synthetic construct
  misc_feature 1..20: note = CRISPR gRNA sequence
  source 1..20: mol_type = other DNA
gctgggagaaggtgagctag

SEQ ID NO: 7111 - DNA, 20 bp, synthetic construct
  misc_feature 1..20: note = CRISPR gRNA sequence
  source 1..20: mol_type = other DNA
ctgggagaaggtgagctaga

SEQ ID NO: 7112 - DNA, 20 bp, synthetic construct
  misc_feature 1..20: note = CRISPR gRNA sequence
  source 1..20: mol_type = other DNA
gaaggtgagctagagggata

SEQ ID NO: 7113 - DNA, 20 bp, synthetic construct
  misc_feature 1..20: note = CRISPR gRNA sequence
  source 1..20: mol_type = other DNA
agggatacagtccctgccct

SEQ ID NO: 7114 - DNA, 20 bp, synthetic construct
  misc_feature 1..20: note = CRISPR gRNA sequence
  source 1..20: mol_type = other DNA
gggatacagtccctgccctc

SEQ ID NO: 7115 - DNA, 20 bp, synthetic construct
  misc_feature 1..20: note = CRISPR gRNA sequence
  source 1..20: mol_type = other DNA
ggatacagtccctgccctca

SEQ ID NO: 7116 - DNA, 20 bp, synthetic construct
  misc_feature 1..20: note = CRISPR gRNA sequence
  source 1..20: mol_type = other DNA
atacagtccctgccctcagg

SEQ ID NO: 7117 - DNA, 20 bp, synthetic construct
  misc_feature 1..20: note = CRISPR gRNA sequence
  source 1..20: mol_type = other DNA
acagtccctgccctcaggga

SEQ ID NO: 7118 - DNA, 20 bp, synthetic construct
  misc_feature 1..20: note = CRISPR gRNA sequence
  source 1..20: mol_type = other DNA
cctgccctcagggagagctg

SEQ ID NO: 7119 - DNA, 20 bp, synthetic construct
  misc_feature 1..20: note = CRISPR gRNA sequence
  source 1..20: mol_type = other DNA
ctgccctcagggagagctga

SEQ ID NO: 7120 - DNA, 20 bp, synthetic construct
  misc_feature 1..20: note = CRISPR gRNA sequence
  source 1..20: mol_type = other DNA
tgccctcagggagagctgaa

SEQ ID NO: 7121 - DNA, 20 bp, synthetic construct
  misc_feature 1..20: note = CRISPR gRNA sequence
  source 1..20: mol_type = other DNA
aagggctctctctcctgcca

SEQ ID NO: 7122 - DNA, 20 bp, synthetic construct
  misc_feature 1..20: note = CRISPR gRNA sequence
  source 1..20: mol_type = other DNA
agggctctctctcctgccac

SEQ ID NO: 7123 - DNA, 20 bp, synthetic construct
  misc_feature 1..20: note = CRISPR gRNA sequence
  source 1..20: mol_type = other DNA
ctctcctgccacgggatgat

SEQ ID NO: 7124 - DNA, 20 bp, synthetic construct
  misc_feature 1..20: note = CRISPR gRNA sequence
  source 1..20: mol_type = other DNA
tctcctgccacgggatgatc

SEQ ID NO: 7125 - DNA, 20 bp, synthetic construct
  misc_feature 1..20: note = CRISPR gRNA sequence
  source 1..20: mol_type = other DNA
ctcctgccacgggatgatca

SEQ ID NO: 7126 - DNA, 20 bp, synthetic construct
  misc_feature 1..20: note = CRISPR gRNA sequence
  source 1..20: mol_type = other DNA
cttttccctccatcccgctc

SEQ ID NO: 7127 - DNA, 20 bp, synthetic construct
  misc_feature 1..20: note = CRISPR gRNA sequence
  source 1..20: mol_type = other DNA
tccatcccgctctggcaatg

SEQ ID NO: 7128 - DNA, 20 bp, synthetic construct
  misc_feature 1..20: note = CRISPR gRNA sequence
  source 1..20: mol_type = other DNA
cccgctctggcaatgtggtt

SEQ ID NO: 7129 - DNA, 20 bp, synthetic construct
  misc_feature 1..20: note = CRISPR gRNA sequence
  source 1..20: mol_type = other DNA
cgctctggcaatgtggtttg

SEQ ID NO: 7130 - DNA, 20 bp, synthetic construct
  misc_feature 1..20: note = CRISPR gRNA sequence
  source 1..20: mol_type = other DNA
ggcaatgtggtttggagaaa

SEQ ID NO: 7131 - DNA, 20 bp, synthetic construct
  misc_feature 1..20: note = CRISPR gRNA sequence
  source 1..20: mol_type = other DNA
tttggagaaacagtccaatg

SEQ ID NO: 7132 - DNA, 20 bp, synthetic construct
  misc_feature 1..20: note = CRISPR gRNA sequence
  source 1..20: mol_type = other DNA
ttggagaaacagtccaatga

SEQ ID NO: 7133 - DNA, 20 bp, synthetic construct
  misc_feature 1..20: note = CRISPR gRNA sequence
  source 1..20: mol_type = other DNA
tggagaaacagtccaatgaa

SEQ ID NO: 7134 - DNA, 20 bp, synthetic construct
  misc_feature 1..20: note = CRISPR gRNA sequence
  source 1..20: mol_type = other DNA
ggagaaacagtccaatgaag

SEQ ID NO: 7135 - DNA, 20 bp, synthetic construct
  misc_feature 1..20: note = CRISPR gRNA sequence
  source 1..20: mol_type = other DNA
gtccaatgaaggggcctttg

SEQ ID NO: 7136 - DNA, 20 bp, synthetic construct
  misc_feature 1..20: note = CRISPR gRNA sequence
  source 1..20: mol_type = other DNA
gggcctttgaagcacttcct

SEQ ID NO: 7137 - DNA, 20 bp, synthetic construct
  misc_feature 1..20: note = CRISPR gRNA sequence
  source 1..20: mol_type = other DNA
aagcacttcctaagcatcta

SEQ ID NO: 7138 - DNA, 20 bp, synthetic construct
  misc_feature 1..20: note = CRISPR gRNA sequence
  source 1..20: mol_type = other DNA
ttcctaagcatctatagaca

SEQ ID NO: 7139 - DNA, 20 bp, synthetic construct
  misc_feature 1..20: note = CRISPR gRNA sequence
  source 1..20: mol_type = other DNA
tcctaagcatctatagacat

SEQ ID NO: 7140 - DNA, 20 bp, synthetic construct
  misc_feature 1..20: note = CRISPR gRNA sequence
  source 1..20: mol_type = other DNA
atctatagacataggaaact

SEQ ID NO: 7141 - DNA, 20 bp, synthetic construct
  misc_feature 1..20: note = CRISPR gRNA sequence
  source 1..20: mol_type = other DNA
agacataggaaacttggctc

SEQ ID NO: 7142 - DNA, 20 bp, synthetic construct
  misc_feature 1..20: note = CRISPR gRNA sequence
  source 1..20: mol_type = other DNA
gacataggaaacttggctct

SEQ ID NO: 7143 - DNA, 20 bp, synthetic construct
  misc_feature 1..20: note = CRISPR gRNA sequence
  source 1..20: mol_type = other DNA
acataggaaacttggctctg

SEQ ID NO: 7144 - DNA, 20 bp, synthetic construct
  misc_feature 1..20: note = CRISPR gRNA sequence
  source 1..20: mol_type = other DNA
aggaaacttggctctgggga

SEQ ID NO: 7145 - DNA, 20 bp, synthetic construct
  misc_feature 1..20: note = CRISPR gRNA sequence
  source 1..20: mol_type = other DNA
gaaacttggctctggggata

SEQ ID NO: 7146 - DNA, 20 bp, synthetic construct
  misc_feature 1..20: note = CRISPR gRNA sequence
  source 1..20: mol_type = other DNA
aaacttggctctggggatag

SEQ ID NO: 7147 - DNA, 20 bp, synthetic construct
  misc_feature 1..20: note = CRISPR gRNA sequence
  source 1..20: mol_type = other DNA
cttggctctggggatagagg

SEQ ID NO: 7148 - DNA, 20 bp, synthetic construct
  misc_feature 1..20: note = CRISPR gRNA sequence
  source 1..20: mol_type = other DNA
ttggctctggggatagagga

SEQ ID NO: 7149 - DNA, 20 bp, synthetic construct
  misc_feature 1..20: note = CRISPR gRNA sequence
  source 1..20: mol_type = other DNA
atagaggaaggtcccatgcc

SEQ ID NO: 7150 - DNA, 20 bp, synthetic construct
  misc_feature 1..20: note = CRISPR gRNA sequence
  source 1..20: mol_type = other DNA
aaggtcccatgccaagattc

SEQ ID NO: 7151 - DNA, 20 bp, synthetic construct
  misc_feature 1..20: note = CRISPR gRNA sequence
  source 1..20: mol_type = other DNA
gtcccatgccaagattcaag

SEQ ID NO: 7152 - DNA, 20 bp, synthetic construct
  misc_feature 1..20: note = CRISPR gRNA sequence
  source 1..20: mol_type = other DNA
gccaagattcaagtagatct

SEQ ID NO: 7153 - DNA, 20 bp, synthetic construct
  misc_feature 1..20: note = CRISPR gRNA sequence
  source 1..20: mol_type = other DNA
caagtagatcttggtgtgac

SEQ ID NO: 7154 - DNA, 20 bp, synthetic construct
  misc_feature 1..20: note = CRISPR gRNA sequence
  source 1..20: mol_type = other DNA
aagtagatcttggtgtgact

SEQ ID NO: 7155 - DNA, 20 bp, synthetic construct
  misc_feature 1..20: note = CRISPR gRNA sequence
  source 1..20: mol_type = other DNA
gtagatcttggtgtgactgg

SEQ ID NO: 7156 - DNA, 20 bp, synthetic construct
  misc_feature 1..20: note = CRISPR gRNA sequence
  source 1..20: mol_type = other DNA
tagatcttggtgtgactggg

SEQ ID NO: 7157 - DNA, 20 bp, synthetic construct
  misc_feature 1..20: note = CRISPR gRNA sequence
  source 1..20: mol_type = other DNA
atcttggtgtgactgggagg

SEQ ID NO: 7158 - DNA, 20 bp, synthetic construct
  misc_feature 1..20: note = CRISPR gRNA sequence
  source 1..20: mol_type = other DNA
gtgtgactgggaggcagctg

SEQ ID NO: 7159 - DNA, 20 bp, synthetic construct
  misc_feature 1..20: note = CRISPR gRNA sequence
  source 1..20: mol_type = other DNA
gggaggcagctgtggcgttg

SEQ ID NO: 7160 - DNA, 20 bp, synthetic construct
  misc_feature 1..20: note = CRISPR gRNA sequence
  source 1..20: mol_type = other DNA
ggaggcagctgtggcgttgt

SEQ ID NO: 7161 - DNA, 20 bp, synthetic construct
  misc_feature 1..20: note = CRISPR gRNA sequence
  source 1..20: mol_type = other DNA
gaggcagctgtggcgttgtg

SEQ ID NO: 7162 - DNA, 20 bp, synthetic construct
  misc_feature 1..20: note = CRISPR gRNA sequence
  source 1..20: mol_type = other DNA
tgtggcgttgtggggaaacc

SEQ ID NO: 7163 - DNA, 20 bp, synthetic construct
  misc_feature 1..20: note = CRISPR gRNA sequence
  source 1..20: mol_type = other DNA
tggcgttgtggggaaaccta

SEQ ID NO: 7164 - DNA, 20 bp, synthetic construct
  misc_feature 1..20: note = CRISPR gRNA sequence
  source 1..20: mol_type = other DNA
tgtggggaaacctagagtct

SEQ ID NO: 7165 - DNA, 20 bp, synthetic construct
  misc_feature 1..20: note = CRISPR gRNA sequence
  source 1..20: mol_type = other DNA
gtggggaaacctagagtctt

SEQ ID NO: 7166 - DNA, 20 bp, synthetic construct
  misc_feature 1..20: note = CRISPR gRNA sequence
  source 1..20: mol_type = other DNA
agagtcttgggcctgaattt

SEQ ID NO: 7167 - DNA, 20 bp, synthetic construct
  misc_feature 1..20: note = CRISPR gRNA sequence
  source 1..20: mol_type = other DNA
tttgacaccctctaatgtaa

SEQ ID NO: 7168 - DNA, 20 bp, synthetic construct
  misc_feature 1..20: note = CRISPR gRNA sequence
  source 1..20: mol_type = other DNA
ttgacaccctctaatgtaat

SEQ ID NO: 7169 - DNA, 20 bp, synthetic construct
  misc_feature 1..20: note = CRISPR gRNA sequence
  source 1..20: mol_type = other DNA
taatgggcttcctttgactg

SEQ ID NO: 7170 - DNA, 20 bp, synthetic construct
  misc_feature 1..20: note = CRISPR gRNA sequence
  source 1..20: mol_type = other DNA
aatgggcttcctttgactgt

SEQ ID NO: 7171 - DNA, 20 bp, synthetic construct
  misc_feature 1..20: note = CRISPR gRNA sequence
  source 1..20: mol_type = other DNA
ttgactgtaggcttcccaca

SEQ ID NO: 7172 - DNA, 20 bp, synthetic construct
  misc_feature 1..20: note = CRISPR gRNA sequence
  source 1..20: mol_type = other DNA
ctgtaggcttcccacatagc

SEQ ID NO: 7173 - DNA, 20 bp, synthetic construct
  misc_feature 1..20: note = CRISPR gRNA sequence
  source 1..20: mol_type = other DNA
cacatagctggcaccccaca

SEQ ID NO: 7174 - DNA, 20 bp, synthetic construct
  misc_feature 1..20: note = CRISPR gRNA sequence
  source 1..20: mol_type = other DNA
caccccacacagaactccct

SEQ ID NO: 7175 - DNA, 20 bp, synthetic construct
  misc_feature 1..20: note = CRISPR gRNA sequence
  source 1..20: mol_type = other DNA
ttggccttctgatgatcctg

SEQ ID NO: 7176 - DNA, 20 bp, synthetic construct
  misc_feature 1..20: note = CRISPR gRNA sequence
  source 1..20: mol_type = other DNA
tggccttctgatgatcctgc

SEQ ID NO: 7177 - DNA, 20 bp, synthetic construct
  misc_feature 1..20: note = CRISPR gRNA sequence
  source 1..20: mol_type = other DNA
ttgttttttgtttttttttt

SEQ ID NO: 7178 - DNA, 20 bp, synthetic construct
  misc_feature 1..20: note = CRISPR gRNA sequence
  source 1..20: mol_type = other DNA
tttttgttttttttttgaga

SEQ ID NO: 7179 - DNA, 20 bp, synthetic construct
  misc_feature 1..20: note = CRISPR gRNA sequence
  source 1..20: mol_type = other DNA
tggtatctcactttgtcgcc

SEQ ID NO: 7180 - DNA, 20 bp, synthetic construct
  misc_feature 1..20: note = CRISPR gRNA sequence
  source 1..20: mol_type = other DNA
ggtatctcactttgtcgccc

SEQ ID NO: 7181 - DNA, 20 bp, synthetic construct
  misc_feature 1..20: note = CRISPR gRNA sequence
  source 1..20: mol_type = other DNA
tctcactttgtcgcccaggc

SEQ ID NO: 7182 - DNA, 20 bp, synthetic construct
  misc_feature 1..20: note = CRISPR gRNA sequence
  source 1..20: mol_type = other DNA
tcactttgtcgcccaggctg

SEQ ID NO: 7183 - DNA, 20 bp, synthetic construct
  misc_feature 1..20: note = CRISPR gRNA sequence
  source 1..20: mol_type = other DNA
ttgtcgcccaggctggagtg

SEQ ID NO: 7184 - DNA, 20 bp, synthetic construct
  misc_feature 1..20: note = CRISPR gRNA sequence
  source 1..20: mol_type = other DNA
tcgcccaggctggagtgcag

SEQ ID NO: 7185 - DNA, 20 bp, synthetic construct
  misc_feature 1..20: note = CRISPR gRNA sequence
  source 1..20: mol_type = other DNA
caggctggagtgcagtggcg

SEQ ID NO: 7186 - DNA, 20 bp, synthetic construct
  misc_feature 1..20: note = CRISPR gRNA sequence
  source 1..20: mol_type = other DNA
ggagtgcagtggcgcagtct

SEQ ID NO: 7187 - DNA, 20 bp, synthetic construct
  misc_feature 1..20: note = CRISPR gRNA sequence
  source 1..20: mol_type = other DNA
ggcgcagtcttggttcactg

SEQ ID NO: 7188 - DNA, 20 bp, synthetic construct
  misc_feature 1..20: note = CRISPR gRNA sequence
  source 1..20: mol_type = other DNA
tcactgcagcctctgcctcc

SEQ ID NO: 7189 - DNA, 20 bp, synthetic construct
  misc_feature 1..20: note = CRISPR gRNA sequence
  source 1..20: mol_type = other DNA
cactgcagcctctgcctccc

SEQ ID NO: 7190 - DNA, 20 bp, synthetic construct
  misc_feature 1..20: note = CRISPR gRNA sequence
  source 1..20: mol_type = other DNA
agcctctgcctcccaggttc

SEQ ID NO: 7191 - DNA, 20 bp, synthetic construct
  misc_feature 1..20: note = CRISPR gRNA sequence
  source 1..20: mol_type = other DNA
ttcaagcgattctcctgcct

SEQ ID NO: 7192 - DNA, 20 bp, synthetic construct
  misc_feature 1..20: note = CRISPR gRNA sequence
  source 1..20: mol_type = other DNA
ttctcctgcctcagcctccc

SEQ ID NO: 7193 - DNA, 20 bp, synthetic construct
  misc_feature 1..20: note = CRISPR gRNA sequence
  source 1..20: mol_type = other DNA
tcctgcctcagcctcccaag

SEQ ID NO: 7194 - DNA, 20 bp, synthetic construct
  misc_feature 1..20: note = CRISPR gRNA sequence
  source 1..20: mol_type = other DNA
gcctcagcctcccaagtagc

SEQ ID NO: 7195 - DNA, 20 bp, synthetic construct
  misc_feature 1..20: note = CRISPR gRNA sequence
  source 1..20: mol_type = other DNA
cctcagcctcccaagtagct

SEQ ID NO: 7196 - DNA, 20 bp, synthetic construct
  misc_feature 1..20: note = CRISPR gRNA sequence
  source 1..20: mol_type = other DNA
ctcccaagtagctgggatta

SEQ ID NO: 7197 - DNA, 20 bp, synthetic construct
  misc_feature 1..20: note = CRISPR gRNA sequence
  source 1..20: mol_type = other DNA
ccaagtagctgggattacag

SEQ ID NO: 7198 - DNA, 20 bp, synthetic construct
  misc_feature 1..20: note = CRISPR gRNA sequence
  source 1..20: mol_type = other DNA
cagaagcacgccaccatgcc

SEQ ID NO: 7199 - DNA, 20 bp, synthetic construct
  misc_feature 1..20: note = CRISPR gRNA sequence
  source 1..20: mol_type = other DNA
cctggctaattttgtatttt

SEQ ID NO: 7200 - DNA, 20 bp, synthetic construct
  misc_feature 1..20: note = CRISPR gRNA sequence
  source 1..20: mol_type = other DNA
ggctaattttgtatttttag

SEQ ID NO: 7201 - DNA, 20 bp, synthetic construct
  misc_feature 1..20: note = CRISPR gRNA sequence
  source 1..20: mol_type = other DNA
ctaattttgtatttttagta

SEQ ID NO: 7202 - DNA, 20 bp, synthetic construct
  misc_feature 1..20: note = CRISPR gRNA sequence
  source 1..20: mol_type = other DNA
ttttgtatttttagtagaga

SEQ ID NO: 7203 - DNA, 20 bp, synthetic construct
  misc_feature 1..20: note = CRISPR gRNA sequence
  source 1..20: mol_type = other DNA
tttgtatttttagtagagac

SEQ ID NO: 7204 - DNA, 20 bp, synthetic construct
  misc_feature 1..20: note = CRISPR gRNA sequence
  source 1..20: mol_type = other DNA
cgggatttcaccatgttgcc

SEQ ID NO: 7205 - DNA, 20 bp, synthetic construct
  misc_feature 1..20: note = CRISPR gRNA sequence
  source 1..20: mol_type = other DNA
gggatttcaccatgttgccc

SEQ ID NO: 7206 - DNA, 20 bp, synthetic construct
  misc_feature 1..20: note = CRISPR gRNA sequence
  source 1..20: mol_type = other DNA
tttcaccatgttgcccgggc

SEQ ID NO: 7207 - DNA, 20 bp, synthetic construct
  misc_feature 1..20: note = CRISPR gRNA sequence
  source 1..20: mol_type = other DNA
ggtctcaaactcctgacctc

SEQ ID NO: 7208 - DNA, 20 bp, synthetic construct
  misc_feature 1..20: note = CRISPR gRNA sequence
  source 1..20: mol_type = other DNA
ctcaagtgatctgcctgcct

SEQ ID NO: 7209 - DNA, 20 bp, synthetic construct
  misc_feature 1..20: note = CRISPR gRNA sequence
  source 1..20: mol_type = other DNA
ctgcctgcctcggcctccca

SEQ ID NO: 7210 - DNA, 20 bp, synthetic construct
  misc_feature 1..20: note = CRISPR gRNA sequence
  source 1..20: mol_type = other DNA
cctgcctcggcctcccacag

SEQ ID NO: 7211 - DNA, 20 bp, synthetic construct
  misc_feature 1..20: note = CRISPR gRNA sequence
  source 1..20: mol_type = other DNA
gcctcggcctcccacagtgg

SEQ ID NO: 7212 - DNA, 20 bp, synthetic construct
  misc_feature 1..20: note = CRISPR gRNA sequence
  source 1..20: mol_type = other DNA
cctcggcctcccacagtggt

SEQ ID NO: 7213 - DNA, 20 bp, synthetic construct
  misc_feature 1..20: note = CRISPR gRNA sequence
  source 1..20: mol_type = other DNA
ctcccacagtggtgggctgc

SEQ ID NO: 7214 - DNA, 20 bp, synthetic construct
  misc_feature 1..20: note = CRISPR gRNA sequence
  source 1..20: mol_type = other DNA
tcccacagtggtgggctgca

SEQ ID NO: 7215 - DNA, 20 bp, synthetic construct
  misc_feature 1..20: note = CRISPR gRNA sequence
  source 1..20: mol_type = other DNA
gcaaggcaatcttcattctc

SEQ ID NO: 7216 - DNA, 20 bp, synthetic construct
  misc_feature 1..20: note = CRISPR gRNA sequence
  source 1..20: mol_type = other DNA
tcattctccagaactaatat

SEQ ID NO: 7217 - DNA, 20 bp, synthetic construct
  misc_feature 1..20: note = CRISPR gRNA sequence
  source 1..20: mol_type = other DNA
cattctccagaactaatatt

SEQ ID NO: 7218 - DNA, 20 bp, synthetic construct
  misc_feature 1..20: note = CRISPR gRNA sequence
  source 1..20: mol_type = other DNA
atattgggaaaactgatgtt

SEQ ID NO: 7219 - DNA, 20 bp, synthetic construct
  misc_feature 1..20: note = CRISPR gRNA sequence
  source 1..20: mol_type = other DNA
attgggaaaactgatgttca

SEQ ID NO: 7220 - DNA, 20 bp, synthetic construct
  misc_feature 1..20: note = CRISPR gRNA sequence
  source 1..20: mol_type = other DNA
tgggaaaactgatgttcaga

SEQ ID NO: 7221 - DNA, 20 bp, synthetic construct
  misc_feature 1..20: note = CRISPR gRNA sequence
  source 1..20: mol_type = other DNA
gggaaaactgatgttcagag

SEQ ID NO: 7222 - DNA, 20 bp, synthetic construct
  misc_feature 1..20: note = CRISPR gRNA sequence
  source 1..20: mol_type = other DNA
aactgatgttcagagaggtc

SEQ ID NO: 7223 - DNA, 20 bp, synthetic construct
  misc_feature 1..20: note = CRISPR gRNA sequence
  source 1..20: mol_type = other DNA
ttcagagaggtcaagtgact

SEQ ID NO: 7224 - DNA, 20 bp, synthetic construct
  misc_feature 1..20: note = CRISPR gRNA sequence
  source 1..20: mol_type = other DNA
agaggtcaagtgacttggct

SEQ ID NO: 7225 - DNA, 20 bp, synthetic construct
  misc_feature 1..20: note = CRISPR gRNA sequence
  source 1..20: mol_type = other DNA
gaggtcaagtgacttggcta

SEQ ID NO: 7226 - DNA, 20 bp, synthetic construct
  misc_feature 1..20: note = CRISPR gRNA sequence
  source 1..20: mol_type = other DNA
gtgacttggctaaggcatca

SEQ ID NO: 7227 - DNA, 20 bp, synthetic construct
  misc_feature 1..20: note = CRISPR gRNA sequence
  source 1..20: mol_type = other DNA
cttggctaaggcatcacagc

SEQ ID NO: 7228 - DNA, 20 bp, synthetic construct
  misc_feature 1..20: note = CRISPR gRNA sequence
  source 1..20: mol_type = other DNA
aaggcatcacagccagaatt

SEQ ID NO: 7229 - DNA, 20 bp, synthetic construct
  misc_feature 1..20: note = CRISPR gRNA sequence
  source 1..20: mol_type = other DNA
cacagccagaattcagatgc

SEQ ID NO: 7230 - DNA, 20 bp, synthetic construct
  misc_feature 1..20: note = CRISPR gRNA sequence
  source 1..20: mol_type = other DNA
gctcctaaaccacatgacct

SEQ ID NO: 7231 - DNA, 20 bp, synthetic construct
  misc_feature 1..20: note = CRISPR gRNA sequence
  source 1..20: mol_type = other DNA
taaaccacatgaccttggac

SEQ ID NO: 7232 - DNA, 20 bp, synthetic construct
  misc_feature 1..20: note = CRISPR gRNA sequence
  source 1..20: mol_type = other DNA
cttggacaagccatttcact

SEQ ID NO: 7233 - DNA, 20 bp, synthetic construct
  misc_feature 1..20: note = CRISPR gRNA sequence
  source 1..20: mol_type = other DNA
ttggacaagccatttcactg

SEQ ID NO: 7234 - DNA, 20 bp, synthetic construct
  misc_feature 1..20: note = CRISPR gRNA sequence
  source 1..20: mol_type = other DNA
gaggcgtgtgaacctcctct

SEQ ID NO: 7235 - DNA, 20 bp, synthetic construct
  misc_feature 1..20: note = CRISPR gRNA sequence
  source 1..20: mol_type = other DNA
gaacctcctctaagctcaaa

SEQ ID NO: 7236 - DNA, 20 bp, synthetic construct
  misc_feature 1..20: note = CRISPR gRNA sequence
  source 1..20: mol_type = other DNA
aacctcctctaagctcaaat

SEQ ID NO: 7237 - DNA, 20 bp, synthetic construct
  misc_feature 1..20: note = CRISPR gRNA sequence
  source 1..20: mol_type = other DNA
actctaccctgccttttccc

SEQ ID NO: 7238 - DNA, 20 bp, synthetic construct
  misc_feature 1..20: note = CRISPR gRNA sequence
  source 1..20: mol_type = other DNA
tctaccctgccttttcccca

SEQ ID NO: 7239 - DNA, 20 bp, synthetic construct
  misc_feature 1..20: note = CRISPR gRNA sequence
  source 1..20: mol_type = other DNA
gccttttccccagagctttt

SEQ ID NO: 7240 - DNA, 20 bp, synthetic construct
  misc_feature 1..20: note = CRISPR gRNA sequence
  source 1..20: mol_type = other DNA
ccttttccccagagcttttt

SEQ ID NO: 7241 - DNA, 20 bp, synthetic construct
  misc_feature 1..20: note = CRISPR gRNA sequence
  source 1..20: mol_type = other DNA
cccagagctttttgggaact

SEQ ID NO: 7242 - DNA, 20 bp, synthetic construct
  misc_feature 1..20: note = CRISPR gRNA sequence
  source 1..20: mol_type = other DNA
gagctttttgggaactcaga

SEQ ID NO: 7243 - DNA, 20 bp, synthetic construct
  misc_feature 1..20: note = CRISPR gRNA sequence
  source 1..20: mol_type = other DNA
ttttgggaactcagatggtg

SEQ ID NO: 7244 - DNA, 20 bp, synthetic construct
  misc_feature 1..20: note = CRISPR gRNA sequence
  source 1..20: mol_type = other DNA
ttgggaactcagatggtgtg

SEQ ID NO: 7245 - DNA, 20 bp, synthetic construct
  misc_feature 1..20: note = CRISPR gRNA sequence
  source 1..20: mol_type = other DNA
tgggaactcagatggtgtgg

SEQ ID NO: 7246 - DNA, 20 bp, synthetic construct
  misc_feature 1..20: note = CRISPR gRNA sequence
  source 1..20: mol_type = other DNA
aactcagatggtgtggagga

SEQ ID NO: 7247 - DNA, 20 bp, synthetic construct
  misc_feature 1..20: note = CRISPR gRNA sequence
  source 1..20: mol_type = other DNA
ctcagatggtgtggaggatg

SEQ ID NO: 7248 - DNA, 20 bp, synthetic construct
  misc_feature 1..20: note = CRISPR gRNA sequence
  source 1..20: mol_type = other DNA
tcagatggtgtggaggatgg

SEQ ID NO: 7249 - DNA, 20 bp, synthetic construct
  misc_feature 1..20: note = CRISPR gRNA sequence
  source 1..20: mol_type = other DNA
gatggtgtggaggatggagg

SEQ ID NO: 7250 - DNA, 20 bp, synthetic construct
  misc_feature 1..20: note = CRISPR gRNA sequence
  source 1..20: mol_type = other DNA
ggtgtggaggatggaggcag

SEQ ID NO: 7251 - DNA, 20 bp, synthetic construct
  misc_feature 1..20: note = CRISPR gRNA sequence
  source 1..20: mol_type = other DNA
tggaggcagaagtccactgt

SEQ ID NO: 7252 - DNA, 20 bp, synthetic construct
  misc_feature 1..20: note = CRISPR gRNA sequence
  source 1..20: mol_type = other DNA
ctgcaaatccttgatcaccc

SEQ ID NO: 7253 - DNA, 20 bp, synthetic construct
  misc_feature 1..20: note = CRISPR gRNA sequence
  source 1..20: mol_type = other DNA
gcaaatccttgatcacccaa

SEQ ID NO: 7254 - DNA, 20 bp, synthetic construct
  misc_feature 1..20: note = CRISPR gRNA sequence
  source 1..20: mol_type = other DNA
caaatccttgatcacccaag

SEQ ID NO: 7255 - DNA, 20 bp, synthetic construct
  misc_feature 1..20: note = CRISPR gRNA sequence
  source 1..20: mol_type = other DNA
atccttgatcacccaagagg

SEQ ID NO: 7256 - DNA, 20 bp, synthetic construct
  misc_feature 1..20: note = CRISPR gRNA sequence
  source 1..20: mol_type = other DNA
tcacccaagaggaagtgctt

SEQ ID NO: 7257 - DNA, 20 bp, synthetic construct
  misc_feature 1..20: note = CRISPR gRNA sequence
  source 1..20: mol_type = other DNA
cacccaagaggaagtgctta

SEQ ID NO: 7258 - DNA, 20 bp, synthetic construct
  misc_feature 1..20: note = CRISPR gRNA sequence
  source 1..20: mol_type = other DNA
aagaggaagtgcttaaggtg

SEQ ID NO: 7259 - DNA, 20 bp, synthetic construct
  misc_feature 1..20: note = CRISPR gRNA sequence
  source 1..20: mol_type = other DNA
agaggaagtgcttaaggtgc

SEQ ID NO: 7260 - DNA, 20 bp, synthetic construct
  misc_feature 1..20: note = CRISPR gRNA sequence
  source 1..20: mol_type = other DNA
agtgcttaaggtgcaggctt

SEQ ID NO: 7261 - DNA, 20 bp, synthetic construct
  misc_feature 1..20: note = CRISPR gRNA sequence
  source 1..20: mol_type = other DNA
taaggtgcaggcttcagtct

SEQ ID NO: 7262 - DNA, 20 bp, synthetic construct
  misc_feature 1..20: note = CRISPR gRNA sequence
  source 1..20: mol_type = other DNA
aaggtgcaggcttcagtctt

SEQ ID NO: 7263 - DNA, 20 bp, synthetic construct
  misc_feature 1..20: note = CRISPR gRNA sequence
  source 1..20: mol_type = other DNA
aggtgcaggcttcagtctta

SEQ ID NO: 7264 - DNA, 20 bp, synthetic construct
  misc_feature 1..20: note = CRISPR gRNA sequence
  source 1..20: mol_type = other DNA
tgcaggcttcagtcttaggg

SEQ ID NO: 7265 - DNA, 20 bp, synthetic construct
  misc_feature 1..20: note = CRISPR gRNA sequence
  source 1..20: mol_type = other DNA
aggcttcagtcttagggaag

SEQ ID NO: 7266 - DNA, 20 bp, synthetic construct
  misc_feature 1..20: note = CRISPR gRNA sequence
  source 1..20: mol_type = other DNA
ggcttcagtcttagggaagc

SEQ ID NO: 7267 - DNA, 20 bp, synthetic construct
  misc_feature 1..20: note = CRISPR gRNA sequence
  source 1..20: mol_type = other DNA
ttcagtcttagggaagcagg

SEQ ID NO: 7268 - DNA, 20 bp, synthetic construct
  misc_feature 1..20: note = CRISPR gRNA sequence
  source 1..20: mol_type = other DNA
agtcttagggaagcaggaag

SEQ ID NO: 7269 - DNA, 20 bp, synthetic construct
  misc_feature 1..20: note = CRISPR gRNA sequence
  source 1..20: mol_type = other DNA
gtcttagggaagcaggaagt

SEQ ID NO: 7270 - DNA, 20 bp, synthetic construct
  misc_feature 1..20: note = CRISPR gRNA sequence
  source 1..20: mol_type = other DNA
tcttagggaagcaggaagtg

SEQ ID NO: 7271 - DNA, 20 bp, synthetic construct
  misc_feature 1..20: note = CRISPR gRNA sequence
  source 1..20: mol_type = other DNA
tggggcgctgaaatgtgtat

SEQ ID NO: 7272 - DNA, 20 bp, synthetic construct
  misc_feature 1..20: note = CRISPR gRNA sequence
  source 1..20: mol_type = other DNA
ggggcgctgaaatgtgtatt

SEQ ID NO: 7273 - DNA, 20 bp, synthetic construct
  misc_feature 1..20: note = CRISPR gRNA sequence
  source 1..20: mol_type = other DNA
gggcgctgaaatgtgtattg

SEQ ID NO: 7274 - DNA, 20 bp, synthetic construct
  misc_feature 1..20: note = CRISPR gRNA sequence
  source 1..20: mol_type = other DNA
ggcgctgaaatgtgtattgg

SEQ ID NO: 7275 - DNA, 20 bp, synthetic construct
  misc_feature 1..20: note = CRISPR gRNA sequence
  source 1..20: mol_type = other DNA
aaatgtgtattgggggcttc

SEQ ID NO: 7276 - DNA, 20 bp, synthetic construct
  misc_feature 1..20: note = CRISPR gRNA sequence
  source 1..20: mol_type = other DNA
aatgtgtattgggggcttct

SEQ ID NO: 7277 - DNA, 20 bp, synthetic construct
  misc_feature 1..20: note = CRISPR gRNA sequence
  source 1..20: mol_type = other DNA
tgtgtattgggggcttctgg

SEQ ID NO: 7278 - DNA, 20 bp, synthetic construct
  misc_feature 1..20: note = CRISPR gRNA sequence
  source 1..20: mol_type = other DNA
gtgtattgggggcttctggg

SEQ ID NO: 7279 - DNA, 20 bp, synthetic construct
  misc_feature 1..20: note = CRISPR gRNA sequence
  source 1..20: mol_type = other DNA
tgtattgggggcttctggga

SEQ ID NO: 7280 - DNA, 20 bp, synthetic construct
  misc_feature 1..20: note = CRISPR gRNA sequence
  source 1..20: mol_type = other DNA
gtattgggggcttctgggag

SEQ ID NO: 7281 - DNA, 20 bp, synthetic construct
  misc_feature 1..20: note = CRISPR gRNA sequence
  source 1..20: mol_type = other DNA
tattgggggcttctgggagg

SEQ ID NO: 7282 - DNA, 20 bp, synthetic construct
  misc_feature 1..20: note = CRISPR gRNA sequence
  source 1..20: mol_type = other DNA
ggagggggtttcttcttgtc

SEQ ID NO: 7283 - DNA, 20 bp, synthetic construct
  misc_feature 1..20: note = CRISPR gRNA sequence
  source 1..20: mol_type = other DNA
gagggggtttcttcttgtcc

SEQ ID NO: 7284 - DNA, 20 bp, synthetic construct
  misc_feature 1..20: note = CRISPR gRNA sequence
  source 1..20: mol_type = other DNA
ggtttcttcttgtccaggtt

SEQ ID NO: 7285 - DNA, 20 bp, synthetic construct
  misc_feature 1..20: note = CRISPR gRNA sequence
  source 1..20: mol_type = other DNA
tccaggttgagccaatgacg

SEQ ID NO: 7286 - DNA, 20 bp, synthetic construct
  misc_feature 1..20: note = CRISPR gRNA sequence
  source 1..20: mol_type = other DNA
tgagccaatgacgcagatct

SEQ ID NO: 7287 - DNA, 20 bp, synthetic construct
  misc_feature 1..20: note = CRISPR gRNA sequence
  source 1..20: mol_type = other DNA
gagccaatgacgcagatctt

SEQ ID NO: 7288 - DNA, 20 bp, synthetic construct
  misc_feature 1..20: note = CRISPR gRNA sequence
  source 1..20: mol_type = other DNA
gacgcagatcttaggccctc

SEQ ID NO: 7289 - DNA, 20 bp, synthetic construct
  misc_feature 1..20: note = CRISPR gRNA sequence
  source 1..20: mol_type = other DNA
ccctctggtgactttttgcc

SEQ ID NO: 7290 - DNA, 20 bp, synthetic construct
  misc_feature 1..20: note = CRISPR gRNA sequence
  source 1..20: mol_type = other DNA
cctctggtgactttttgccc

SEQ ID NO: 7291 - DNA, 20 bp, synthetic construct
  misc_feature 1..20: note = CRISPR gRNA sequence
  source 1..20: mol_type = other DNA
tttttgcccaggcaacttct

SEQ ID NO: 7292 - DNA, 20 bp, synthetic construct
  misc_feature 1..20: note = CRISPR gRNA sequence
  source 1..20: mol_type = other DNA
ttgcccaggcaacttctcag

SEQ ID NO: 7293 - DNA, 20 bp, synthetic construct
  misc_feature 1..20: note = CRISPR gRNA sequence
  source 1..20: mol_type = other DNA
cccaggcaacttctcagtgg

SEQ ID NO: 7294 - DNA, 20 bp, synthetic construct
  misc_feature 1..20: note = CRISPR gRNA sequence
  source 1..20: mol_type = other DNA
caacttctcagtggtggtga

SEQ ID NO: 7295 - DNA, 20 bp, synthetic construct
  misc_feature 1..20: note = CRISPR gRNA sequence
  source 1..20: mol_type = other DNA
aacttctcagtggtggtgat

SEQ ID NO: 7296 - DNA, 20 bp, synthetic construct
  misc_feature 1..20: note = CRISPR gRNA sequence
  source 1..20: mol_type = other DNA
acttctcagtggtggtgatg

SEQ ID NO: 7297 - DNA, 20 bp, synthetic construct
  misc_feature 1..20: note = CRISPR gRNA sequence
  source 1..20: mol_type = other DNA
ttctcagtggtggtgatggg

SEQ ID NO: 7298 - DNA, 20 bp, synthetic construct
  misc_feature 1..20: note = CRISPR gRNA sequence
  source 1..20: mol_type = other DNA
agtggtggtgatggggagcg

SEQ ID NO: 7299 - DNA, 20 bp, synthetic construct
  misc_feature 1..20: note = CRISPR gRNA sequence
  source 1..20: mol_type = other DNA
gtggtgatggggagcgtggc

SEQ ID NO: 7300 - DNA, 20 bp, synthetic construct
  misc_feature 1..20: note = CRISPR gRNA sequence
  source 1..20: mol_type = other DNA
ggagcgtggccagaccatcc

SEQ ID NO: 7301 - DNA, 20 bp, synthetic construct
  misc_feature 1..20: note = CRISPR gRNA sequence
  source 1..20: mol_type = other DNA
gaccatccaagctgccctgc

SEQ ID NO: 7302 - DNA, 20 bp, synthetic construct
  misc_feature 1..20: note = CRISPR gRNA sequence
  source 1..20: mol_type = other DNA
ccaagctgccctgctggctg

SEQ ID NO: 7303 - DNA, 20 bp, synthetic construct
  misc_feature 1..20: note = CRISPR gRNA sequence
  source 1..20: mol_type = other DNA
caagctgccctgctggctgt

SEQ ID NO: 7304 - DNA, 20 bp, synthetic construct
  misc_feature 1..20: note = CRISPR gRNA sequence
  source 1..20: mol_type = other DNA
aagctgccctgctggctgtg

SEQ ID NO: 7305 - DNA, 20 bp, synthetic construct
  misc_feature 1..20: note = CRISPR gRNA sequence
  source 1..20: mol_type = other DNA
agctgccctgctggctgtgg

SEQ ID NO: 7306 - DNA, 20 bp, synthetic construct
  misc_feature 1..20: note = CRISPR gRNA sequence
  source 1..20: mol_type = other DNA
ggggccttttttttttttct

SEQ ID NO: 7307 - DNA, 20 bp, synthetic construct
  misc_feature 1..20: note = CRISPR gRNA sequence
  source 1..20: mol_type = other DNA
ttttttttttttctgagaca

SEQ ID NO: 7308 - DNA, 20 bp, synthetic construct
  misc_feature 1..20: note = CRISPR gRNA sequence
  source 1..20: mol_type = other DNA
tttttttctgagacacagtc

SEQ ID NO: 7309 - DNA, 20 bp, synthetic construct
  misc_feature 1..20: note = CRISPR gRNA sequence
  source 1..20: mol_type = other DNA
cacagtctggctctatcacc

SEQ ID NO: 7310 - DNA, 20 bp, synthetic construct
  misc_feature 1..20: note = CRISPR gRNA sequence
  source 1..20: mol_type = other DNA
acagtctggctctatcaccc

SEQ ID NO: 7311 - DNA, 20 bp, synthetic construct
  misc_feature 1..20: note = CRISPR gRNA sequence
  source 1..20: mol_type = other DNA
tctggctctatcacccaggc

SEQ ID NO: 7312 - DNA, 20 bp, synthetic construct
  misc_feature 1..20: note = CRISPR gRNA sequence
  source 1..20: mol_type = other DNA
tggctctatcacccaggctg

SEQ ID NO: 7313 - DNA, 20 bp, synthetic construct
  misc_feature 1..20: note = CRISPR gRNA sequence
  source 1..20: mol_type = other DNA
ctatcacccaggctggagtg

SEQ ID NO: 7314 - DNA, 20 bp, synthetic construct
  misc_feature 1..20: note = CRISPR gRNA sequence
  source 1..20: mol_type = other DNA
tcacccaggctggagtgcag

SEQ ID NO: 7315 - DNA, 20 bp, synthetic construct
  misc_feature 1..20: note = CRISPR gRNA sequence
  source 1..20: mol_type = other DNA
ggagtgcagtggtgcaatct

SEQ ID NO: 7316 - DNA, 20 bp, synthetic construct
  misc_feature 1..20: note = CRISPR gRNA sequence
  source 1..20: mol_type = other DNA
ggtgcaatctcagttcactg

SEQ ID NO: 7317 - DNA, 20 bp, synthetic construct
  misc_feature 1..20: note = CRISPR gRNA sequence
  source 1..20: mol_type = other DNA
ctgcagccttgacacctccc

SEQ ID NO: 7318 - DNA, 20 bp, synthetic construct
  misc_feature 1..20: note = CRISPR gRNA sequence
  source 1..20: mol_type = other DNA
tgcagccttgacacctcccc

SEQ ID NO: 7319 - DNA, 20 bp, synthetic construct
  misc_feature 1..20: note = CRISPR gRNA sequence
  source 1..20: mol_type = other DNA
cttgacacctccccaggctc

SEQ ID NO: 7320 - DNA, 20 bp, synthetic construct
  misc_feature 1..20: note = CRISPR gRNA sequence
  source 1..20: mol_type = other DNA
ctcaagctatcctcccacct

SEQ ID NO: 7321 - DNA, 20 bp, synthetic construct
  misc_feature 1..20: note = CRISPR gRNA sequence
  source 1..20: mol_type = other DNA
tcctcccacctcagcctcct

SEQ ID NO: 7322 - DNA, 20 bp, synthetic construct
  misc_feature 1..20: note = CRISPR gRNA sequence
  source 1..20: mol_type = other DNA
tcccacctcagcctcctgag

SEQ ID NO: 7323 - DNA, 20 bp, synthetic construct
  misc_feature 1..20: note = CRISPR gRNA sequence
  source 1..20: mol_type = other DNA
acctcagcctcctgagtagc

SEQ ID NO: 7324 - DNA, 20 bp, synthetic construct
  misc_feature 1..20: note = CRISPR gRNA sequence
  source 1..20: mol_type = other DNA
ctcctgagtagctggttcta

SEQ ID NO: 7325 - DNA, 20 bp, synthetic construct
  misc_feature 1..20: note = CRISPR gRNA sequence
  source 1..20: mol_type = other DNA
cagatgcacatcaccacgcc

SEQ ID NO: 7326 - DNA, 20 bp, synthetic construct
  misc_feature 1..20: note = CRISPR gRNA sequence
  source 1..20: mol_type = other DNA
gcacatcaccacgcccagct

SEQ ID NO: 7327 - DNA, 20 bp, synthetic construct
  misc_feature 1..20: note = CRISPR gRNA sequence
  source 1..20: mol_type = other DNA
gctaagttttgtgttatttg

SEQ ID NO: 7328 - DNA, 20 bp, synthetic construct
  misc_feature 1..20: note = CRISPR gRNA sequence
  source 1..20: mol_type = other DNA
taagttttgtgttatttgta

SEQ ID NO: 7329 - DNA, 20 bp, synthetic construct
  misc_feature 1..20: note = CRISPR gRNA sequence
  source 1..20: mol_type = other DNA
ttttgtgttatttgtagaga

SEQ ID NO: 7330 - DNA, 20 bp, synthetic construct
  misc_feature 1..20: note = CRISPR gRNA sequence
  source 1..20: mol_type = other DNA
tttgtgttatttgtagagat

SEQ ID NO: 7331 - DNA, 20 bp, synthetic construct
  misc_feature 1..20: note = CRISPR gRNA sequence
  source 1..20: mol_type = other DNA
ttgtgttatttgtagagata

SEQ ID NO: 7332 - DNA, 20 bp, synthetic construct
  misc_feature 1..20: note = CRISPR gRNA sequence
  source 1..20: mol_type = other DNA
tagggcttcaccatgttgcc

SEQ ID NO: 7333 - DNA, 20 bp, synthetic construct
  misc_feature 1..20: note = CRISPR gRNA sequence
  source 1..20: mol_type = other DNA
agggcttcaccatgttgccc

SEQ ID NO: 7334 - DNA, 20 bp, synthetic construct
  misc_feature 1..20: note = CRISPR gRNA sequence
  source 1..20: mol_type = other DNA
cttcaccatgttgcccaggc

SEQ ID NO: 7335 - DNA, 20 bp, synthetic construct
  misc_feature 1..20: note = CRISPR gRNA sequence
  source 1..20: mol_type = other DNA
ccaggctggtctcaaactcc

SEQ ID NO: 7336 - DNA, 20 bp, synthetic construct
  misc_feature 1..20: note = CRISPR gRNA sequence
  source 1..20: mol_type = other DNA
tggtctcaaactcctggact

SEQ ID NO: 7337 - DNA, 20 bp, synthetic construct
  misc_feature 1..20: note = CRISPR gRNA sequence
  source 1..20: mol_type = other DNA
ggtctcaaactcctggactg

SEQ ID NO: 7338 - DNA, 20 bp, synthetic construct
  misc_feature 1..20: note = CRISPR gRNA sequence
  source 1..20: mol_type = other DNA
ctgaggtgatactcctgcct

SEQ ID NO: 7339 - DNA, 20 bp, synthetic construct
  misc_feature 1..20: note = CRISPR gRNA sequence
  source 1..20: mol_type = other DNA
actcctgccttggactccca

SEQ ID NO: 7340 - DNA, 20 bp, synthetic construct
  misc_feature 1..20: note = CRISPR gRNA sequence
  source 1..20: mol_type = other DNA
gccttggactcccaaagtgc

SEQ ID NO: 7341 - DNA, 20 bp, synthetic construct
  misc_feature 1..20: note = CRISPR gRNA sequence
  source 1..20: mol_type = other DNA
ccaaagtgctggaatttcta

SEQ ID NO: 7342 - DNA, 20 bp, synthetic construct
  misc_feature 1..20: note = CRISPR gRNA sequence
  source 1..20: mol_type = other DNA
gctggaatttctacagatgt

SEQ ID NO: 7343 - DNA, 20 bp, synthetic construct
  misc_feature 1..20: note = CRISPR gRNA sequence
  source 1..20: mol_type = other DNA
cagatgtgagccaccatgcc

SEQ ID NO: 7344 - DNA, 20 bp, synthetic construct
  misc_feature 1..20: note = CRISPR gRNA sequence
  source 1..20: mol_type = other DNA
gagccaccatgcccggccta

SEQ ID NO: 7345 - DNA, 20 bp, synthetic construct
  misc_feature 1..20: note = CRISPR gRNA sequence
  source 1..20: mol_type = other DNA
agccaccatgcccggcctat

SEQ ID NO: 7346 - DNA, 20 bp, synthetic construct
  misc_feature 1..20: note = CRISPR gRNA sequence
  source 1..20: mol_type = other DNA
gccaccatgcccggcctatg

SEQ ID NO: 7347 - DNA, 20 bp, synthetic construct
  misc_feature 1..20: note = CRISPR gRNA sequence
  source 1..20: mol_type = other DNA
gggcccttcttgttcctatg

SEQ ID NO: 7348 - DNA, 20 bp, synthetic construct
  misc_feature 1..20: note = CRISPR gRNA sequence
  source 1..20: mol_type = other DNA
tcttgttcctatgaagtctg

SEQ ID NO: 7349 - DNA, 20 bp, synthetic construct
  misc_feature 1..20: note = CRISPR gRNA sequence
  source 1..20: mol_type = other DNA
cttgttcctatgaagtctgc

SEQ ID NO: 7350 - DNA, 20 bp, synthetic construct
  misc_feature 1..20: note = CRISPR gRNA sequence
  source 1..20: mol_type = other DNA
ttgttcctatgaagtctgca

SEQ ID NO: 7351 - DNA, 20 bp, synthetic construct
  misc_feature 1..20: note = CRISPR gRNA sequence
  source 1..20: mol_type = other DNA
tgcagggtccccttatgcaa

SEQ ID NO: 7352 - DNA, 20 bp, synthetic construct
  misc_feature 1..20: note = CRISPR gRNA sequence
  source 1..20: mol_type = other DNA
ggtccccttatgcaaaagaa

SEQ ID NO: 7353 - DNA, 20 bp, synthetic construct
  misc_feature 1..20: note = CRISPR gRNA sequence
  source 1..20: mol_type = other DNA
cccttatgcaaaagaacaga

SEQ ID NO: 7354 - DNA, 20 bp, synthetic construct
  misc_feature 1..20: note = CRISPR gRNA sequence
  source 1..20: mol_type = other DNA
atgcaaaagaacagaaagct

SEQ ID NO: 7355 - DNA, 20 bp, synthetic construct
  misc_feature 1..20: note = CRISPR gRNA sequence
  source 1..20: mol_type = other DNA
acagaaagctcggcttcaca

SEQ ID NO: 7356 - DNA, 20 bp, synthetic construct
  misc_feature 1..20: note = CRISPR gRNA sequence
  source 1..20: mol_type = other DNA
ggcttcacaaagtttgacct

SEQ ID NO: 7357 - DNA, 20 bp, synthetic construct
  misc_feature 1..20: note = CRISPR gRNA sequence
  source 1..20: mol_type = other DNA
ttcacaaagtttgacctcgg

SEQ ID NO: 7358 - DNA, 20 bp, synthetic construct
  misc_feature 1..20: note = CRISPR gRNA sequence
  source 1..20: mol_type = other DNA
aagtttgacctcggaagaaa

SEQ ID NO: 7359 - DNA, 20 bp, synthetic construct
  misc_feature 1..20: note = CRISPR gRNA sequence
  source 1..20: mol_type = other DNA
tttgacctcggaagaaatgg

SEQ ID NO: 7360 - DNA, 20 bp, synthetic construct
  misc_feature 1..20: note = CRISPR gRNA sequence
  source 1..20: mol_type = other DNA
ttgacctcggaagaaatgga

SEQ ID NO: 7361 - DNA, 20 bp, synthetic construct
  misc_feature 1..20: note = CRISPR gRNA sequence
  source 1..20: mol_type = other DNA
tgacctcggaagaaatggaa

SEQ ID NO: 7362 - DNA, 20 bp, synthetic construct
  misc_feature 1..20: note = CRISPR gRNA sequence
  source 1..20: mol_type = other DNA
ctcggaagaaatggaaggga

SEQ ID NO: 7363 - DNA, 20 bp, synthetic construct
  misc_feature 1..20: note = CRISPR gRNA sequence
  source 1..20: mol_type = other DNA
tcggaagaaatggaagggaa

SEQ ID NO: 7364 - DNA, 20 bp, synthetic construct
  misc_feature 1..20: note = CRISPR gRNA sequence
  source 1..20: mol_type = other DNA
cggaagaaatggaagggaaa

SEQ ID NO: 7365 - DNA, 20 bp, synthetic construct
  misc_feature 1..20: note = CRISPR gRNA sequence
  source 1..20: mol_type = other DNA
tttgtcactctcacaaacgt

SEQ ID NO: 7366 - DNA, 20 bp, synthetic construct
  misc_feature 1..20: note = CRISPR gRNA sequence
  source 1..20: mol_type = other DNA
gtcactctcacaaacgtaag

SEQ ID NO: 7367 - DNA, 20 bp, synthetic construct
  misc_feature 1..20: note = CRISPR gRNA sequence
  source 1..20: mol_type = other DNA
aagaagcaaactaataatga

SEQ ID NO: 7368 - DNA, 20 bp, synthetic construct
  misc_feature 1..20: note = CRISPR gRNA sequence
  source 1..20: mol_type = other DNA
cacatattatactcaccatg

SEQ ID NO: 7369 - DNA, 20 bp, synthetic construct
  misc_feature 1..20: note = CRISPR gRNA sequence
  source 1..20: mol_type = other DNA
atattatactcaccatgtag

SEQ ID NO: 7370 - DNA, 20 bp, synthetic construct
  misc_feature 1..20: note = CRISPR gRNA sequence
  source 1..20: mol_type = other DNA
gccttaaacttctgttcatt

SEQ ID NO: 7371 - DNA, 20 bp, synthetic construct
  misc_feature 1..20: note = CRISPR gRNA sequence
  source 1..20: mol_type = other DNA
attcagcacttactgattgc

SEQ ID NO: 7372 - DNA, 20 bp, synthetic construct
  misc_feature 1..20: note = CRISPR gRNA sequence
  source 1..20: mol_type = other DNA
tgattgccagtcccattgct

SEQ ID NO: 7373 - DNA, 20 bp, synthetic construct
  misc_feature 1..20: note = CRISPR gRNA sequence
  source 1..20: mol_type = other DNA
gattgccagtcccattgcta

SEQ ID NO: 7374 - DNA, 20 bp, synthetic construct
  misc_feature 1..20: note = CRISPR gRNA sequence
  source 1..20: mol_type = other DNA
attgccagtcccattgctaa

SEQ ID NO: 7375 - DNA, 20 bp, synthetic construct
  misc_feature 1..20: note = CRISPR gRNA sequence
  source 1..20: mol_type = other DNA
ttaactcccctaatccttgt

SEQ ID NO: 7376 - DNA, 20 bp, synthetic construct
  misc_feature 1..20: note = CRISPR gRNA sequence
  source 1..20: mol_type = other DNA
caattattattcgcatttta

SEQ ID NO: 7377 - DNA, 20 bp, synthetic construct
  misc_feature 1..20: note = CRISPR gRNA sequence
  source 1..20: mol_type = other DNA
ttattcgcattttatagata

SEQ ID NO: 7378 - DNA, 20 bp, synthetic construct
  misc_feature 1..20: note = CRISPR gRNA sequence
  source 1..20: mol_type = other DNA
attttatagatatggaaact

SEQ ID NO: 7379 - DNA, 20 bp, synthetic construct
  misc_feature 1..20: note = CRISPR gRNA sequence
  source 1..20: mol_type = other DNA
ttttatagatatggaaactg

SEQ ID NO: 7380 - DNA, 20 bp, synthetic construct
  misc_feature 1..20: note = CRISPR gRNA sequence
  source 1..20: mol_type = other DNA
gatatggaaactgaggctcc

SEQ ID NO: 7381 - DNA, 20 bp, synthetic construct
  misc_feature 1..20: note = CRISPR gRNA sequence
  source 1..20: mol_type = other DNA
atggaaactgaggctccaag

SEQ ID NO: 7382 - DNA, 20 bp, synthetic construct
  misc_feature 1..20: note = CRISPR gRNA sequence
  source 1..20: mol_type = other DNA
gtttaaaaaatgaacttgcc

SEQ ID NO: 7383 - DNA, 20 bp, synthetic construct
  misc_feature 1..20: note = CRISPR gRNA sequence
  source 1..20: mol_type = other DNA
tttaaaaaatgaacttgccc

SEQ ID NO: 7384 - DNA, 20 bp, synthetic construct
  misc_feature 1..20: note = CRISPR gRNA sequence
  source 1..20: mol_type = other DNA
aaatgaacttgcccaggtta

SEQ ID NO: 7385 - DNA, 20 bp, synthetic construct
  misc_feature 1..20: note = CRISPR gRNA sequence
  source 1..20: mol_type = other DNA
ttgcccaggttacagtgtgt

SEQ ID NO: 7386 - DNA, 20 bp, synthetic construct
  misc_feature 1..20: note = CRISPR gRNA sequence
  source 1..20: mol_type = other DNA
cccaggttacagtgtgttgg

SEQ ID NO: 7387 - DNA, 20 bp, synthetic construct
  misc_feature 1..20: note = CRISPR gRNA sequence
  source 1..20: mol_type = other DNA
ccaggttacagtgtgttggt

SEQ ID NO: 7388 - DNA, 20 bp, synthetic construct
  misc_feature 1..20: note = CRISPR gRNA sequence
  source 1..20: mol_type = other DNA
ggttacagtgtgttggtagg

SEQ ID NO: 7389 - DNA, 20 bp, synthetic construct
  misc_feature 1..20: note = CRISPR gRNA sequence
  source 1..20: mol_type = other DNA
gttacagtgtgttggtaggt

SEQ ID NO: 7390 - DNA, 20 bp, synthetic construct
  misc_feature 1..20: note = CRISPR gRNA sequence
  source 1..20: mol_type = other DNA
ttacagtgtgttggtaggta

SEQ ID NO: 7391 - DNA, 20 bp, synthetic construct
  misc_feature 1..20: note = CRISPR gRNA sequence
  source 1..20: mol_type = other DNA
tacagtgtgttggtaggtag

SEQ ID NO: 7392 - DNA, 20 bp, synthetic construct
  misc_feature 1..20: note = CRISPR gRNA sequence
  source 1..20: mol_type = other DNA
agtgtgttggtaggtagggg

SEQ ID NO: 7393 - DNA, 20 bp, synthetic construct
  misc_feature 1..20: note = CRISPR gRNA sequence
  source 1..20: mol_type = other DNA
ggtaggtaggggtagtctca

SEQ ID NO: 7394 - DNA, 20 bp, synthetic construct
  misc_feature 1..20: note = CRISPR gRNA sequence
  source 1..20: mol_type = other DNA
ggtaggggtagtctcaaagt

SEQ ID NO: 7395 - DNA, 20 bp, synthetic construct
  misc_feature 1..20: note = CRISPR gRNA sequence
  source 1..20: mol_type = other DNA
agttggtaaattttacgcca

SEQ ID NO: 7396 - DNA, 20 bp, synthetic construct
  misc_feature 1..20: note = CRISPR gRNA sequence
  source 1..20: mol_type = other DNA
tgactgtgtgcttaaccaca

SEQ ID NO: 7397 - DNA, 20 bp, synthetic construct
  misc_feature 1..20: note = CRISPR gRNA sequence
  source 1..20: mol_type = other DNA
ctgtgtgcttaaccacacag

SEQ ID NO: 7398 - DNA, 20 bp, synthetic construct
  misc_feature 1..20: note = CRISPR gRNA sequence
  source 1..20: mol_type = other DNA
aaccacacagcagtgtcatc

SEQ ID NO: 7399 - DNA, 20 bp, synthetic construct
  misc_feature 1..20: note = CRISPR gRNA sequence
  source 1..20: mol_type = other DNA
ccacacagcagtgtcatcca

SEQ ID NO: 7400 - DNA, 20 bp, synthetic construct
  misc_feature 1..20: note = CRISPR gRNA sequence
  source 1..20: mol_type = other DNA
gcagtgtcatccagagtttg

SEQ ID NO: 7401 - DNA, 20 bp, synthetic construct
  misc_feature 1..20: note = CRISPR gRNA sequence
  source 1..20: mol_type = other DNA
gtgtcatccagagtttgaag

SEQ ID NO: 7402 - DNA, 20 bp, synthetic construct
  misc_feature 1..20: note = CRISPR gRNA sequence
  source 1..20: mol_type = other DNA
gtcatccagagtttgaagca

SEQ ID NO: 7403 - DNA, 20 bp, synthetic construct
  misc_feature 1..20: note = CRISPR gRNA sequence
  source 1..20: mol_type = other DNA
ttgaagcagagctcatcaat

SEQ ID NO: 7404 - DNA, 20 bp, synthetic construct
  misc_feature 1..20: note = CRISPR gRNA sequence
  source 1..20: mol_type = other DNA
aagcagagctcatcaataag

SEQ ID NO: 7405 - DNA, 20 bp, synthetic construct
  misc_feature 1..20: note = CRISPR gRNA sequence
  source 1..20: mol_type = other DNA
agcagagctcatcaataagt

SEQ ID NO: 7406 - DNA, 20 bp, synthetic construct
  misc_feature 1..20: note = CRISPR gRNA sequence
  source 1..20: mol_type = other DNA
gcagagctcatcaataagtg

SEQ ID NO: 7407 - DNA, 20 bp, synthetic construct
  misc_feature 1..20: note = CRISPR gRNA sequence
  source 1..20: mol_type = other DNA
cagagctcatcaataagtgg

SEQ ID NO: 7408 - DNA, 20 bp, synthetic construct
  misc_feature 1..20: note = CRISPR gRNA sequence
  source 1..20: mol_type = other DNA
agctcatcaataagtggggg

SEQ ID NO: 7409 - DNA, 20 bp, synthetic construct
  misc_feature 1..20: note = CRISPR gRNA sequence
  source 1..20: mol_type = other DNA
gctcatcaataagtgggggt

SEQ ID NO: 7410 - DNA, 20 bp, synthetic construct
  misc_feature 1..20: note = CRISPR gRNA sequence
  source 1..20: mol_type = other DNA
gggggtgggctaaatgtctc

SEQ ID NO: 7411 - DNA, 20 bp, synthetic construct
  misc_feature 1..20: note = CRISPR gRNA sequence
  source 1..20: mol_type = other DNA
ggggtgggctaaatgtctcc

SEQ ID NO: 7412 - DNA, 20 bp, synthetic construct
  misc_feature 1..20: note = CRISPR gRNA sequence
  source 1..20: mol_type = other DNA
tgtctccaggctcctccctg

SEQ ID NO: 7413 - DNA, 20 bp, synthetic construct
  misc_feature 1..20: note = CRISPR gRNA sequence
  source 1..20: mol_type = other DNA
ccacctgtgtctctatgctt

SEQ ID NO: 7414 - DNA, 20 bp, synthetic construct
  misc_feature 1..20: note = CRISPR gRNA sequence
  source 1..20: mol_type = other DNA
tgtgtctctatgcttgagcc

SEQ ID NO: 7415 - DNA, 20 bp, synthetic construct
  misc_feature 1..20: note = CRISPR gRNA sequence
  source 1..20: mol_type = other DNA
tctctatgcttgagcccaga

SEQ ID NO: 7416 - DNA, 20 bp, synthetic construct
  misc_feature 1..20: note = CRISPR gRNA sequence
  source 1..20: mol_type = other DNA
ctctatgcttgagcccagac

SEQ ID NO: 7417 - DNA, 20 bp, synthetic construct
  misc_feature 1..20: note = CRISPR gRNA sequence
  source 1..20: mol_type = other DNA
tgcttgagcccagacaggac

SEQ ID NO: 7418 - DNA, 20 bp, synthetic construct
  misc_feature 1..20: note = CRISPR gRNA sequence
  source 1..20: mol_type = other DNA
gcttgagcccagacaggaca

SEQ ID NO: 7419 - DNA, 20 bp, synthetic construct
  misc_feature 1..20: note = CRISPR gRNA sequence
  source 1..20: mol_type = other DNA
cttgagcccagacaggacaa

SEQ ID NO: 7420 - DNA, 20 bp, synthetic construct
  misc_feature 1..20: note = CRISPR gRNA sequence
  source 1..20: mol_type = other DNA
gacaagggtgatcatttcat

SEQ ID NO: 7421 - DNA, 20 bp, synthetic construct
  misc_feature 1..20: note = CRISPR gRNA sequence
  source 1..20: mol_type = other DNA
acaagggtgatcatttcatt

SEQ ID NO: 7422 - DNA, 20 bp, synthetic construct
  misc_feature 1..20: note = CRISPR gRNA sequence
  source 1..20: mol_type = other DNA
ttcattgggaacattttgac

SEQ ID NO: 7423 - DNA, 20 bp, synthetic construct
  misc_feature 1..20: note = CRISPR gRNA sequence
  source 1..20: mol_type = other DNA
tcattgggaacattttgact

SEQ ID NO: 7424 - DNA, 20 bp, synthetic construct
  misc_feature 1..20: note = CRISPR gRNA sequence
  source 1..20: mol_type = other DNA
cattgggaacattttgactg

SEQ ID NO: 7425 - DNA, 20 bp, synthetic construct
  misc_feature 1..20: note = CRISPR gRNA sequence
  source 1..20: mol_type = other DNA
attgggaacattttgactgg

SEQ ID NO: 7426 - DNA, 20 bp, synthetic construct
  misc_feature 1..20: note = CRISPR gRNA sequence
  source 1..20: mol_type = other DNA
ttgggaacattttgactggg

SEQ ID NO: 7427 - DNA, 20 bp, synthetic construct
  misc_feature 1..20: note = CRISPR gRNA sequence
  source 1..20: mol_type = other DNA
gaacattttgactgggggga

SEQ ID NO: 7428 - DNA, 20 bp, synthetic construct
  misc_feature 1..20: note = CRISPR gRNA sequence
  source 1..20: mol_type = other DNA
acattttgactggggggaaa

SEQ ID NO: 7429 - DNA, 20 bp, synthetic construct
  misc_feature 1..20: note = CRISPR gRNA sequence
  source 1..20: mol_type = other DNA
tgactggggggaaagagcac

SEQ ID NO: 7430 - DNA, 20 bp, synthetic construct
  misc_feature 1..20: note = CRISPR gRNA sequence
  source 1..20: mol_type = other DNA
ggggggaaagagcaccagcc

SEQ ID NO: 7431 - DNA, 20 bp, synthetic construct
  misc_feature 1..20: note = CRISPR gRNA sequence
  source 1..20: mol_type = other DNA
gggggaaagagcaccagcct

SEQ ID NO: 7432 - DNA, 20 bp, synthetic construct
  misc_feature 1..20: note = CRISPR gRNA sequence
  source 1..20: mol_type = other DNA
gggaaagagcaccagcctgg

SEQ ID NO: 7433 - DNA, 20 bp, synthetic construct
  misc_feature 1..20: note = CRISPR gRNA sequence
  source 1..20: mol_type = other DNA
gagcaccagcctgggagtct

SEQ ID NO: 7434 - DNA, 20 bp, synthetic construct
  misc_feature 1..20: note = CRISPR gRNA sequence
  source 1..20: mol_type = other DNA
caccagcctgggagtcttgg

SEQ ID NO: 7435 - DNA, 20 bp, synthetic construct
  misc_feature 1..20: note = CRISPR gRNA sequence
  source 1..20: mol_type = other DNA
accagcctgggagtcttggc

SEQ ID NO: 7436 - DNA, 20 bp, synthetic construct
  misc_feature 1..20: note = CRISPR gRNA sequence
  source 1..20: mol_type = other DNA
ccagcctgggagtcttggca

SEQ ID NO: 7437 - DNA, 20 bp, synthetic construct
  misc_feature 1..20: note = CRISPR gRNA sequence
  source 1..20: mol_type = other DNA
cagcctgggagtcttggcag

SEQ ID NO: 7438 - DNA, 20 bp, synthetic construct
  misc_feature 1..20: note = CRISPR gRNA sequence
  source 1..20: mol_type = other DNA
agcctgggagtcttggcagg

SEQ ID NO: 7439 - DNA, 20 bp, synthetic construct
  misc_feature 1..20: note = CRISPR gRNA sequence
  source 1..20: mol_type = other DNA
cctgggagtcttggcagggg

SEQ ID NO: 7440 - DNA, 20 bp, synthetic construct
  misc_feature 1..20: note = CRISPR gRNA sequence
  source 1..20: mol_type = other DNA
gggagtcttggcagggggag

SEQ ID NO: 7441 - DNA, 20 bp, synthetic construct
  misc_feature 1..20: note = CRISPR gRNA sequence
  source 1..20: mol_type = other DNA
ggagtcttggcagggggagt

SEQ ID NO: 7442 - DNA, 20 bp, synthetic construct
  misc_feature 1..20: note = CRISPR gRNA sequence
  source 1..20: mol_type = other DNA
gagtcttggcagggggagtg

SEQ ID NO: 7443 - DNA, 20 bp, synthetic construct
  misc_feature 1..20: note = CRISPR gRNA sequence
  source 1..20: mol_type = other DNA
agtcttggcagggggagtgg

SEQ ID NO: 7444 - DNA, 20 bp, synthetic construct
  misc_feature 1..20: note = CRISPR gRNA sequence
  source 1..20: mol_type = other DNA
tcttggcagggggagtgggg

SEQ ID NO: 7445 - DNA, 20 bp, synthetic construct
  misc_feature 1..20: note = CRISPR gRNA sequence
  source 1..20: mol_type = other DNA
tggcagggggagtgggggag

SEQ ID NO: 7446 - DNA, 20 bp, synthetic construct
  misc_feature 1..20: note = CRISPR gRNA sequence
  source 1..20: mol_type = other DNA
ggcagggggagtgggggaga

SEQ ID NO: 7447 - DNA, 20 bp, synthetic construct
  misc_feature 1..20: note = CRISPR gRNA sequence
  source 1..20: mol_type = other DNA
gcagggggagtgggggagaa

SEQ ID NO: 7448 - DNA, 20 bp, synthetic construct
  misc_feature 1..20: note = CRISPR gRNA sequence
  source 1..20: mol_type = other DNA
cagggggagtgggggagaag

SEQ ID NO: 7449 - DNA, 20 bp, synthetic construct
  misc_feature 1..20: note = CRISPR gRNA sequence
  source 1..20: mol_type = other DNA
ggggagtgggggagaagggg

SEQ ID NO: 7450 - DNA, 20 bp, synthetic construct
  misc_feature 1..20: note = CRISPR gRNA sequence
  source 1..20: mol_type = other DNA
gggagtgggggagaaggggc

SEQ ID NO: 7451 - DNA, 20 bp, synthetic construct
  misc_feature 1..20: note = CRISPR gRNA sequence
  source 1..20: mol_type = other DNA
ggagtgggggagaaggggca

SEQ ID NO: 7452 - DNA, 20 bp, synthetic construct
  misc_feature 1..20: note = CRISPR gRNA sequence
  source 1..20: mol_type = other DNA
gagtgggggagaaggggcag

SEQ ID NO: 7453 - DNA, 20 bp, synthetic construct
  misc_feature 1..20: note = CRISPR gRNA sequence
  source 1..20: mol_type = other DNA
tgggggagaaggggcagggg

SEQ ID NO: 7454 - DNA, 20 bp, synthetic construct
  misc_feature 1..20: note = CRISPR gRNA sequence
  source 1..20: mol_type = other DNA
ggggcaggggcagccaccga

SEQ ID NO: 7455 - DNA, 20 bp, synthetic construct
  misc_feature 1..20: note = CRISPR gRNA sequence
  source 1..20: mol_type = other DNA
gggcaggggcagccaccgac

SEQ ID NO: 7456 - DNA, 20 bp, synthetic construct
  misc_feature 1..20: note = CRISPR gRNA sequence
  source 1..20: mol_type = other DNA
ggcagccaccgacaggctat

SEQ ID NO: 7457 - DNA, 20 bp, synthetic construct
  misc_feature 1..20: note = CRISPR gRNA sequence
  source 1..20: mol_type = other DNA
gcagccaccgacaggctatg

SEQ ID NO: 7458 - DNA, 20 bp, synthetic construct
  misc_feature 1..20: note = CRISPR gRNA sequence
  source 1..20: mol_type = other DNA
caggctatgaggtcttgtgc

SEQ ID NO: 7459 - DNA, 20 bp, synthetic construct
  misc_feature 1..20: note = CRISPR gRNA sequence
  source 1..20: mol_type = other DNA
tgtgcaagtcacgtccttcc

SEQ ID NO: 7460 - DNA, 20 bp, synthetic construct
  misc_feature 1..20: note = CRISPR gRNA sequence
  source 1..20: mol_type = other DNA
gtgcaagtcacgtccttccc

SEQ ID NO: 7461 - DNA, 20 bp, synthetic construct
  misc_feature 1..20: note = CRISPR gRNA sequence
  source 1..20: mol_type = other DNA
tgcaagtcacgtccttcccg

SEQ ID NO: 7462 - DNA, 20 bp, synthetic construct
  misc_feature 1..20: note = CRISPR gRNA sequence
  source 1..20: mol_type = other DNA
tcacgtccttcccggggtct

SEQ ID NO: 7463 - DNA, 20 bp, synthetic construct
  misc_feature 1..20: note = CRISPR gRNA sequence
  source 1..20: mol_type = other DNA
ggtctcagtcttgtcatctg

SEQ ID NO: 7464 - DNA, 20 bp, synthetic construct
  misc_feature 1..20: note = CRISPR gRNA sequence
  source 1..20: mol_type = other DNA
tctcagtcttgtcatctgca

SEQ ID NO: 7465 - DNA, 20 bp, synthetic construct
  misc_feature 1..20: note = CRISPR gRNA sequence
  source 1..20: mol_type = other DNA
gtcttgtcatctgcagagtg

SEQ ID NO: 7466 - DNA, 20 bp, synthetic construct
  misc_feature 1..20: note = CRISPR gRNA sequence
  source 1..20: mol_type = other DNA
tcttgtcatctgcagagtga

SEQ ID NO: 7467 - DNA, 20 bp, synthetic construct
  misc_feature 1..20: note = CRISPR gRNA sequence
  source 1..20: mol_type = other DNA
gtcatctgcagagtgaagga

SEQ ID NO: 7468 - DNA, 20 bp, synthetic construct
  misc_feature 1..20: note = CRISPR gRNA sequence
  source 1..20: mol_type = other DNA
catctgcagagtgaaggaaa

SEQ ID NO: 7469 - DNA, 20 bp, synthetic construct
  misc_feature 1..20: note = CRISPR gRNA sequence
  source 1..20: mol_type = other DNA
atctgcagagtgaaggaaag

SEQ ID NO: 7470 - DNA, 20 bp, synthetic construct
  misc_feature 1..20: note = CRISPR gRNA sequence
  source 1..20: mol_type = other DNA
cagagtgaaggaaagaggtc

SEQ ID NO: 7471 - DNA, 20 bp, synthetic construct
  misc_feature 1..20: note = CRISPR gRNA sequence
  source 1..20: mol_type = other DNA
aaggaaagaggtcaagcttg

SEQ ID NO: 7472 - DNA, 20 bp, synthetic construct
  misc_feature 1..20: note = CRISPR gRNA sequence
  source 1..20: mol_type = other DNA
aggaaagaggtcaagcttga

SEQ ID NO: 7473 - DNA, 20 bp, synthetic construct
  misc_feature 1..20: note = CRISPR gRNA sequence
  source 1..20: mol_type = other DNA
aggtcaagcttgaaggtccc

SEQ ID NO: 7474 - DNA, 20 bp, synthetic construct
  misc_feature 1..20: note = CRISPR gRNA sequence
  source 1..20: mol_type = other DNA
tcaagcttgaaggtccctgg

SEQ ID NO: 7475 - DNA, 20 bp, synthetic construct
  misc_feature 1..20: note = CRISPR gRNA sequence
  source 1..20: mol_type = other DNA
tggcagacccaatgccctgt

SEQ ID NO: 7476 - DNA, 20 bp, synthetic construct
  misc_feature 1..20: note = CRISPR gRNA sequence
  source 1..20: mol_type = other DNA
caatgccctgtgagaaaact

SEQ ID NO: 7477 - DNA, 20 bp, synthetic construct
  misc_feature 1..20: note = CRISPR gRNA sequence
  source 1..20: mol_type = other DNA
ccctgtgagaaaactgagtt

SEQ ID NO: 7478 - DNA, 20 bp, synthetic construct
  misc_feature 1..20: note = CRISPR gRNA sequence
  source 1..20: mol_type = other DNA
cctgtgagaaaactgagttt

SEQ ID NO: 7479 - DNA, 20 bp, synthetic construct
  misc_feature 1..20: note = CRISPR gRNA sequence
  source 1..20: mol_type = other DNA
ttgggtaacttattatttta

SEQ ID NO: 7480 - DNA, 20 bp, synthetic construct
  misc_feature 1..20: note = CRISPR gRNA sequence
  source 1..20: mol_type = other DNA
aacttattattttatagata

SEQ ID NO: 7481 - DNA, 20 bp, synthetic construct
  misc_feature 1..20: note = CRISPR gRNA sequence
  source 1..20: mol_type = other DNA
atagatatggaattatctta

SEQ ID NO: 7482 - DNA, 20 bp, synthetic construct
  misc_feature 1..20: note = CRISPR gRNA sequence
  source 1..20: mol_type = other DNA
attatcttatagaaatgtta

SEQ ID NO: 7483 - DNA, 20 bp, synthetic construct
  misc_feature 1..20: note = CRISPR gRNA sequence
  source 1..20: mol_type = other DNA
ttatagaaatgttatagata

SEQ ID NO: 7484 - DNA, 20 bp, synthetic construct
  misc_feature 1..20: note = CRISPR gRNA sequence
  source 1..20: mol_type = other DNA
atagatatggaatcatttta

SEQ ID NO: 7485 - DNA, 20 bp, synthetic construct
  misc_feature 1..20: note = CRISPR gRNA sequence
  source 1..20: mol_type = other DNA
atggaatcattttatagata

SEQ ID NO: 7486 - DNA, 20 bp, synthetic construct
  misc_feature 1..20: note = CRISPR gRNA sequence
  source 1..20: mol_type = other DNA
cattttatagatatggccca

SEQ ID NO: 7487 - DNA, 20 bp, synthetic construct
  misc_feature 1..20: note = CRISPR gRNA sequence
  source 1..20: mol_type = other DNA
tagatatggcccaaagtcca

SEQ ID NO: 7488 - DNA, 20 bp, synthetic construct
  misc_feature 1..20: note = CRISPR gRNA sequence
  source 1..20: mol_type = other DNA
aaagtcacacaactcattca

SEQ ID NO: 7489 - DNA, 20 bp, synthetic construct
  misc_feature 1..20: note = CRISPR gRNA sequence
  source 1..20: mol_type = other DNA
agtcacacaactcattcacg

SEQ ID NO: 7490 - DNA, 20 bp, synthetic construct
  misc_feature 1..20: note = CRISPR gRNA sequence
  source 1..20: mol_type = other DNA
caactcattcacggagttgc

SEQ ID NO: 7491 - DNA, 20 bp, synthetic construct
  misc_feature 1..20: note = CRISPR gRNA sequence
  source 1..20: mol_type = other DNA
aactcattcacggagttgct

SEQ ID NO: 7492 - DNA, 20 bp, synthetic construct
  misc_feature 1..20: note = CRISPR gRNA sequence
  source 1..20: mol_type = other DNA
attcacggagttgctaggat

SEQ ID NO: 7493 - DNA, 20 bp, synthetic construct
  misc_feature 1..20: note = CRISPR gRNA sequence
  source 1..20: mol_type = other DNA
cggagttgctaggatcagtc

SEQ ID NO: 7494 - DNA, 20 bp, synthetic construct
  misc_feature 1..20: note = CRISPR gRNA sequence
  source 1..20: mol_type = other DNA
gagttgctaggatcagtctg

SEQ ID NO: 7495 - DNA, 20 bp, synthetic construct
  misc_feature 1..20: note = CRISPR gRNA sequence
  source 1..20: mol_type = other DNA
cagtctggagctcttgtcac

SEQ ID NO: 7496 - DNA, 20 bp, synthetic construct
  misc_feature 1..20: note = CRISPR gRNA sequence
  source 1..20: mol_type = other DNA
cacgagatcacactgcctca

SEQ ID NO: 7497 - DNA, 20 bp, synthetic construct
  misc_feature 1..20: note = CRISPR gRNA sequence
  source 1..20: mol_type = other DNA
cgagatcacactgcctcaaa

SEQ ID NO: 7498 - DNA, 20 bp, synthetic construct
  misc_feature 1..20: note = CRISPR gRNA sequence
  source 1..20: mol_type = other DNA
gagatcacactgcctcaaag

SEQ ID NO: 7499 - DNA, 20 bp, synthetic construct
  misc_feature 1..20: note = CRISPR gRNA sequence
  source 1..20: mol_type = other DNA
gatcacactgcctcaaagag

SEQ ID NO: 7500 - DNA, 20 bp, synthetic construct
  misc_feature 1..20: note = CRISPR gRNA sequence
  source 1..20: mol_type = other DNA
atcacactgcctcaaagagg

SEQ ID NO: 7501 - DNA, 20 bp, synthetic construct
  misc_feature 1..20: note = CRISPR gRNA sequence
  source 1..20: mol_type = other DNA
acactgcctcaaagaggagg

SEQ ID NO: 7502 - DNA, 20 bp, synthetic construct
  misc_feature 1..20: note = CRISPR gRNA sequence
  source 1..20: mol_type = other DNA
ggaggcagattgctgcaatg

SEQ ID NO: 7503 - DNA, 20 bp, synthetic construct
  misc_feature 1..20: note = CRISPR gRNA sequence
  source 1..20: mol_type = other DNA
gaggcagattgctgcaatgt

SEQ ID NO: 7504 - DNA, 20 bp, synthetic construct
  misc_feature 1..20: note = CRISPR gRNA sequence
  source 1..20: mol_type = other DNA
tgcaatgtaggttcttaata

SEQ ID NO: 7505 - DNA, 20 bp, synthetic construct
  misc_feature 1..20: note = CRISPR gRNA sequence
  source 1..20: mol_type = other DNA
caatgtaggttcttaataaa

SEQ ID NO: 7506 - DNA, 20 bp, synthetic construct
  misc_feature 1..20: note = CRISPR gRNA sequence
  source 1..20: mol_type = other DNA
taggttcttaataaagagca

SEQ ID NO: 7507 - DNA, 20 bp, synthetic construct
  misc_feature 1..20: note = CRISPR gRNA sequence
  source 1..20: mol_type = other DNA
aggttcttaataaagagcat

SEQ ID NO: 7508 - DNA, 20 bp, synthetic construct
  misc_feature 1..20: note = CRISPR gRNA sequence
  source 1..20: mol_type = other DNA
ttcttaataaagagcatggg

SEQ ID NO: 7509 - DNA, 20 bp, synthetic construct
  misc_feature 1..20: note = CRISPR gRNA sequence
  source 1..20: mol_type = other DNA
aataaagagcatgggtggaa

SEQ ID NO: 7510 - DNA, 20 bp, synthetic construct
  misc_feature 1..20: note = CRISPR gRNA sequence
  source 1..20: mol_type = other DNA
ataaagagcatgggtggaat

SEQ ID NO: 7511 - DNA, 20 bp, synthetic construct
  misc_feature 1..20: note = CRISPR gRNA sequence
  source 1..20: mol_type = other DNA
aaagagcatgggtggaatgg

SEQ ID NO: 7512 - DNA, 20 bp, synthetic construct
  misc_feature 1..20: note = CRISPR gRNA sequence
  source 1..20: mol_type = other DNA
aagagcatgggtggaatggg

SEQ ID NO: 7513 - DNA, 20 bp, synthetic construct
  misc_feature 1..20: note = CRISPR gRNA sequence
  source 1..20: mol_type = other DNA
agcatgggtggaatgggagg

SEQ ID NO: 7514 - DNA, 20 bp, synthetic construct
  misc_feature 1..20: note = CRISPR gRNA sequence
  source 1..20: mol_type = other DNA
gcatgggtggaatgggaggc

SEQ ID NO: 7515 - DNA, 20 bp, synthetic construct
  misc_feature 1..20: note = CRISPR gRNA sequence
  source 1..20: mol_type = other DNA
gtggaatgggaggcgggcat

SEQ ID NO: 7516 - DNA, 20 bp, synthetic construct
  misc_feature 1..20: note = CRISPR gRNA sequence
  source 1..20: mol_type = other DNA
tggaatgggaggcgggcatc

SEQ ID NO: 7517 - DNA, 20 bp, synthetic construct
  misc_feature 1..20: note = CRISPR gRNA sequence
  source 1..20: mol_type = other DNA
aatgggaggcgggcatcagg

SEQ ID NO: 7518 - DNA, 20 bp, synthetic construct
  misc_feature 1..20: note = CRISPR gRNA sequence
  source 1..20: mol_type = other DNA
atgggaggcgggcatcaggc

SEQ ID NO: 7519 - DNA, 20 bp, synthetic construct
  misc_feature 1..20: note = CRISPR gRNA sequence
  source 1..20: mol_type = other DNA
gggaggcgggcatcaggcag

SEQ ID NO: 7520 - DNA, 20 bp, synthetic construct
  misc_feature 1..20: note = CRISPR gRNA sequence
  source 1..20: mol_type = other DNA
ggcgggcatcaggcaggagc

SEQ ID NO: 7521 - DNA, 20 bp, synthetic construct
  misc_feature 1..20: note = CRISPR gRNA sequence
  source 1..20: mol_type = other DNA
gcgggcatcaggcaggagct

SEQ ID NO: 7522 - DNA, 20 bp, synthetic construct
  misc_feature 1..20: note = CRISPR gRNA sequence
  source 1..20: mol_type = other DNA
cgggcatcaggcaggagctg

SEQ ID NO: 7523 - DNA, 20 bp, synthetic construct
  misc_feature 1..20: note = CRISPR gRNA sequence
  source 1..20: mol_type = other DNA
atcaggcaggagctggggca

SEQ ID NO: 7524 - DNA, 20 bp, synthetic construct
  misc_feature 1..20: note = CRISPR gRNA sequence
  source 1..20: mol_type = other DNA
tcaggcaggagctggggcaa

SEQ ID NO: 7525 - DNA, 20 bp, synthetic construct
  misc_feature 1..20: note = CRISPR gRNA sequence
  source 1..20: mol_type = other DNA
gtgtcttttctcactgctct

SEQ ID NO: 7526 - DNA, 20 bp, synthetic construct
  misc_feature 1..20: note = CRISPR gRNA sequence
  source 1..20: mol_type = other DNA
gtcttttctcactgctctga

SEQ ID NO: 7527 - DNA, 20 bp, synthetic construct
  misc_feature 1..20: note = CRISPR gRNA sequence
  source 1..20: mol_type = other DNA
ttctcactgctctgagagaa

SEQ ID NO: 7528 - DNA, 20 bp, synthetic construct
  misc_feature 1..20: note = CRISPR gRNA sequence
  source 1..20: mol_type = other DNA
ttgtgcctgtgtccctgacc

SEQ ID NO: 7529 - DNA, 20 bp, synthetic construct
  misc_feature 1..20: note = CRISPR gRNA sequence
  source 1..20: mol_type = other DNA
tgtgcctgtgtccctgacca

SEQ ID NO: 7530 - DNA, 20 bp, synthetic construct
  misc_feature 1..20: note = CRISPR gRNA sequence
  source 1..20: mol_type = other DNA
gtgcctgtgtccctgaccaa

SEQ ID NO: 7531 - DNA, 20 bp, synthetic construct
  misc_feature 1..20: note = CRISPR gRNA sequence
  source 1..20: mol_type = other DNA
tgcctgtgtccctgaccaag

SEQ ID NO: 7532 - DNA, 20 bp, synthetic construct
  misc_feature 1..20: note = CRISPR gRNA sequence
  source 1..20: mol_type = other DNA
tgtgtccctgaccaaggggc

SEQ ID NO: 7533 - DNA, 20 bp, synthetic construct
  misc_feature 1..20: note = CRISPR gRNA sequence
  source 1..20: mol_type = other DNA
gtgtccctgaccaaggggct

SEQ ID NO: 7534 - DNA, 20 bp, synthetic construct
  misc_feature 1..20: note = CRISPR gRNA sequence
  source 1..20: mol_type = other DNA
gtccctgaccaaggggctgg

SEQ ID NO: 7535 - DNA, 20 bp, synthetic construct
  misc_feature 1..20: note = CRISPR gRNA sequence
  source 1..20: mol_type = other DNA
ccctgaccaaggggctggga

SEQ ID NO: 7536 - DNA, 20 bp, synthetic construct
  misc_feature 1..20: note = CRISPR gRNA sequence
  source 1..20: mol_type = other DNA
cctgaccaaggggctgggag

SEQ ID NO: 7537 - DNA, 20 bp, synthetic construct
  misc_feature 1..20: note = CRISPR gRNA sequence
  source 1..20: mol_type = other DNA
gaccaaggggctgggagagg

SEQ ID NO: 7538 - DNA, 20 bp, synthetic construct
  misc_feature 1..20: note = CRISPR gRNA sequence
  source 1..20: mol_type = other DNA
ccaaggggctgggagaggtg

SEQ ID NO: 7539 - DNA, 20 bp, synthetic construct
  misc_feature 1..20: note = CRISPR gRNA sequence
  source 1..20: mol_type = other DNA
tctcacccccaaccatctcc

SEQ ID NO: 7540 - DNA, 20 bp, synthetic construct
  misc_feature 1..20: note = CRISPR gRNA sequence
  source 1..20: mol_type = other DNA
ccccaaccatctcccagctt

SEQ ID NO: 7541 - DNA, 20 bp, synthetic construct
  misc_feature 1..20: note = CRISPR gRNA sequence
  source 1..20: mol_type = other DNA
tcccagctttggccctgctc

SEQ ID NO: 7542 - DNA, 20 bp, synthetic construct
  misc_feature 1..20: note = CRISPR gRNA sequence
  source 1..20: mol_type = other DNA
cccagctttggccctgctcc

SEQ ID NO: 7543 - DNA, 20 bp, synthetic construct
  misc_feature 1..20: note = CRISPR gRNA sequence
  source 1..20: mol_type = other DNA
ctttggccctgctccaggaa

SEQ ID NO: 7544 - DNA, 20 bp, synthetic construct
  misc_feature 1..20: note = CRISPR gRNA sequence
  source 1..20: mol_type = other DNA
tttggccctgctccaggaaa

SEQ ID NO: 7545 - DNA, 20 bp, synthetic construct
  misc_feature 1..20: note = CRISPR gRNA sequence
  source 1..20: mol_type = other DNA
ttggccctgctccaggaaaa

SEQ ID NO: 7546 - DNA, 20 bp, synthetic construct
  misc_feature 1..20: note = CRISPR gRNA sequence
  source 1..20: mol_type = other DNA
gccctgctccaggaaaaggg

SEQ ID NO: 7547 - DNA, 20 bp, synthetic construct
  misc_feature 1..20: note = CRISPR gRNA sequence
  source 1..20: mol_type = other DNA
ctgctccaggaaaagggcgg

SEQ ID NO: 7548 - DNA, 20 bp, synthetic construct
  misc_feature 1..20: note = CRISPR gRNA sequence
  source 1..20: mol_type = other DNA
agggcggtggccccatcttt

SEQ ID NO: 7549 - DNA, 20 bp, synthetic construct
  misc_feature 1..20: note = CRISPR gRNA sequence
  source 1..20: mol_type = other DNA
tctttcagttctgcttcctc

SEQ ID NO: 7550 - DNA, 20 bp, synthetic construct
  misc_feature 1..20: note = CRISPR gRNA sequence
  source 1..20: mol_type = other DNA
agttctgcttcctctagtca

SEQ ID NO: 7551 - DNA, 20 bp, synthetic construct
  misc_feature 1..20: note = CRISPR gRNA sequence
  source 1..20: mol_type = other DNA
ctgcttcctctagtcatggt

SEQ ID NO: 7552 - DNA, 20 bp, synthetic construct
  misc_feature 1..20: note = CRISPR gRNA sequence
  source 1..20: mol_type = other DNA
ttcctctagtcatggttggc

SEQ ID NO: 7553 - DNA, 20 bp, synthetic construct
  misc_feature 1..20: note = CRISPR gRNA sequence
  source 1..20: mol_type = other DNA
tcctctagtcatggttggct

SEQ ID NO: 7554 - DNA, 20 bp, synthetic construct
  misc_feature 1..20: note = CRISPR gRNA sequence
  source 1..20: mol_type = other DNA
gttggctgggatctcgctgc

SEQ ID NO: 7555 - DNA, 20 bp, synthetic construct
  misc_feature 1..20: note = CRISPR gRNA sequence
  source 1..20: mol_type = other DNA
gctgggatctcgctgcaagc

SEQ ID NO: 7556 - DNA, 20 bp, synthetic construct
  misc_feature 1..20: note = CRISPR gRNA sequence
  source 1..20: mol_type = other DNA
cgctgcaagccggttatgtt

SEQ ID NO: 7557 - DNA, 20 bp, synthetic construct
  misc_feature 1..20: note = CRISPR gRNA sequence
  source 1..20: mol_type = other DNA
gctgcaagccggttatgttt

SEQ ID NO: 7558 - DNA, 20 bp, synthetic construct
  misc_feature 1..20: note = CRISPR gRNA sequence
  source 1..20: mol_type = other DNA
cggttatgtttgggttcctg

SEQ ID NO: 7559 - DNA, 20 bp, synthetic construct
  misc_feature 1..20: note = CRISPR gRNA sequence
  source 1..20: mol_type = other DNA
cccgctcaaccgtcatgaac

SEQ ID NO: 7560 - DNA, 20 bp, synthetic construct
  misc_feature 1..20: note = CRISPR gRNA sequence
  source 1..20: mol_type = other DNA
gctcaaccgtcatgaacaag

SEQ ID NO: 7561 - DNA, 20 bp, synthetic construct
  misc_feature 1..20: note = CRISPR gRNA sequence
  source 1..20: mol_type = other DNA
ctcaaccgtcatgaacaagt

SEQ ID NO: 7562 - DNA, 20 bp, synthetic construct
  misc_feature 1..20: note = CRISPR gRNA sequence
  source 1..20: mol_type = other DNA
ccgtcatgaacaagtgggcc

SEQ ID NO: 7563 - DNA, 20 bp, synthetic construct
  misc_feature 1..20: note = CRISPR gRNA sequence
  source 1..20: mol_type = other DNA
catgaacaagtgggcccagc

SEQ ID NO: 7564 - DNA, 20 bp, synthetic construct
  misc_feature 1..20: note = CRISPR gRNA sequence
  source 1..20: mol_type = other DNA
agtgggcccagccagtgccc

SEQ ID NO: 7565 - DNA, 20 bp, synthetic construct
  misc_feature 1..20: note = CRISPR gRNA sequence
  source 1..20: mol_type = other DNA
gcccagccagtgccccagct

SEQ ID NO: 7566 - DNA, 20 bp, synthetic construct
  misc_feature 1..20: note = CRISPR gRNA sequence
  source 1..20: mol_type = other DNA
gccagtgccccagcttggac

SEQ ID NO: 7567 - DNA, 20 bp, synthetic construct
  misc_feature 1..20: note = CRISPR gRNA sequence
  source 1..20: mol_type = other DNA
gtgccccagcttggactgga

SEQ ID NO: 7568 - DNA, 20 bp, synthetic construct
  misc_feature 1..20: note = CRISPR gRNA sequence
  source 1..20: mol_type = other DNA
agatcattctctgtgacatc

SEQ ID NO: 7569 - DNA, 20 bp, synthetic construct
  misc_feature 1..20: note = CRISPR gRNA sequence
  source 1..20: mol_type = other DNA
gatcattctctgtgacatcc

SEQ ID NO: 7570 - DNA, 20 bp, synthetic construct
  misc_feature 1..20: note = CRISPR gRNA sequence
  source 1..20: mol_type = other DNA
atcattctctgtgacatccg

SEQ ID NO: 7571 - DNA, 20 bp, synthetic construct
  misc_feature 1..20: note = CRISPR gRNA sequence
  source 1..20: mol_type = other DNA
tcattctctgtgacatccgg

SEQ ID NO: 7572 - DNA, 20 bp, synthetic construct
  misc_feature 1..20: note = CRISPR gRNA sequence
  source 1..20: mol_type = other DNA
gacatccgggggtctgtgct

SEQ ID NO: 7573 - DNA, 20 bp, synthetic construct
  misc_feature 1..20: note = CRISPR gRNA sequence
  source 1..20: mol_type = other DNA
gtctgtgctgagcctctccc

SEQ ID NO: 7574 - DNA, 20 bp, synthetic construct
  misc_feature 1..20: note = CRISPR gRNA sequence
  source 1..20: mol_type = other DNA
tctgtgctgagcctctcccc

SEQ ID NO: 7575 - DNA, 20 bp, synthetic construct
  misc_feature 1..20: note = CRISPR gRNA sequence
  source 1..20: mol_type = other DNA
gtgctgagcctctccccagg

SEQ ID NO: 7576 - DNA, 20 bp, synthetic construct
  misc_feature 1..20: note = CRISPR gRNA sequence
  source 1..20: mol_type = other DNA
agcctctccccaggcagtga

SEQ ID NO: 7577 - DNA, 20 bp, synthetic construct
  misc_feature 1..20: note = CRISPR gRNA sequence
  source 1..20: mol_type = other DNA
tccccaggcagtgaaagctg

SEQ ID NO: 7578 - DNA, 20 bp, synthetic construct
  misc_feature 1..20: note = CRISPR gRNA sequence
  source 1..20: mol_type = other DNA
tgaaagctgtggatgcgtga

SEQ ID NO: 7579 - DNA, 20 bp, synthetic construct
  misc_feature 1..20: note = CRISPR gRNA sequence
  source 1..20: mol_type = other DNA
tgtggatgcgtgaaagaaaa

SEQ ID NO: 7580 - DNA, 20 bp, synthetic construct
  misc_feature 1..20: note = CRISPR gRNA sequence
  source 1..20: mol_type = other DNA
gtggatgcgtgaaagaaaat

SEQ ID NO: 7581 - DNA, 20 bp, synthetic construct
  misc_feature 1..20: note = CRISPR gRNA sequence
  source 1..20: mol_type = other DNA
cgtgaaagaaaatgggtctc

SEQ ID NO: 7582 - DNA, 20 bp, synthetic construct
  misc_feature 1..20: note = CRISPR gRNA sequence
  source 1..20: mol_type = other DNA
gtgaaagaaaatgggtctct

SEQ ID NO: 7583 - DNA, 20 bp, synthetic construct
  misc_feature 1..20: note = CRISPR gRNA sequence
  source 1..20: mol_type = other DNA
aagaaaatgggtctctgggc

SEQ ID NO: 7584 - DNA, 20 bp, synthetic construct
  misc_feature 1..20: note = CRISPR gRNA sequence
  source 1..20: mol_type = other DNA
agaaaatgggtctctgggcc

SEQ ID NO: 7585 - DNA, 20 bp, synthetic construct
  misc_feature 1..20: note = CRISPR gRNA sequence
  source 1..20: mol_type = other DNA
atgggtctctgggccgggtg

SEQ ID NO: 7586 - DNA, 20 bp, synthetic construct
  misc_feature 1..20: note = CRISPR gRNA sequence
  source 1..20: mol_type = other DNA
ggtctctgggccgggtgtgg

SEQ ID NO: 7587 - DNA, 20 bp, synthetic construct
  misc_feature 1..20: note = CRISPR gRNA sequence
  source 1..20: mol_type = other DNA
gtggctcacacctgtaatcc

SEQ ID NO: 7588 - DNA, 20 bp, synthetic construct
  misc_feature 1..20: note = CRISPR gRNA sequence
  source 1..20: mol_type = other DNA
cacctgtaatcccagcactt

SEQ ID NO: 7589 - DNA, 20 bp, synthetic construct
  misc_feature 1..20: note = CRISPR gRNA sequence
  source 1..20: mol_type = other DNA
acctgtaatcccagcacttt

SEQ ID NO: 7590 - DNA, 20 bp, synthetic construct
  misc_feature 1..20: note = CRISPR gRNA sequence
  source 1..20: mol_type = other DNA
ctgtaatcccagcactttgg

SEQ ID NO: 7591 - DNA, 20 bp, synthetic construct
  misc_feature 1..20: note = CRISPR gRNA sequence
  source 1..20: mol_type = other DNA
tgtaatcccagcactttggg

SEQ ID NO: 7592 - DNA, 20 bp, synthetic construct
  misc_feature 1..20: note = CRISPR gRNA sequence
  source 1..20: mol_type = other DNA
tcccagcactttgggaggcc

SEQ ID NO: 7593 - DNA, 20 bp, synthetic construct
  misc_feature 1..20: note = CRISPR gRNA sequence
  source 1..20: mol_type = other DNA
cccagcactttgggaggcca

SEQ ID NO: 7594 - DNA, 20 bp, synthetic construct
  misc_feature 1..20: note = CRISPR gRNA sequence
  source 1..20: mol_type = other DNA
agcactttgggaggccaagg

SEQ ID NO: 7595 - DNA, 20 bp, synthetic construct
  misc_feature 1..20: note = CRISPR gRNA sequence
  source 1..20: mol_type = other DNA
gcactttgggaggccaaggc

SEQ ID NO: 7596 - DNA, 20 bp, synthetic construct
  misc_feature 1..20: note = CRISPR gRNA sequence
  source 1..20: mol_type = other DNA
ctttgggaggccaaggcggg

SEQ ID NO: 7597 - DNA, 20 bp, synthetic construct
  misc_feature 1..20: note = CRISPR gRNA sequence
  source 1..20: mol_type = other DNA
ccaaggcgggtggatcacct

SEQ ID NO: 7598 - DNA, 20 bp, synthetic construct
  misc_feature 1..20: note = CRISPR gRNA sequence
  source 1..20: mol_type = other DNA
caaggcgggtggatcacctg

SEQ ID NO: 7599 - DNA, 20 bp, synthetic construct
  misc_feature 1..20: note = CRISPR gRNA sequence
  source 1..20: mol_type = other DNA
gcgggtggatcacctgaggt

SEQ ID NO: 7600 - DNA, 20 bp, synthetic construct
  misc_feature 1..20: note = CRISPR gRNA sequence
  source 1..20: mol_type = other DNA
cgggtggatcacctgaggtc

SEQ ID NO: 7601 - DNA, 20 bp, synthetic construct
  misc_feature 1..20: note = CRISPR gRNA sequence
  source 1..20: mol_type = other DNA
ggtggatcacctgaggtcgg

SEQ ID NO: 7602 - DNA, 20 bp, synthetic construct
  misc_feature 1..20: note = CRISPR gRNA sequence
  source 1..20: mol_type = other DNA
tgaggtcgggagttcgaaac

SEQ ID NO: 7603 - DNA, 20 bp, synthetic construct
  misc_feature 1..20: note = CRISPR gRNA sequence
  source 1..20: mol_type = other DNA
cgaaaccagcctgaccaaca

SEQ ID NO: 7604 - DNA, 20 bp, synthetic construct
  misc_feature 1..20: note = CRISPR gRNA sequence
  source 1..20: mol_type = other DNA
tttactaaaaataaaaaaat

SEQ ID NO: 7605 - DNA, 20 bp, synthetic construct
  misc_feature 1..20: note = CRISPR gRNA sequence
  source 1..20: mol_type = other DNA
ctaaaaataaaaaaattagc

SEQ ID NO: 7606 - DNA, 20 bp, synthetic construct
  misc_feature 1..20: note = CRISPR gRNA sequence
  source 1..20: mol_type = other DNA
taaaaataaaaaaattagcc

SEQ ID NO: 7607 - DNA, 20 bp, synthetic construct
  misc_feature 1..20: note = CRISPR gRNA sequence
  source 1..20: mol_type = other DNA
ataaaaaaattagccaggca

SEQ ID NO: 7608 - DNA, 20 bp, synthetic construct
  misc_feature 1..20: note = CRISPR gRNA sequence
  source 1..20: mol_type = other DNA
aaaaaattagccaggcatgg

SEQ ID NO: 7609 - DNA, 20 bp, synthetic construct
  misc_feature 1..20: note = CRISPR gRNA sequence
  source 1..20: mol_type = other DNA
aaattagccaggcatggtgg

SEQ ID NO: 7610 - DNA, 20 bp, synthetic construct
  misc_feature 1..20: note = CRISPR gRNA sequence
  source 1..20: mol_type = other DNA
aattagccaggcatggtggc

SEQ ID NO: 7611 - DNA, 20 bp, synthetic construct
  misc_feature 1..20: note = CRISPR gRNA sequence
  source 1..20: mol_type = other DNA
gtggcgggtgcctgtaatgc

SEQ ID NO: 7612 - DNA, 20 bp, synthetic construct
  misc_feature 1..20: note = CRISPR gRNA sequence
  source 1..20: mol_type = other DNA
tgcctgtaatgccagctact

SEQ ID NO: 7613 - DNA, 20 bp, synthetic construct
  misc_feature 1..20: note = CRISPR gRNA sequence
  source 1..20: mol_type = other DNA
gcctgtaatgccagctactt

SEQ ID NO: 7614 - DNA, 20 bp, synthetic construct
  misc_feature 1..20: note = CRISPR gRNA sequence
  source 1..20: mol_type = other DNA
ctgtaatgccagctacttgg

SEQ ID NO: 7615 - DNA, 20 bp, synthetic construct
  misc_feature 1..20: note = CRISPR gRNA sequence
  source 1..20: mol_type = other DNA
tgtaatgccagctacttggg

SEQ ID NO: 7616 - DNA, 20 bp, synthetic construct
  misc_feature 1..20: note = CRISPR gRNA sequence
  source 1..20: mol_type = other DNA
gccagctacttgggaggttg

SEQ ID NO: 7617 - DNA, 20 bp, synthetic construct
  misc_feature 1..20: note = CRISPR gRNA sequence
  source 1..20: mol_type = other DNA
agctacttgggaggttgaag

SEQ ID NO: 7618 - DNA, 20 bp, synthetic construct
  misc_feature 1..20: note = CRISPR gRNA sequence
  source 1..20: mol_type = other DNA
gctacttgggaggttgaagc

SEQ ID NO: 7619 - DNA, 20 bp, synthetic construct
  misc_feature 1..20: note = CRISPR gRNA sequence
  source 1..20: mol_type = other DNA
tacttgggaggttgaagcag

SEQ ID NO: 7620 - DNA, 20 bp, synthetic construct
  misc_feature 1..20: note = CRISPR gRNA sequence
  source 1..20: mol_type = other DNA
gcaggagaattgcttgaatc

SEQ ID NO: 7621 - DNA, 20 bp, synthetic construct
  misc_feature 1..20: note = CRISPR gRNA sequence
  source 1..20: mol_type = other DNA
caggagaattgcttgaatcc

SEQ ID NO: 7622 - DNA, 20 bp, synthetic construct
  misc_feature 1..20: note = CRISPR gRNA sequence
  source 1..20: mol_type = other DNA
ggagaattgcttgaatccgg

SEQ ID NO: 7623 - DNA, 20 bp, synthetic construct
  misc_feature 1..20: note = CRISPR gRNA sequence
  source 1..20: mol_type = other DNA
gagaattgcttgaatccggg

SEQ ID NO: 7624 - DNA, 20 bp, synthetic construct
  misc_feature 1..20: note = CRISPR gRNA sequence
  source 1..20: mol_type = other DNA
aattgcttgaatccgggagg

SEQ ID NO: 7625 - DNA, 20 bp, synthetic construct
  misc_feature 1..20: note = CRISPR gRNA sequence
  source 1..20: mol_type = other DNA
ttgcttgaatccgggaggca

SEQ ID NO: 7626 - DNA, 20 bp, synthetic construct
  misc_feature 1..20: note = CRISPR gRNA sequence
  source 1..20: mol_type = other DNA
tgcttgaatccgggaggcag

SEQ ID NO: 7627 - DNA, 20 bp, synthetic construct
  misc_feature 1..20: note = CRISPR gRNA sequence
  source 1..20: mol_type = other DNA
aatccgggaggcagaggttg

SEQ ID NO: 7628 - DNA, 20 bp, synthetic construct
  misc_feature 1..20: note = CRISPR gRNA sequence
  source 1..20: mol_type = other DNA
cgggaggcagaggttgcagt

SEQ ID NO: 7629 - DNA, 20 bp, synthetic construct
  misc_feature 1..20: note = CRISPR gRNA sequence
  source 1..20: mol_type = other DNA
ggcagaggttgcagtgagcc

SEQ ID NO: 7630 - DNA, 20 bp, synthetic construct
  misc_feature 1..20: note = CRISPR gRNA sequence
  source 1..20: mol_type = other DNA
aagattgcaccactgcactc

SEQ ID NO: 7631 - DNA, 20 bp, synthetic construct
  misc_feature 1..20: note = CRISPR gRNA sequence
  source 1..20: mol_type = other DNA
tgcaccactgcactccagcc

SEQ ID NO: 7632 - DNA, 20 bp, synthetic construct
  misc_feature 1..20: note = CRISPR gRNA sequence
  source 1..20: mol_type = other DNA
gcaccactgcactccagcct

SEQ ID NO: 7633 - DNA, 20 bp, synthetic construct
  misc_feature 1..20: note = CRISPR gRNA sequence
  source 1..20: mol_type = other DNA
ctgcactccagcctgggcga

SEQ ID NO: 7634 - DNA, 20 bp, synthetic construct
  misc_feature 1..20: note = CRISPR gRNA sequence
  source 1..20: mol_type = other DNA
gcactccagcctgggcgaca

SEQ ID NO: 7635 - DNA, 20 bp, synthetic construct
  misc_feature 1..20: note = CRISPR gRNA sequence
  source 1..20: mol_type = other DNA
tccagcctgggcgacagagt

SEQ ID NO: 7636 - DNA, 20 bp, synthetic construct
  misc_feature 1..20: note = CRISPR gRNA sequence
  source 1..20: mol_type = other DNA
gactctgtctcaaaaaaaaa

SEQ ID NO: 7637 - DNA, 20 bp, synthetic construct
  misc_feature 1..20: note = CRISPR gRNA sequence
  source 1..20: mol_type = other DNA
gtctcaaaaaaaaaaagaaa

SEQ ID NO: 7638 - DNA, 20 bp, synthetic construct
  misc_feature 1..20: note = CRISPR gRNA sequence
  source 1..20: mol_type = other DNA
aaaaaaaagaaaaagaaaat

SEQ ID NO: 7639 - DNA, 20 bp, synthetic construct
  misc_feature 1..20: note = CRISPR gRNA sequence
  source 1..20: mol_type = other DNA
aagaaaaagaaaatgagtct

SEQ ID NO: 7640 - DNA, 20 bp, synthetic construct
  misc_feature 1..20: note = CRISPR gRNA sequence
  source 1..20: mol_type = other DNA
agaaaaagaaaatgagtctc

SEQ ID NO: 7641 - DNA, 20 bp, synthetic construct
  misc_feature 1..20: note = CRISPR gRNA sequence
  source 1..20: mol_type = other DNA
aagaaaatgagtctcaggaa

SEQ ID NO: 7642 - DNA, 20 bp, synthetic construct
  misc_feature 1..20: note = CRISPR gRNA sequence
  source 1..20: mol_type = other DNA
agaaaatgagtctcaggaat

SEQ ID NO: 7643 - DNA, 20 bp, synthetic construct
  misc_feature 1..20: note = CRISPR gRNA sequence
  source 1..20: mol_type = other DNA
gaaaatgagtctcaggaatg

SEQ ID NO: 7644 - DNA, 20 bp, synthetic construct
  misc_feature 1..20: note = CRISPR gRNA sequence
  source 1..20: mol_type = other DNA
aatgagtctcaggaatgggg

SEQ ID NO: 7645 - DNA, 20 bp, synthetic construct
  misc_feature 1..20: note = CRISPR gRNA sequence
  source 1..20: mol_type = other DNA
agtctcaggaatggggtggc

SEQ ID NO: 7646 - DNA, 20 bp, synthetic construct
  misc_feature 1..20: note = CRISPR gRNA sequence
  source 1..20: mol_type = other DNA
caggaatggggtggcaagtt

SEQ ID NO: 7647 - DNA, 20 bp, synthetic construct
  misc_feature 1..20: note = CRISPR gRNA sequence
  source 1..20: mol_type = other DNA
ttgagtgtgtgttttctcat

SEQ ID NO: 7648 - DNA, 20 bp, synthetic construct
  misc_feature 1..20: note = CRISPR gRNA sequence
  source 1..20: mol_type = other DNA
ctcttcaatgtattctcttc

SEQ ID NO: 7649 - DNA, 20 bp, synthetic construct
  misc_feature 1..20: note = CRISPR gRNA sequence
  source 1..20: mol_type = other DNA
tcttcaatgtattctcttct

SEQ ID NO: 7650 - DNA, 20 bp, synthetic construct
  misc_feature 1..20: note = CRISPR gRNA sequence
  source 1..20: mol_type = other DNA
aatgtattctcttctgggcc

SEQ ID NO: 7651 - DNA, 20 bp, synthetic construct
  misc_feature 1..20: note = CRISPR gRNA sequence
  source 1..20: mol_type = other DNA
attctcttctgggcccagaa

SEQ ID NO: 7652 - DNA, 20 bp, synthetic construct
  misc_feature 1..20: note = CRISPR gRNA sequence
  source 1..20: mol_type = other DNA
ttctcttctgggcccagaac

SEQ ID NO: 7653 - DNA, 20 bp, synthetic construct
  misc_feature 1..20: note = CRISPR gRNA sequence
  source 1..20: mol_type = other DNA
tctcttctgggcccagaaca

SEQ ID NO: 7654 - DNA, 20 bp, synthetic construct
  misc_feature 1..20: note = CRISPR gRNA sequence
  source 1..20: mol_type = other DNA
cttctgggcccagaacaggg

SEQ ID NO: 7655 - DNA, 20 bp, synthetic construct
  misc_feature 1..20: note = CRISPR gRNA sequence
  source 1..20: mol_type = other DNA
ctgggcccagaacagggcag

SEQ ID NO: 7656 - DNA, 20 bp, synthetic construct
  misc_feature 1..20: note = CRISPR gRNA sequence
  source 1..20: mol_type = other DNA
tgggcccagaacagggcagt

SEQ ID NO: 7657 - DNA, 20 bp, synthetic construct
  misc_feature 1..20: note = CRISPR gRNA sequence
  source 1..20: mol_type = other DNA
ggcccagaacagggcagtag

SEQ ID NO: 7658 - DNA, 20 bp, synthetic construct
  misc_feature 1..20: note = CRISPR gRNA sequence
  source 1..20: mol_type = other DNA
gggcagtaggagcctccctc

SEQ ID NO: 7659 - DNA, 20 bp, synthetic construct
  misc_feature 1..20: note = CRISPR gRNA sequence
  source 1..20: mol_type = other DNA
ggagcctccctctggtcttc

SEQ ID NO: 7660 - DNA, 20 bp, synthetic construct
  misc_feature 1..20: note = CRISPR gRNA sequence
  source 1..20: mol_type = other DNA
tccctctggtcttccagctt

SEQ ID NO: 7661 - DNA, 20 bp, synthetic construct
  misc_feature 1..20: note = CRISPR gRNA sequence
  source 1..20: mol_type = other DNA
ccctctggtcttccagcttc

SEQ ID NO: 7662 - DNA, 20 bp, synthetic construct
  misc_feature 1..20: note = CRISPR gRNA sequence
  source 1..20: mol_type = other DNA
cctctggtcttccagcttca

SEQ ID NO: 7663 - DNA, 20 bp, synthetic construct
  misc_feature 1..20: note = CRISPR gRNA sequence
  source 1..20: mol_type = other DNA
tggtcttccagcttcagggc

SEQ ID NO: 7664 - DNA, 20 bp, synthetic construct
  misc_feature 1..20: note = CRISPR gRNA sequence
  source 1..20: mol_type = other DNA
agctctcctcttacctcctc

SEQ ID NO: 7665 - DNA, 20 bp, synthetic construct
  misc_feature 1..20: note = CRISPR gRNA sequence
  source 1..20: mol_type = other DNA
gctctcctcttacctcctcc

SEQ ID NO: 7666 - DNA, 20 bp, synthetic construct
  misc_feature 1..20: note = CRISPR gRNA sequence
  source 1..20: mol_type = other DNA
ctcctcttacctcctccagg

SEQ ID NO: 7667 - DNA, 20 bp, synthetic construct
  misc_feature 1..20: note = CRISPR gRNA sequence
  source 1..20: mol_type = other DNA
aagctccctctgtttctttc

SEQ ID NO: 7668 - DNA, 20 bp, synthetic construct
  misc_feature 1..20: note = CRISPR gRNA sequence
  source 1..20: mol_type = other DNA
cttcatctgcatgtcatgtg

SEQ ID NO: 7669 - DNA, 20 bp, synthetic construct
  misc_feature 1..20: note = CRISPR gRNA sequence
  source 1..20: mol_type = other DNA
catctgcatgtcatgtgtgg

SEQ ID NO: 7670 - DNA, 20 bp, synthetic construct
  misc_feature 1..20: note = CRISPR gRNA sequence
  source 1..20: mol_type = other DNA
atctgcatgtcatgtgtggt

SEQ ID NO: 7671 - DNA, 20 bp, synthetic construct
  misc_feature 1..20: note = CRISPR gRNA sequence
  source 1..20: mol_type = other DNA
tgtcatgtgtggtgggttga

SEQ ID NO: 7672 - DNA, 20 bp, synthetic construct
  misc_feature 1..20: note = CRISPR gRNA sequence
  source 1..20: mol_type = other DNA
gtcatgtgtggtgggttgaa

SEQ ID NO: 7673 - DNA, 20 bp, synthetic construct
  misc_feature 1..20: note = CRISPR gRNA sequence
  source 1..20: mol_type = other DNA
atgtgtggtgggttgaaagg

SEQ ID NO: 7674 - DNA, 20 bp, synthetic construct
  misc_feature 1..20: note = CRISPR gRNA sequence
  source 1..20: mol_type = other DNA
gttgaaaggtggccccccaa

SEQ ID NO: 7675 - DNA, 20 bp, synthetic construct
  misc_feature 1..20: note = CRISPR gRNA sequence
  source 1..20: mol_type = other DNA
atatgtccatgtcaaatccc

SEQ ID NO: 7676 - DNA, 20 bp, synthetic construct
  misc_feature 1..20: note = CRISPR gRNA sequence
  source 1..20: mol_type = other DNA
gtcaaatccctggaacctgt

SEQ ID NO: 7677 - DNA, 20 bp, synthetic construct
  misc_feature 1..20: note = CRISPR gRNA sequence
  source 1..20: mol_type = other DNA
cctgtcagtgtgactttatt

SEQ ID NO: 7678 - DNA, 20 bp, synthetic construct
  misc_feature 1..20: note = CRISPR gRNA sequence
  source 1..20: mol_type = other DNA
ctgtcagtgtgactttattt

SEQ ID NO: 7679 - DNA, 20 bp, synthetic construct
  misc_feature 1..20: note = CRISPR gRNA sequence
  source 1..20: mol_type = other DNA
agtgtgactttatttgggaa

SEQ ID NO: 7680 - DNA, 20 bp, synthetic construct
  misc_feature 1..20: note = CRISPR gRNA sequence
  source 1..20: mol_type = other DNA
gtgtgactttatttgggaaa

SEQ ID NO: 7681 - DNA, 20 bp, synthetic construct
  misc_feature 1..20: note = CRISPR gRNA sequence
  source 1..20: mol_type = other DNA
tgtgactttatttgggaaaa

SEQ ID NO: 7682 - DNA, 20 bp, synthetic construct
  misc_feature 1..20: note = CRISPR gRNA sequence
  source 1..20: mol_type = other DNA
atttgggaaaagggtctttg

SEQ ID NO: 7683 - DNA, 20 bp, synthetic construct
  misc_feature 1..20: note = CRISPR gRNA sequence
  source 1..20: mol_type = other DNA
gggaaaagggtctttgcaga

SEQ ID NO: 7684 - DNA, 20 bp, synthetic construct
  misc_feature 1..20: note = CRISPR gRNA sequence
  source 1..20: mol_type = other DNA
gggtctttgcagatagaatt

SEQ ID NO: 7685 - DNA, 20 bp, synthetic construct
  misc_feature 1..20: note = CRISPR gRNA sequence
  source 1..20: mol_type = other DNA
tttgcagatagaattaagtt

SEQ ID NO: 7686 - DNA, 20 bp, synthetic construct
  misc_feature 1..20: note = CRISPR gRNA sequence
  source 1..20: mol_type = other DNA
ttgcagatagaattaagtta

SEQ ID NO: 7687 - DNA, 20 bp, synthetic construct
  misc_feature 1..20: note = CRISPR gRNA sequence
  source 1..20: mol_type = other DNA
tgcagatagaattaagttaa

SEQ ID NO: 7688 - DNA, 20 bp, synthetic construct
  misc_feature 1..20: note = CRISPR gRNA sequence
  source 1..20: mol_type = other DNA
gcagatagaattaagttaag

SEQ ID NO: 7689 - DNA, 20 bp, synthetic construct
  misc_feature 1..20: note = CRISPR gRNA sequence
  source 1..20: mol_type = other DNA
atagaattaagttaaggggc

SEQ ID NO: 7690 - DNA, 20 bp, synthetic construct
  misc_feature 1..20: note = CRISPR gRNA sequence
  source 1..20: mol_type = other DNA
tagaattaagttaaggggct

SEQ ID NO: 7691 - DNA, 20 bp, synthetic construct
  misc_feature 1..20: note = CRISPR gRNA sequence
  source 1..20: mol_type = other DNA
ttaagttaaggggctgggtg

SEQ ID NO: 7692 - DNA, 20 bp, synthetic construct
  misc_feature 1..20: note = CRISPR gRNA sequence
  source 1..20: mol_type = other DNA
agttaaggggctgggtgcag

SEQ ID NO: 7693 - DNA, 20 bp, synthetic construct
  misc_feature 1..20: note = CRISPR gRNA sequence
  source 1..20: mol_type = other DNA
gtggctcatgcctgtaatcc

SEQ ID NO: 7694 - DNA, 20 bp, synthetic construct
  misc_feature 1..20: note = CRISPR gRNA sequence
  source 1..20: mol_type = other DNA
tgcctgtaatcccagcactt

SEQ ID NO: 7695 - DNA, 20 bp, synthetic construct
  misc_feature 1..20: note = CRISPR gRNA sequence
  source 1..20: mol_type = other DNA
gcctgtaatcccagcacttt

SEQ ID NO: 7696 - DNA, 20 bp, synthetic construct
  misc_feature 1..20: note = CRISPR gRNA sequence
  source 1..20: mol_type = other DNA
tgtaatcccagcactttggg

SEQ ID NO: 7697 - DNA, 20 bp, synthetic construct
  misc_feature 1..20: note = CRISPR gRNA sequence
  source 1..20: mol_type = other DNA
tcccagcactttgggaagct

SEQ ID NO: 7698 - DNA, 20 bp, synthetic construct
  misc_feature 1..20: note = CRISPR gRNA sequence
  source 1..20: mol_type = other DNA
gcactttgggaagctgagat

SEQ ID NO: 7699 - DNA, 20 bp, synthetic construct
  misc_feature 1..20: note = CRISPR gRNA sequence
  source 1..20: mol_type = other DNA
actttgggaagctgagattg

SEQ ID NO: 7700 - DNA, 20 bp, synthetic construct
  misc_feature 1..20: note = CRISPR gRNA sequence
  source 1..20: mol_type = other DNA
ctttgggaagctgagattgg

SEQ ID NO: 7701 - DNA, 20 bp, synthetic construct
  misc_feature 1..20: note = CRISPR gRNA sequence
  source 1..20: mol_type = other DNA
ctgagattggaggatcacct

SEQ ID NO: 7702 - DNA, 20 bp, synthetic construct
  misc_feature 1..20: note = CRISPR gRNA sequence
  source 1..20: mol_type = other DNA
tgagattggaggatcacctg

SEQ ID NO: 7703 - DNA, 20 bp, synthetic construct
  misc_feature 1..20: note = CRISPR gRNA sequence
  source 1..20: mol_type = other DNA
attggaggatcacctgaggt

SEQ ID NO: 7704 - DNA, 20 bp, synthetic construct
  misc_feature 1..20: note = CRISPR gRNA sequence
  source 1..20: mol_type = other DNA
ttggaggatcacctgaggtc

SEQ ID NO: 7705 - DNA, 20 bp, synthetic construct
  misc_feature 1..20: note = CRISPR gRNA sequence
  source 1..20: mol_type = other DNA
ggaggatcacctgaggtcag

SEQ ID NO: 7706 - DNA, 20 bp, synthetic construct
  misc_feature 1..20: note = CRISPR gRNA sequence
  source 1..20: mol_type = other DNA
tcacctgaggtcaggagttc

SEQ ID NO: 7707 - DNA, 20 bp, synthetic construct
  misc_feature 1..20: note = CRISPR gRNA sequence
  source 1..20: mol_type = other DNA
tgaggtcaggagttcaagac

SEQ ID NO: 7708 - DNA, 20 bp, synthetic construct
  misc_feature 1..20: note = CRISPR gRNA sequence
  source 1..20: mol_type = other DNA
tcaggagttcaagaccagcg

SEQ ID NO: 7709 - DNA, 20 bp, synthetic construct
  misc_feature 1..20: note = CRISPR gRNA sequence
  source 1..20: mol_type = other DNA
caagaccagcgtggccaaca

SEQ ID NO: 7710 - DNA, 20 bp, synthetic construct
  misc_feature 1..20: note = CRISPR gRNA sequence
  source 1..20: mol_type = other DNA
tctactaaaaatacaaaaat

SEQ ID NO: 7711 - DNA, 20 bp, synthetic construct
  misc_feature 1..20: note = CRISPR gRNA sequence
  source 1..20: mol_type = other DNA
ctaaaaatacaaaaattagc

SEQ ID NO: 7712 - DNA, 20 bp, synthetic construct
  misc_feature 1..20: note = CRISPR gRNA sequence
  source 1..20: mol_type = other DNA
atacaaaaattagctggtca

SEQ ID NO: 7713 - DNA, 20 bp, synthetic construct
  misc_feature 1..20: note = CRISPR gRNA sequence
  source 1..20: mol_type = other DNA
caaaaattagctggtcatgg

SEQ ID NO: 7714 - DNA, 20 bp, synthetic construct
  misc_feature 1..20: note = CRISPR gRNA sequence
  source 1..20: mol_type = other DNA
aattagctggtcatggtggt

SEQ ID NO: 7715 - DNA, 20 bp, synthetic construct
  misc_feature 1..20: note = CRISPR gRNA sequence
  source 1..20: mol_type = other DNA
gtggtgagcacctgtaatcc

SEQ ID NO: 7716 - DNA, 20 bp, synthetic construct
  misc_feature 1..20: note = CRISPR gRNA sequence
  source 1..20: mol_type = other DNA
cacctgtaatcccagctact

SEQ ID NO: 7717 - DNA, 20 bp, synthetic construct
  misc_feature 1..20: note = CRISPR gRNA sequence
  source 1..20: mol_type = other DNA
acctgtaatcccagctactc

SEQ ID NO: 7718 - DNA, 20 bp, synthetic construct
  misc_feature 1..20: note = CRISPR gRNA sequence
  source 1..20: mol_type = other DNA
ctgtaatcccagctactcag

SEQ ID NO: 7719 - DNA, 20 bp, synthetic construct
  misc_feature 1..20: note = CRISPR gRNA sequence
  source 1..20: mol_type = other DNA
atcccagctactcaggagac

SEQ ID NO: 7720 - DNA, 20 bp, synthetic construct
  misc_feature 1..20: note = CRISPR gRNA sequence
  source 1..20: mol_type = other DNA
tcccagctactcaggagact

SEQ ID NO: 7721 - DNA, 20 bp, synthetic construct
  misc_feature 1..20: note = CRISPR gRNA sequence
  source 1..20: mol_type = other DNA
cccagctactcaggagactg

SEQ ID NO: 7722 - DNA, 20 bp, synthetic construct
  misc_feature 1..20: note = CRISPR gRNA sequence
  source 1..20: mol_type = other DNA
agctactcaggagactgggg

SEQ ID NO: 7723 - DNA, 20 bp, synthetic construct
  misc_feature 1..20: note = CRISPR gRNA sequence
  source 1..20: mol_type = other DNA
gctactcaggagactggggc

SEQ ID NO: 7724 - DNA, 20 bp, synthetic construct
  misc_feature 1..20: note = CRISPR gRNA sequence
  source 1..20: mol_type = other DNA
tactcaggagactggggcag

SEQ ID NO: 7725 - DNA, 20 bp, synthetic construct
  misc_feature 1..20: note = CRISPR gRNA sequence
  source 1..20: mol_type = other DNA
ggcaggagaatcgcttgaac

SEQ ID NO: 7726 - DNA, 20 bp, synthetic construct
  misc_feature 1..20: note = CRISPR gRNA sequence
  source 1..20: mol_type = other DNA
gcaggagaatcgcttgaact

SEQ ID NO: 7727 - DNA, 20 bp, synthetic construct
  misc_feature 1..20: note = CRISPR gRNA sequence
  source 1..20: mol_type = other DNA
aggagaatcgcttgaactgg

SEQ ID NO: 7728 - DNA, 20 bp, synthetic construct
  misc_feature 1..20: note = CRISPR gRNA sequence
  source 1..20: mol_type = other DNA
ggagaatcgcttgaactggg

SEQ ID NO: 7729 - DNA, 20 bp, synthetic construct
  misc_feature 1..20: note = CRISPR gRNA sequence
  source 1..20: mol_type = other DNA
gaatcgcttgaactgggagg

SEQ ID NO: 7730 - DNA, 20 bp, synthetic construct
  misc_feature 1..20: note = CRISPR gRNA sequence
  source 1..20: mol_type = other DNA
atcgcttgaactgggaggtg

SEQ ID NO: 7731 - DNA, 20 bp, synthetic construct
  misc_feature 1..20: note = CRISPR gRNA sequence
  source 1..20: mol_type = other DNA
tcgcttgaactgggaggtgg

SEQ ID NO: 7732 - DNA, 20 bp, synthetic construct
  misc_feature 1..20: note = CRISPR gRNA sequence
  source 1..20: mol_type = other DNA
gaactgggaggtggaggttg

SEQ ID NO: 7733 - DNA, 20 bp, synthetic construct
  misc_feature 1..20: note = CRISPR gRNA sequence
  source 1..20: mol_type = other DNA
tgggaggtggaggttgcagt

SEQ ID NO: 7734 - DNA, 20 bp, synthetic construct
  misc_feature 1..20: note = CRISPR gRNA sequence
  source 1..20: mol_type = other DNA
gaggttgcagtgagccgata

SEQ ID NO: 7735 - DNA, 20 bp, synthetic construct
  misc_feature 1..20: note = CRISPR gRNA sequence
  source 1..20: mol_type = other DNA
gatacagcgccactgcattc

SEQ ID NO: 7736 - DNA, 20 bp, synthetic construct
  misc_feature 1..20: note = CRISPR gRNA sequence
  source 1..20: mol_type = other DNA
agcgccactgcattccagcc

SEQ ID NO: 7737 - DNA, 20 bp, synthetic construct
  misc_feature 1..20: note = CRISPR gRNA sequence
  source 1..20: mol_type = other DNA
gcgccactgcattccagcct

SEQ ID NO: 7738 - DNA, 20 bp, synthetic construct
  misc_feature 1..20: note = CRISPR gRNA sequence
  source 1..20: mol_type = other DNA
ctgcattccagcctgggcaa

SEQ ID NO: 7739 - DNA, 20 bp, synthetic construct
  misc_feature 1..20: note = CRISPR gRNA sequence
  source 1..20: mol_type = other DNA
gcattccagcctgggcaaca

SEQ ID NO: 7740 - DNA, 20 bp, synthetic construct
  misc_feature 1..20: note = CRISPR gRNA sequence
  source 1..20: mol_type = other DNA
tccagcctgggcaacagagc

SEQ ID NO: 7741 - DNA, 20 bp, synthetic construct
  misc_feature 1..20: note = CRISPR gRNA sequence
  source 1..20: mol_type = other DNA
agagcaagcctctgtctcaa

SEQ ID NO: 7742 - DNA, 20 bp, synthetic construct
  misc_feature 1..20: note = CRISPR gRNA sequence
  source 1..20: mol_type = other DNA
gcaagcctctgtctcaaaag

SEQ ID NO: 7743 - DNA, 20 bp, synthetic construct
  misc_feature 1..20: note = CRISPR gRNA sequence
  source 1..20: mol_type = other DNA
caagcctctgtctcaaaaga

SEQ ID NO: 7744 - DNA, 20 bp, synthetic construct
  misc_feature 1..20: note = CRISPR gRNA sequence
  source 1..20: mol_type = other DNA
gtctcaaaagaaggcaaaaa

SEQ ID NO: 7745 - DNA, 20 bp, synthetic construct
  misc_feature 1..20: note = CRISPR gRNA sequence
  source 1..20: mol_type = other DNA
agaaggcaaaaaaagaatta

SEQ ID NO: 7746 - DNA, 20 bp, synthetic construct
  misc_feature 1..20: note = CRISPR gRNA sequence
  source 1..20: mol_type = other DNA
atcttgaaatgacatcatcc

SEQ ID NO: 7747 - DNA, 20 bp, synthetic construct
  misc_feature 1..20: note = CRISPR gRNA sequence
  source 1..20: mol_type = other DNA
tgacatcatcctggattatc

SEQ ID NO: 7748 - DNA, 20 bp, synthetic construct
  misc_feature 1..20: note = CRISPR gRNA sequence
  source 1..20: mol_type = other DNA
gacatcatcctggattatct

SEQ ID NO: 7749 - DNA, 20 bp, synthetic construct
  misc_feature 1..20: note = CRISPR gRNA sequence
  source 1..20: mol_type = other DNA
atcatcctggattatctagg

SEQ ID NO: 7750 - DNA, 20 bp, synthetic construct
  misc_feature 1..20: note = CRISPR gRNA sequence
  source 1..20: mol_type = other DNA
tcatcctggattatctaggt

SEQ ID NO: 7751 - DNA, 20 bp, synthetic construct
  misc_feature 1..20: note = CRISPR gRNA sequence
  source 1..20: mol_type = other DNA
tgggtcctaaatccaatgac

SEQ ID NO: 7752 - DNA, 20 bp, synthetic construct
  misc_feature 1..20: note = CRISPR gRNA sequence
  source 1..20: mol_type = other DNA
ccaatgacaagtgtctttat

SEQ ID NO: 7753 - DNA, 20 bp, synthetic construct
  misc_feature 1..20: note = CRISPR gRNA sequence
  source 1..20: mol_type = other DNA
aatgacaagtgtctttataa

SEQ ID NO: 7754 - DNA, 20 bp, synthetic construct
  misc_feature 1..20: note = CRISPR gRNA sequence
  source 1..20: mol_type = other DNA
acaagtgtctttataagaga

SEQ ID NO: 7755 - DNA, 20 bp, synthetic construct
  misc_feature 1..20: note = CRISPR gRNA sequence
  source 1..20: mol_type = other DNA
aagtgtctttataagagaaa

SEQ ID NO: 7756 - DNA, 20 bp, synthetic construct
  misc_feature 1..20: note = CRISPR gRNA sequence
  source 1..20: mol_type = other DNA
gagaaagagacttgctacat

SEQ ID NO: 7757 - DNA, 20 bp, synthetic construct
  misc_feature 1..20: note = CRISPR gRNA sequence
  source 1..20: mol_type = other DNA
agaaagagacttgctacatg

SEQ ID NO: 7758 - DNA, 20 bp, synthetic construct
  misc_feature 1..20: note = CRISPR gRNA sequence
  source 1..20: mol_type = other DNA
aaagagacttgctacatgag

SEQ ID NO: 7759 - DNA, 20 bp, synthetic construct
  misc_feature 1..20: note = CRISPR gRNA sequence
  source 1..20: mol_type = other DNA
gagacttgctacatgaggag

SEQ ID NO: 7760 - DNA, 20 bp, synthetic construct
  misc_feature 1..20: note = CRISPR gRNA sequence
  source 1..20: mol_type = other DNA
agacttgctacatgaggagt

SEQ ID NO: 7761 - DNA, 20 bp, synthetic construct
  misc_feature 1..20: note = CRISPR gRNA sequence
  source 1..20: mol_type = other DNA
tacatgaggagtaggtgatg

SEQ ID NO: 7762 - DNA, 20 bp, synthetic construct
  misc_feature 1..20: note = CRISPR gRNA sequence
  source 1..20: mol_type = other DNA
agtaggtgatgtggccacta

SEQ ID NO: 7763 - DNA, 20 bp, synthetic construct
  misc_feature 1..20: note = CRISPR gRNA sequence
  source 1..20: mol_type = other DNA
gtgatgtggccactaaagct

SEQ ID NO: 7764 - DNA, 20 bp, synthetic construct
  misc_feature 1..20: note = CRISPR gRNA sequence
  source 1..20: mol_type = other DNA
gtggccactaaagctgagtt

SEQ ID NO: 7765 - DNA, 20 bp, synthetic construct
  misc_feature 1..20: note = CRISPR gRNA sequence
  source 1..20: mol_type = other DNA
ggccactaaagctgagttta

SEQ ID NO: 7766 - DNA, 20 bp, synthetic construct
  misc_feature 1..20: note = CRISPR gRNA sequence
  source 1..20: mol_type = other DNA
aagctgagtttagagtgatg

SEQ ID NO: 7767 - DNA, 20 bp, synthetic construct
  misc_feature 1..20: note = CRISPR gRNA sequence
  source 1..20: mol_type = other DNA
gtttagagtgatgcagccac

SEQ ID NO: 7768 - DNA, 20 bp, synthetic construct
  misc_feature 1..20: note = CRISPR gRNA sequence
  source 1..20: mol_type = other DNA
tgatgcagccacaagaccac

SEQ ID NO: 7769 - DNA, 20 bp, synthetic construct
  misc_feature 1..20: note = CRISPR gRNA sequence
  source 1..20: mol_type = other DNA
cagccacaagaccacaagtc

SEQ ID NO: 7770 - DNA, 20 bp, synthetic construct
  misc_feature 1..20: note = CRISPR gRNA sequence
  source 1..20: mol_type = other DNA
agccacaagaccacaagtca

SEQ ID NO: 7771 - DNA, 20 bp, synthetic construct
  misc_feature 1..20: note = CRISPR gRNA sequence
  source 1..20: mol_type = other DNA
gaccacaagtcaaggatcac

SEQ ID NO: 7772 - DNA, 20 bp, synthetic construct
  misc_feature 1..20: note = CRISPR gRNA sequence
  source 1..20: mol_type = other DNA
cacaagtcaaggatcaccag

SEQ ID NO: 7773 - DNA, 20 bp, synthetic construct
  misc_feature 1..20: note = CRISPR gRNA sequence
  source 1..20: mol_type = other DNA
caaggatcaccagtagttcc

SEQ ID NO: 7774 - DNA, 20 bp, synthetic construct
  misc_feature 1..20: note = CRISPR gRNA sequence
  source 1..20: mol_type = other DNA
ggatcaccagtagttcccag

SEQ ID NO: 7775 - DNA, 20 bp, synthetic construct
  misc_feature 1..20: note = CRISPR gRNA sequence
  source 1..20: mol_type = other DNA
caccagtagttcccagcagc

SEQ ID NO: 7776 - DNA, 20 bp, synthetic construct
  misc_feature 1..20: note = CRISPR gRNA sequence
  source 1..20: mol_type = other DNA
ccagtagttcccagcagcta

SEQ ID NO: 7777 - DNA, 20 bp, synthetic construct
  misc_feature 1..20: note = CRISPR gRNA sequence
  source 1..20: mol_type = other DNA
cagtagttcccagcagctag

SEQ ID NO: 7778 - DNA, 20 bp, synthetic construct
  misc_feature 1..20: note = CRISPR gRNA sequence
  source 1..20: mol_type = other DNA
gtagttcccagcagctagag

SEQ ID NO: 7779 - DNA, 20 bp, synthetic construct
  misc_feature 1..20: note = CRISPR gRNA sequence
  source 1..20: mol_type = other DNA
tagttcccagcagctagagg

SEQ ID NO: 7780 - DNA, 20 bp, synthetic construct
  misc_feature 1..20: note = CRISPR gRNA sequence
  source 1..20: mol_type = other DNA
tcccagcagctagaggaggc

SEQ ID NO: 7781 - DNA, 20 bp, synthetic construct
  misc_feature 1..20: note = CRISPR gRNA sequence
  source 1..20: mol_type = other DNA
cccagcagctagaggaggca

SEQ ID NO: 7782 - DNA, 20 bp, synthetic construct
  misc_feature 1..20: note = CRISPR gRNA sequence
  source 1..20: mol_type = other DNA
agcagctagaggaggcaagg

SEQ ID NO: 7783 - DNA, 20 bp, synthetic construct
  misc_feature 1..20: note = CRISPR gRNA sequence
  source 1..20: mol_type = other DNA
caaggaagcattctcccctc

SEQ ID NO: 7784 - DNA, 20 bp, synthetic construct
  misc_feature 1..20: note = CRISPR gRNA sequence
  source 1..20: mol_type = other DNA
gcattctcccctcgagcctc

SEQ ID NO: 7785 - DNA, 20 bp, synthetic construct
  misc_feature 1..20: note = CRISPR gRNA sequence
  source 1..20: mol_type = other DNA
attctcccctcgagcctcca

SEQ ID NO: 7786 - DNA, 20 bp, synthetic construct
  misc_feature 1..20: note = CRISPR gRNA sequence
  source 1..20: mol_type = other DNA
ttctcccctcgagcctccag

SEQ ID NO: 7787 - DNA, 20 bp, synthetic construct
  misc_feature 1..20: note = CRISPR gRNA sequence
  source 1..20: mol_type = other DNA
tcccctcgagcctccagagg

SEQ ID NO: 7788 - DNA, 20 bp, synthetic construct
  misc_feature 1..20: note = CRISPR gRNA sequence
  source 1..20: mol_type = other DNA
tcgagcctccagaggcagcg

SEQ ID NO: 7789 - DNA, 20 bp, synthetic construct
  misc_feature 1..20: note = CRISPR gRNA sequence
  source 1..20: mol_type = other DNA
gcgtggccctgctgacacct

SEQ ID NO: 7790 - DNA, 20 bp, synthetic construct
  misc_feature 1..20: note = CRISPR gRNA sequence
  source 1..20: mol_type = other DNA
gacaccttggcttcaacttc

SEQ ID NO: 7791 - DNA, 20 bp, synthetic construct
  misc_feature 1..20: note = CRISPR gRNA sequence
  source 1..20: mol_type = other DNA
tggcttcaacttctggcctc

SEQ ID NO: 7792 - DNA, 20 bp, synthetic construct
  misc_feature 1..20: note = CRISPR gRNA sequence
  source 1..20: mol_type = other DNA
cttctggcctccagaaccat

SEQ ID NO: 7793 - DNA, 20 bp, synthetic construct
  misc_feature 1..20: note = CRISPR gRNA sequence
  source 1..20: mol_type = other DNA
tctggcctccagaaccatga

SEQ ID NO: 7794 - DNA, 20 bp, synthetic construct
  misc_feature 1..20: note = CRISPR gRNA sequence
  source 1..20: mol_type = other DNA
tccagaaccatgagagaata

SEQ ID NO: 7795 - DNA, 20 bp, synthetic construct
  misc_feature 1..20: note = CRISPR gRNA sequence
  source 1..20: mol_type = other DNA
gaataaagtgctgttgttct

SEQ ID NO: 7796 - DNA, 20 bp, synthetic construct
  misc_feature 1..20: note = CRISPR gRNA sequence
  source 1..20: mol_type = other DNA
tgctgttgttctgagctacc

SEQ ID NO: 7797 - DNA, 20 bp, synthetic construct
  misc_feature 1..20: note = CRISPR gRNA sequence
  source 1..20: mol_type = other DNA
gttctgagctacctggatgc

SEQ ID NO: 7798 - DNA, 20 bp, synthetic construct
  misc_feature 1..20: note = CRISPR gRNA sequence
  source 1..20: mol_type = other DNA
tggatgctggtaccttgttt

SEQ ID NO: 7799 - DNA, 20 bp, synthetic construct
  misc_feature 1..20: note = CRISPR gRNA sequence
  source 1..20: mol_type = other DNA
atgctggtaccttgtttcag

SEQ ID NO: 7800 - DNA, 20 bp, synthetic construct
  misc_feature 1..20: note = CRISPR gRNA sequence
  source 1..20: mol_type = other DNA
gtaccttgtttcagcagccc

SEQ ID NO: 7801 - DNA, 20 bp, synthetic construct
  misc_feature 1..20: note = CRISPR gRNA sequence
  source 1..20: mol_type = other DNA
taccttgtttcagcagccct

SEQ ID NO: 7802 - DNA, 20 bp, synthetic construct
  misc_feature 1..20: note = CRISPR gRNA sequence
  source 1..20: mol_type = other DNA
cctgggaaatgaatatacca

SEQ ID NO: 7803 - DNA, 20 bp, synthetic construct
  misc_feature 1..20: note = CRISPR gRNA sequence
  source 1..20: mol_type = other DNA
atgaatataccatggaaaca

SEQ ID NO: 7804 - DNA, 20 bp, synthetic construct
  misc_feature 1..20: note = CRISPR gRNA sequence
  source 1..20: mol_type = other DNA
ggaaacatggacctgaacca

SEQ ID NO: 7805 - DNA, 20 bp, synthetic construct
  misc_feature 1..20: note = CRISPR gRNA sequence
  source 1..20: mol_type = other DNA
tggacctgaaccacggatcc

SEQ ID NO: 7806 - DNA, 20 bp, synthetic construct
  misc_feature 1..20: note = CRISPR gRNA sequence
  source 1..20: mol_type = other DNA
acctgaaccacggatcctgg

SEQ ID NO: 7807 - DNA, 20 bp, synthetic construct
  misc_feature 1..20: note = CRISPR gRNA sequence
  source 1..20: mol_type = other DNA
cctgaaccacggatcctggc

SEQ ID NO: 7808 - DNA, 20 bp, synthetic construct
  misc_feature 1..20: note = CRISPR gRNA sequence
  source 1..20: mol_type = other DNA
tgaaccacggatcctggcag

SEQ ID NO: 7809 - DNA, 20 bp, synthetic construct
  misc_feature 1..20: note = CRISPR gRNA sequence
  source 1..20: mol_type = other DNA
acggatcctggcaggagcct

SEQ ID NO: 7810 - DNA, 20 bp, synthetic construct
  misc_feature 1..20: note = CRISPR gRNA sequence
  source 1..20: mol_type = other DNA
ggatcctggcaggagcctta

SEQ ID NO: 7811 - DNA, 20 bp, synthetic construct
  misc_feature 1..20: note = CRISPR gRNA sequence
  source 1..20: mol_type = other DNA
gcaggagccttagagccaca

SEQ ID NO: 7812 - DNA, 20 bp, synthetic construct
  misc_feature 1..20: note = CRISPR gRNA sequence
  source 1..20: mol_type = other DNA
agccttagagccacacagat

SEQ ID NO: 7813 - DNA, 20 bp, synthetic construct
  misc_feature 1..20: note = CRISPR gRNA sequence
  source 1..20: mol_type = other DNA
gagccacacagatgagcctt

SEQ ID NO: 7814 - DNA, 20 bp, synthetic construct
  misc_feature 1..20: note = CRISPR gRNA sequence
  source 1..20: mol_type = other DNA
acacagatgagccttcagct

SEQ ID NO: 7815 - DNA, 20 bp, synthetic construct
  misc_feature 1..20: note = CRISPR gRNA sequence
  source 1..20: mol_type = other DNA
gccttcagcttggctttccc

SEQ ID NO: 7816 - DNA, 20 bp, synthetic construct
  misc_feature 1..20: note = CRISPR gRNA sequence
  source 1..20: mol_type = other DNA
tcagcttggctttccccagc

SEQ ID NO: 7817 - DNA, 20 bp, synthetic construct
  misc_feature 1..20: note = CRISPR gRNA sequence
  source 1..20: mol_type = other DNA
agcttggctttccccagcaa

SEQ ID NO: 7818 - DNA, 20 bp, synthetic construct
  misc_feature 1..20: note = CRISPR gRNA sequence
  source 1..20: mol_type = other DNA
agcaagagctacatgatctt

SEQ ID NO: 7819 - DNA, 20 bp, synthetic construct
  misc_feature 1..20: note = CRISPR gRNA sequence
  source 1..20: mol_type = other DNA
gcaagagctacatgatcttg

SEQ ID NO: 7820 - DNA, 20 bp, synthetic construct
  misc_feature 1..20: note = CRISPR gRNA sequence
  source 1..20: mol_type = other DNA
agagctacatgatcttgagg

SEQ ID NO: 7821 - DNA, 20 bp, synthetic construct
  misc_feature 1..20: note = CRISPR gRNA sequence
  source 1..20: mol_type = other DNA
aggaagctgcttgtcttctc

SEQ ID NO: 7822 - DNA, 20 bp, synthetic construct
  misc_feature 1..20: note = CRISPR gRNA sequence
  source 1..20: mol_type = other DNA
ggaagctgcttgtcttctct

SEQ ID NO: 7823 - DNA, 20 bp, synthetic construct
  misc_feature 1..20: note = CRISPR gRNA sequence
  source 1..20: mol_type = other DNA
gcttgtcttctctgggtctc

SEQ ID NO: 7824 - DNA, 20 bp, synthetic construct
  misc_feature 1..20: note = CRISPR gRNA sequence
  source 1..20: mol_type = other DNA
tcaagttcttcatctgccaa

SEQ ID NO: 7825 - DNA, 20 bp, synthetic construct
  misc_feature 1..20: note = CRISPR gRNA sequence
  source 1..20: mol_type = other DNA
aagttcttcatctgccaatg

SEQ ID NO: 7826 - DNA, 20 bp, synthetic construct
  misc_feature 1..20: note = CRISPR gRNA sequence
  source 1..20: mol_type = other DNA
agacaataatgcttacttcc

SEQ ID NO: 7827 - DNA, 20 bp, synthetic construct
  misc_feature 1..20: note = CRISPR gRNA sequence
  source 1..20: mol_type = other DNA
gacaataatgcttacttcct

SEQ ID NO: 7828 - DNA, 20 bp, synthetic construct
  misc_feature 1..20: note = CRISPR gRNA sequence
  source 1..20: mol_type = other DNA
gcttacttcctaggttttaa

SEQ ID NO: 7829 - DNA, 20 bp, synthetic construct
  misc_feature 1..20: note = CRISPR gRNA sequence
  source 1..20: mol_type = other DNA
taggttttaacagctttatt

SEQ ID NO: 7830 - DNA, 20 bp, synthetic construct
  misc_feature 1..20: note = CRISPR gRNA sequence
  source 1..20: mol_type = other DNA
atacaatttgcccacttaaa

SEQ ID NO: 7831 - DNA, 20 bp, synthetic construct
  misc_feature 1..20: note = CRISPR gRNA sequence
  source 1..20: mol_type = other DNA
atttgcccacttaaaaagta

SEQ ID NO: 7832 - DNA, 20 bp, synthetic construct
  misc_feature 1..20: note = CRISPR gRNA sequence
  source 1..20: mol_type = other DNA
tgcctgtaatcccaacactt

SEQ ID NO: 7833 - DNA, 20 bp, synthetic construct
  misc_feature 1..20: note = CRISPR gRNA sequence
  source 1..20: mol_type = other DNA
gcctgtaatcccaacacttt

SEQ ID NO: 7834 - DNA, 20 bp, synthetic construct
  misc_feature 1..20: note = CRISPR gRNA sequence
  source 1..20: mol_type = other DNA
ctgtaatcccaacactttgg

SEQ ID NO: 7835 - DNA, 20 bp, synthetic construct
  misc_feature 1..20: note = CRISPR gRNA sequence
  source 1..20: mol_type = other DNA
tgtaatcccaacactttggg

SEQ ID NO: 7836 - DNA, 20 bp, synthetic construct
  misc_feature 1..20: note = CRISPR gRNA sequence
  source 1..20: mol_type = other DNA
tcccaacactttgggaggcc

SEQ ID NO: 7837 - DNA, 20 bp, synthetic construct
  misc_feature 1..20: note = CRISPR gRNA sequence
  source 1..20: mol_type = other DNA
cccaacactttgggaggccg

SEQ ID NO: 7838 - DNA, 20 bp, synthetic construct
  misc_feature 1..20: note = CRISPR gRNA sequence
  source 1..20: mol_type = other DNA
caacactttgggaggccgag

SEQ ID NO: 7839 - DNA, 20 bp, synthetic construct
  misc_feature 1..20: note = CRISPR gRNA sequence
  source 1..20: mol_type = other DNA
actttgggaggccgaggaga

SEQ ID NO: 7840 - DNA, 20 bp, synthetic construct
  misc_feature 1..20: note = CRISPR gRNA sequence
  source 1..20: mol_type = other DNA
ctttgggaggccgaggagac

SEQ ID NO: 7841 - DNA, 20 bp, synthetic construct
  misc_feature 1..20: note = CRISPR gRNA sequence
  source 1..20: mol_type = other DNA
tgggaggccgaggagacagg

SEQ ID NO: 7842 - DNA, 20 bp, synthetic construct
  misc_feature 1..20: note = CRISPR gRNA sequence
  source 1..20: mol_type = other DNA
aggagacaggcggatcactt

SEQ ID NO: 7843 - DNA, 20 bp, synthetic construct
  misc_feature 1..20: note = CRISPR gRNA sequence
  source 1..20: mol_type = other DNA
ggagacaggcggatcacttg

SEQ ID NO: 7844 - DNA, 20 bp, synthetic construct
  misc_feature 1..20: note = CRISPR gRNA sequence
  source 1..20: mol_type = other DNA
acaggcggatcacttgaggt

SEQ ID NO: 7845 - DNA, 20 bp, synthetic construct
  misc_feature 1..20: note = CRISPR gRNA sequence
  source 1..20: mol_type = other DNA
caggcggatcacttgaggtc

SEQ ID NO: 7846 - DNA, 20 bp, synthetic construct
  misc_feature 1..20: note = CRISPR gRNA sequence
  source 1..20: mol_type = other DNA
ggcggatcacttgaggtcag

SEQ ID NO: 7847 - DNA, 20 bp, synthetic construct
  misc_feature 1..20: note = CRISPR gRNA sequence
  source 1..20: mol_type = other DNA
tcacttgaggtcaggagttt

SEQ ID NO: 7848 - DNA, 20 bp, synthetic construct
  misc_feature 1..20: note = CRISPR gRNA sequence
  source 1..20: mol_type = other DNA
tgaggtcaggagtttgagaa

SEQ ID NO: 7849 - DNA, 20 bp, synthetic construct
  misc_feature 1..20: note = CRISPR gRNA sequence
  source 1..20: mol_type = other DNA
tcaggagtttgagaacagcc

SEQ ID NO: 7850 - DNA, 20 bp, synthetic construct
  misc_feature 1..20: note = CRISPR gRNA sequence
  source 1..20: mol_type = other DNA
tgagaacagcctggccaaaa

SEQ ID NO: 7851 - DNA, 20 bp, synthetic construct
  misc_feature 1..20: note = CRISPR gRNA sequence
  source 1..20: mol_type = other DNA
tctactaaaaatgcaaaaat

SEQ ID NO: 7852 - DNA, 20 bp, synthetic construct
  misc_feature 1..20: note = CRISPR gRNA sequence
  source 1..20: mol_type = other DNA
ctaaaaatgcaaaaattagc

SEQ ID NO: 7853 - DNA, 20 bp, synthetic construct
  misc_feature 1..20: note = CRISPR gRNA sequence
  source 1..20: mol_type = other DNA
taaaaatgcaaaaattagcc

SEQ ID NO: 7854 - DNA, 20 bp, synthetic construct
  misc_feature 1..20: note = CRISPR gRNA sequence
  source 1..20: mol_type = other DNA
atgcaaaaattagccgggtg

SEQ ID NO: 7855 - DNA, 20 bp, synthetic construct
  misc_feature 1..20: note = CRISPR gRNA sequence
  source 1..20: mol_type = other DNA
caaaaattagccgggtgtgg

SEQ ID NO: 7856 - DNA, 20 bp, synthetic construct
  misc_feature 1..20: note = CRISPR gRNA sequence
  source 1..20: mol_type = other DNA
aaattagccgggtgtggtgg

SEQ ID NO: 7857 - DNA, 20 bp, synthetic construct
  misc_feature 1..20: note = CRISPR gRNA sequence
  source 1..20: mol_type = other DNA
aattagccgggtgtggtggt

SEQ ID NO: 7858 - DNA, 20 bp, synthetic construct
  misc_feature 1..20: note = CRISPR gRNA sequence
  source 1..20: mol_type = other DNA
gtggtgggtgcctgtaatcc

SEQ ID NO: 7859 - DNA, 20 bp, synthetic construct
  misc_feature 1..20: note = CRISPR gRNA sequence
  source 1..20: mol_type = other DNA
tgcctgtaatcccagctgct

SEQ ID NO: 7860 - DNA, 20 bp, synthetic construct
  misc_feature 1..20: note = CRISPR gRNA sequence
  source 1..20: mol_type = other DNA
gcctgtaatcccagctgctc

SEQ ID NO: 7861 - DNA, 20 bp, synthetic construct
  misc_feature 1..20: note = CRISPR gRNA sequence
  source 1..20: mol_type = other DNA
ctgtaatcccagctgctcag

SEQ ID NO: 7862 - DNA, 20 bp, synthetic construct
  misc_feature 1..20: note = CRISPR gRNA sequence
  source 1..20: mol_type = other DNA
tgtaatcccagctgctcagg

SEQ ID NO: 7863 - DNA, 20 bp, synthetic construct
  misc_feature 1..20: note = CRISPR gRNA sequence
  source 1..20: mol_type = other DNA
tcccagctgctcaggaggct

SEQ ID NO: 7864 - DNA, 20 bp, synthetic construct
  misc_feature 1..20: note = CRISPR gRNA sequence
  source 1..20: mol_type = other DNA
cccagctgctcaggaggctg

SEQ ID NO: 7865 - DNA, 20 bp, synthetic construct
  misc_feature 1..20: note = CRISPR gRNA sequence
  source 1..20: mol_type = other DNA
agctgctcaggaggctgagg

SEQ ID NO: 7866 - DNA, 20 bp, synthetic construct
  misc_feature 1..20: note = CRISPR gRNA sequence
  source 1..20: mol_type = other DNA
tgctcaggaggctgaggcag

SEQ ID NO: 7867 - DNA, 20 bp, synthetic construct
  misc_feature 1..20: note = CRISPR gRNA sequence
  source 1..20: mol_type = other DNA
aggaggctgaggcagaagaa

SEQ ID NO: 7868 - DNA, 20 bp, synthetic construct
  misc_feature 1..20: note = CRISPR gRNA sequence
  source 1..20: mol_type = other DNA
gcagaagaatggcttgaacc

SEQ ID NO: 7869 - DNA, 20 bp, synthetic construct
  misc_feature 1..20: note = CRISPR gRNA sequence
  source 1..20: mol_type = other DNA
cagaagaatggcttgaacct

SEQ ID NO: 7870 - DNA, 20 bp, synthetic construct
  misc_feature 1..20: note = CRISPR gRNA sequence
  source 1..20: mol_type = other DNA
gaagaatggcttgaacctgg

SEQ ID NO: 7871 - DNA, 20 bp, synthetic construct
  misc_feature 1..20: note = CRISPR gRNA sequence
  source 1..20: mol_type = other DNA
aagaatggcttgaacctggg

SEQ ID NO: 7872 - DNA, 20 bp, synthetic construct
  misc_feature 1..20: note = CRISPR gRNA sequence
  source 1..20: mol_type = other DNA
aatggcttgaacctgggagg

SEQ ID NO: 7873 - DNA, 20 bp, synthetic construct
  misc_feature 1..20: note = CRISPR gRNA sequence
  source 1..20: mol_type = other DNA
aacctgggaggcagacgttg

SEQ ID NO: 7874 - DNA, 20 bp, synthetic construct
  misc_feature 1..20: note = CRISPR gRNA sequence
  source 1..20: mol_type = other DNA
tgggaggcagacgttgcagt

SEQ ID NO: 7875 - DNA, 20 bp, synthetic construct
  misc_feature 1..20: note = CRISPR gRNA sequence
  source 1..20: mol_type = other DNA
ggcagacgttgcagtgagcc

SEQ ID NO: 7876 - DNA, 20 bp, synthetic construct
  misc_feature 1..20: note = CRISPR gRNA sequence
  source 1..20: mol_type = other DNA
aagattgcacccctgcactc

SEQ ID NO: 7877 - DNA, 20 bp, synthetic construct
  misc_feature 1..20: note = CRISPR gRNA sequence
  source 1..20: mol_type = other DNA
tgcacccctgcactccagcc

SEQ ID NO: 7878 - DNA, 20 bp, synthetic construct
  misc_feature 1..20: note = CRISPR gRNA sequence
  source 1..20: mol_type = other DNA
gcacccctgcactccagcct

SEQ ID NO: 7879 - DNA, 20 bp, synthetic construct
  misc_feature 1..20: note = CRISPR gRNA sequence
  source 1..20: mol_type = other DNA
ctgcactccagcctgggtga

SEQ ID NO: 7880 - DNA, 20 bp, synthetic construct
  misc_feature 1..20: note = CRISPR gRNA sequence
  source 1..20: mol_type = other DNA
gcactccagcctgggtgaca

SEQ ID NO: 7881 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 7882 - DNA, 20 bp, synthetic construct
  misc_feature 1..20: note = CRISPR gRNA sequence
  source 1..20: mol_type = other DNA
aaaaaaaaaaaaaaaaaaag

SEQ ID NO: 7883 - DNA, 20 bp, synthetic construct
  misc_feature 1..20: note = CRISPR gRNA sequence
  source 1..20: mol_type = other DNA
aaaaaaaaaaaaaaaaagta

SEQ ID NO: 7884 - DNA, 20 bp, synthetic construct
  misc_feature 1..20: note = CRISPR gRNA sequence
  source 1..20: mol_type = other DNA
aaaaaaaaaaaagtagagtt

SEQ ID NO: 7885 - DNA, 20 bp, synthetic construct
  misc_feature 1..20: note = CRISPR gRNA sequence
  source 1..20: mol_type = other DNA
agtagagttcagtgttcttt

SEQ ID NO: 7886 - DNA, 20 bp, synthetic construct
  misc_feature 1..20: note = CRISPR gRNA sequence
  source 1..20: mol_type = other DNA
gtagagttcagtgttctttt

SEQ ID NO: 7887 - DNA, 20 bp, synthetic construct
  misc_feature 1..20: note = CRISPR gRNA sequence
  source 1..20: mol_type = other DNA
agtgttcttttgggaatact

SEQ ID NO: 7888 - DNA, 20 bp, synthetic construct
  misc_feature 1..20: note = CRISPR gRNA sequence
  source 1..20: mol_type = other DNA
tgttcttttgggaatactca

SEQ ID NO: 7889 - DNA, 20 bp, synthetic construct
  misc_feature 1..20: note = CRISPR gRNA sequence
  source 1..20: mol_type = other DNA
ttcttttgggaatactcaga

SEQ ID NO: 7890 - DNA, 20 bp, synthetic construct
  misc_feature 1..20: note = CRISPR gRNA sequence
  source 1..20: mol_type = other DNA
gtgaccatctcccatcccca

SEQ ID NO: 7891 - DNA, 20 bp, synthetic construct
  misc_feature 1..20: note = CRISPR gRNA sequence
  source 1..20: mol_type = other DNA
cccatccccacagtcaattt

SEQ ID NO: 7892 - DNA, 20 bp, synthetic construct
  misc_feature 1..20: note = CRISPR gRNA sequence
  source 1..20: mol_type = other DNA
gcacatttcatcacccccta

SEQ ID NO: 7893 - DNA, 20 bp, synthetic construct
  misc_feature 1..20: note = CRISPR gRNA sequence
  source 1..20: mol_type = other DNA
atcaccccctaaagaaactc

SEQ ID NO: 7894 - DNA, 20 bp, synthetic construct
  misc_feature 1..20: note = CRISPR gRNA sequence
  source 1..20: mol_type = other DNA
taaagaaactccagacccat

SEQ ID NO: 7895 - DNA, 20 bp, synthetic construct
  misc_feature 1..20: note = CRISPR gRNA sequence
  source 1..20: mol_type = other DNA
agaaactccagacccatcag

SEQ ID NO: 7896 - DNA, 20 bp, synthetic construct
  misc_feature 1..20: note = CRISPR gRNA sequence
  source 1..20: mol_type = other DNA
ttccaaaatccctctctgcc

SEQ ID NO: 7897 - DNA, 20 bp, synthetic construct
  misc_feature 1..20: note = CRISPR gRNA sequence
  source 1..20: mol_type = other DNA
aatccctctctgccaagccc

SEQ ID NO: 7898 - DNA, 20 bp, synthetic construct
  misc_feature 1..20: note = CRISPR gRNA sequence
  source 1..20: mol_type = other DNA
atccctctctgccaagccct

SEQ ID NO: 7899 - DNA, 20 bp, synthetic construct
  misc_feature 1..20: note = CRISPR gRNA sequence
  source 1..20: mol_type = other DNA
ctttcttaaaaaaaaattaa

SEQ ID NO: 7900 - DNA, 20 bp, synthetic construct
  misc_feature 1..20: note = CRISPR gRNA sequence
  source 1..20: mol_type = other DNA
ttcttaaaaaaaaattaata

SEQ ID NO: 7901 - DNA, 20 bp, synthetic construct
  misc_feature 1..20: note = CRISPR gRNA sequence
  source 1..20: mol_type = other DNA
taaaaaaaaattaatagaga

SEQ ID NO: 7902 - DNA, 20 bp, synthetic construct
  misc_feature 1..20: note = CRISPR gRNA sequence
  source 1..20: mol_type = other DNA
aaaaaaaaattaatagagat

SEQ ID NO: 7903 - DNA, 20 bp, synthetic construct
  misc_feature 1..20: note = CRISPR gRNA sequence
  source 1..20: mol_type = other DNA
taggcttttgctatgttgcc

SEQ ID NO: 7904 - DNA, 20 bp, synthetic construct
  misc_feature 1..20: note = CRISPR gRNA sequence
  source 1..20: mol_type = other DNA
aggcttttgctatgttgccc

SEQ ID NO: 7905 - DNA, 20 bp, synthetic construct
  misc_feature 1..20: note = CRISPR gRNA sequence
  source 1..20: mol_type = other DNA
ttttgctatgttgcccaggc

SEQ ID NO: 7906 - DNA, 20 bp, synthetic construct
  misc_feature 1..20: note = CRISPR gRNA sequence
  source 1..20: mol_type = other DNA
ccaggctggtcttgaacacc

SEQ ID NO: 7907 - DNA, 20 bp, synthetic construct
  misc_feature 1..20: note = CRISPR gRNA sequence
  source 1..20: mol_type = other DNA
caggctggtcttgaacacct

SEQ ID NO: 7908 - DNA, 20 bp, synthetic construct
  misc_feature 1..20: note = CRISPR gRNA sequence
  source 1..20: mol_type = other DNA
ggtcttgaacacctgggctc

SEQ ID NO: 7909 - DNA, 20 bp, synthetic construct
  misc_feature 1..20: note = CRISPR gRNA sequence
  source 1..20: mol_type = other DNA
ctcaagcgattctcctgtct

SEQ ID NO: 7910 - DNA, 20 bp, synthetic construct
  misc_feature 1..20: note = CRISPR gRNA sequence
  source 1..20: mol_type = other DNA
tctcctgtctcagcctccca

SEQ ID NO: 7911 - DNA, 20 bp, synthetic construct
  misc_feature 1..20: note = CRISPR gRNA sequence
  source 1..20: mol_type = other DNA
gtctcagcctcccaaagtgc

SEQ ID NO: 7912 - DNA, 20 bp, synthetic construct
  misc_feature 1..20: note = CRISPR gRNA sequence
  source 1..20: mol_type = other DNA
tctcagcctcccaaagtgct

SEQ ID NO: 7913 - DNA, 20 bp, synthetic construct
  misc_feature 1..20: note = CRISPR gRNA sequence
  source 1..20: mol_type = other DNA
ctcccaaagtgctgggattt

SEQ ID NO: 7914 - DNA, 20 bp, synthetic construct
  misc_feature 1..20: note = CRISPR gRNA sequence
  source 1..20: mol_type = other DNA
tcccaaagtgctgggatttc

SEQ ID NO: 7915 - DNA, 20 bp, synthetic construct
  misc_feature 1..20: note = CRISPR gRNA sequence
  source 1..20: mol_type = other DNA
agtgctgggatttcaggcat

SEQ ID NO: 7916 - DNA, 20 bp, synthetic construct
  misc_feature 1..20: note = CRISPR gRNA sequence
  source 1..20: mol_type = other DNA
cctcctactttatgtctcca

SEQ ID NO: 7917 - DNA, 20 bp, synthetic construct
  misc_feature 1..20: note = CRISPR gRNA sequence
  source 1..20: mol_type = other DNA
ctccatggatttgcctgttt

SEQ ID NO: 7918 - DNA, 20 bp, synthetic construct
  misc_feature 1..20: note = CRISPR gRNA sequence
  source 1..20: mol_type = other DNA
ttttggtcatttcaaataaa

SEQ ID NO: 7919 - DNA, 20 bp, synthetic construct
  misc_feature 1..20: note = CRISPR gRNA sequence
  source 1..20: mol_type = other DNA
aatatgtgaccctttgtgtc

SEQ ID NO: 7920 - DNA, 20 bp, synthetic construct
  misc_feature 1..20: note = CRISPR gRNA sequence
  source 1..20: mol_type = other DNA
ttgtgtccggcttcttcact

SEQ ID NO: 7921 - DNA, 20 bp, synthetic construct
  misc_feature 1..20: note = CRISPR gRNA sequence
  source 1..20: mol_type = other DNA
cttcacttagcatttttttt

SEQ ID NO: 7922 - DNA, 20 bp, synthetic construct
  misc_feature 1..20: note = CRISPR gRNA sequence
  source 1..20: mol_type = other DNA
ttcacttagcatttttttta

SEQ ID NO: 7923 - DNA, 20 bp, synthetic construct
  misc_feature 1..20: note = CRISPR gRNA sequence
  source 1..20: mol_type = other DNA
tttaaggttcatccatgttc

SEQ ID NO: 7924 - DNA, 20 bp, synthetic construct
  misc_feature 1..20: note = CRISPR gRNA sequence
  source 1..20: mol_type = other DNA
atccatgttccagcatgtat

SEQ ID NO: 7925 - DNA, 20 bp, synthetic construct
  misc_feature 1..20: note = CRISPR gRNA sequence
  source 1..20: mol_type = other DNA
tcagtgctttctccctttaa

SEQ ID NO: 7926 - DNA, 20 bp, synthetic construct
  misc_feature 1..20: note = CRISPR gRNA sequence
  source 1..20: mol_type = other DNA
gtgctttctccctttaatgg

SEQ ID NO: 7927 - DNA, 20 bp, synthetic construct
  misc_feature 1..20: note = CRISPR gRNA sequence
  source 1..20: mol_type = other DNA
tggtggaatactttattgta

SEQ ID NO: 7928 - DNA, 20 bp, synthetic construct
  misc_feature 1..20: note = CRISPR gRNA sequence
  source 1..20: mol_type = other DNA
gaatactttattgtatagat

SEQ ID NO: 7929 - DNA, 20 bp, synthetic construct
  misc_feature 1..20: note = CRISPR gRNA sequence
  source 1..20: mol_type = other DNA
ttgtttatccatttattttt

SEQ ID NO: 7930 - DNA, 20 bp, synthetic construct
  misc_feature 1..20: note = CRISPR gRNA sequence
  source 1..20: mol_type = other DNA
tttatccatttattttttgg

SEQ ID NO: 7931 - DNA, 20 bp, synthetic construct
  misc_feature 1..20: note = CRISPR gRNA sequence
  source 1..20: mol_type = other DNA
tttattttttggtggatatt

SEQ ID NO: 7932 - DNA, 20 bp, synthetic construct
  misc_feature 1..20: note = CRISPR gRNA sequence
  source 1..20: mol_type = other DNA
ttattttttggtggatattt

SEQ ID NO: 7933 - DNA, 20 bp, synthetic construct
  misc_feature 1..20: note = CRISPR gRNA sequence
  source 1..20: mol_type = other DNA
tttgggctgtttttatattt

SEQ ID NO: 7934 - DNA, 20 bp, synthetic construct
  misc_feature 1..20: note = CRISPR gRNA sequence
  source 1..20: mol_type = other DNA
cttctgtgaacattcgtgta

SEQ ID NO: 7935 - DNA, 20 bp, synthetic construct
  misc_feature 1..20: note = CRISPR gRNA sequence
  source 1..20: mol_type = other DNA
ttctgtgaacattcgtgtat

SEQ ID NO: 7936 - DNA, 20 bp, synthetic construct
  misc_feature 1..20: note = CRISPR gRNA sequence
  source 1..20: mol_type = other DNA
ttcgtgtataggtttttgtg

SEQ ID NO: 7937 - DNA, 20 bp, synthetic construct
  misc_feature 1..20: note = CRISPR gRNA sequence
  source 1..20: mol_type = other DNA
ggtttttgtgtggatatatc

SEQ ID NO: 7938 - DNA, 20 bp, synthetic construct
  misc_feature 1..20: note = CRISPR gRNA sequence
  source 1..20: mol_type = other DNA
cataatatgatacatattta

SEQ ID NO: 7939 - DNA, 20 bp, synthetic construct
  misc_feature 1..20: note = CRISPR gRNA sequence
  source 1..20: mol_type = other DNA
ataatatgatacatatttat

SEQ ID NO: 7940 - DNA, 20 bp, synthetic construct
  misc_feature 1..20: note = CRISPR gRNA sequence
  source 1..20: mol_type = other DNA
taatatgatacatatttatg

SEQ ID NO: 7941 - DNA, 20 bp, synthetic construct
  misc_feature 1..20: note = CRISPR gRNA sequence
  source 1..20: mol_type = other DNA
gtgaatatttattacatgca

SEQ ID NO: 7942 - DNA, 20 bp, synthetic construct
  misc_feature 1..20: note = CRISPR gRNA sequence
  source 1..20: mol_type = other DNA
aatatttattacatgcatag

SEQ ID NO: 7943 - DNA, 20 bp, synthetic construct
  misc_feature 1..20: note = CRISPR gRNA sequence
  source 1..20: mol_type = other DNA
atatttattacatgcataga

SEQ ID NO: 7944 - DNA, 20 bp, synthetic construct
  misc_feature 1..20: note = CRISPR gRNA sequence
  source 1..20: mol_type = other DNA
agaaggtataatgatcatgt

SEQ ID NO: 7945 - DNA, 20 bp, synthetic construct
  misc_feature 1..20: note = CRISPR gRNA sequence
  source 1..20: mol_type = other DNA
gaaggtataatgatcatgtc

SEQ ID NO: 7946 - DNA, 20 bp, synthetic construct
  misc_feature 1..20: note = CRISPR gRNA sequence
  source 1..20: mol_type = other DNA
atgatcatgtcaggatattt

SEQ ID NO: 7947 - DNA, 20 bp, synthetic construct
  misc_feature 1..20: note = CRISPR gRNA sequence
  source 1..20: mol_type = other DNA
tgatcatgtcaggatatttg

SEQ ID NO: 7948 - DNA, 20 bp, synthetic construct
  misc_feature 1..20: note = CRISPR gRNA sequence
  source 1..20: mol_type = other DNA
atatttgaggtatccacatt

SEQ ID NO: 7949 - DNA, 20 bp, synthetic construct
  misc_feature 1..20: note = CRISPR gRNA sequence
  source 1..20: mol_type = other DNA
tatttgaggtatccacattt

SEQ ID NO: 7950 - DNA, 20 bp, synthetic construct
  misc_feature 1..20: note = CRISPR gRNA sequence
  source 1..20: mol_type = other DNA
tccacatttgggattgttta

SEQ ID NO: 7951 - DNA, 20 bp, synthetic construct
  misc_feature 1..20: note = CRISPR gRNA sequence
  source 1..20: mol_type = other DNA
tgtttaaagattaaatgaaa

SEQ ID NO: 7952 - DNA, 20 bp, synthetic construct
  misc_feature 1..20: note = CRISPR gRNA sequence
  source 1..20: mol_type = other DNA
attaaatgaaatagtgttaa

SEQ ID NO: 7953 - DNA, 20 bp, synthetic construct
  misc_feature 1..20: note = CRISPR gRNA sequence
  source 1..20: mol_type = other DNA
tatgcccttcaacaaatgat

SEQ ID NO: 7954 - DNA, 20 bp, synthetic construct
  misc_feature 1..20: note = CRISPR gRNA sequence
  source 1..20: mol_type = other DNA
atgcccttcaacaaatgatg

SEQ ID NO: 7955 - DNA, 20 bp, synthetic construct
  misc_feature 1..20: note = CRISPR gRNA sequence
  source 1..20: mol_type = other DNA
aacaaatgatgaggaaatct

SEQ ID NO: 7956 - DNA, 20 bp, synthetic construct
  misc_feature 1..20: note = CRISPR gRNA sequence
  source 1..20: mol_type = other DNA
aggaaatcttagaatctgct

SEQ ID NO: 7957 - DNA, 20 bp, synthetic construct
  misc_feature 1..20: note = CRISPR gRNA sequence
  source 1..20: mol_type = other DNA
agaatctgctcagactcctt

SEQ ID NO: 7958 - DNA, 20 bp, synthetic construct
  misc_feature 1..20: note = CRISPR gRNA sequence
  source 1..20: mol_type = other DNA
gactccttcagtttacatat

SEQ ID NO: 7959 - DNA, 20 bp, synthetic construct
  misc_feature 1..20: note = CRISPR gRNA sequence
  source 1..20: mol_type = other DNA
actccttcagtttacatatt

SEQ ID NO: 7960 - DNA, 20 bp, synthetic construct
  misc_feature 1..20: note = CRISPR gRNA sequence
  source 1..20: mol_type = other DNA
agtttacatattaggaaact

SEQ ID NO: 7961 - DNA, 20 bp, synthetic construct
  misc_feature 1..20: note = CRISPR gRNA sequence
  source 1..20: mol_type = other DNA
gtttacatattaggaaactg

SEQ ID NO: 7962 - DNA, 20 bp, synthetic construct
  misc_feature 1..20: note = CRISPR gRNA sequence
  source 1..20: mol_type = other DNA
catattaggaaactgaggca

SEQ ID NO: 7963 - DNA, 20 bp, synthetic construct
  misc_feature 1..20: note = CRISPR gRNA sequence
  source 1..20: mol_type = other DNA
ttaggaaactgaggcacaga

SEQ ID NO: 7964 - DNA, 20 bp, synthetic construct
  misc_feature 1..20: note = CRISPR gRNA sequence
  source 1..20: mol_type = other DNA
taggaaactgaggcacagaa

SEQ ID NO: 7965 - DNA, 20 bp, synthetic construct
  misc_feature 1..20: note = CRISPR gRNA sequence
  source 1..20: mol_type = other DNA
ggaaactgaggcacagaaag

SEQ ID NO: 7966 - DNA, 20 bp, synthetic construct
  misc_feature 1..20: note = CRISPR gRNA sequence
  source 1..20: mol_type = other DNA
aactgaggcacagaaaggag

SEQ ID NO: 7967 - DNA, 20 bp, synthetic construct
  misc_feature 1..20: note = CRISPR gRNA sequence
  source 1..20: mol_type = other DNA
ctgaggcacagaaaggagca

SEQ ID NO: 7968 - DNA, 20 bp, synthetic construct
  misc_feature 1..20: note = CRISPR gRNA sequence
  source 1..20: mol_type = other DNA
aaaggagcagagacttgctc

SEQ ID NO: 7969 - DNA, 20 bp, synthetic construct
  misc_feature 1..20: note = CRISPR gRNA sequence
  source 1..20: mol_type = other DNA
gacttgctcaagtccaccca

SEQ ID NO: 7970 - DNA, 20 bp, synthetic construct
  misc_feature 1..20: note = CRISPR gRNA sequence
  source 1..20: mol_type = other DNA
ttgctcaagtccacccaaag

SEQ ID NO: 7971 - DNA, 20 bp, synthetic construct
  misc_feature 1..20: note = CRISPR gRNA sequence
  source 1..20: mol_type = other DNA
ctcaagtccacccaaagcag

SEQ ID NO: 7972 - DNA, 20 bp, synthetic construct
  misc_feature 1..20: note = CRISPR gRNA sequence
  source 1..20: mol_type = other DNA
caagtccacccaaagcagta

SEQ ID NO: 7973 - DNA, 20 bp, synthetic construct
  misc_feature 1..20: note = CRISPR gRNA sequence
  source 1..20: mol_type = other DNA
cccaaagcagtagagcattg

SEQ ID NO: 7974 - DNA, 20 bp, synthetic construct
  misc_feature 1..20: note = CRISPR gRNA sequence
  source 1..20: mol_type = other DNA
tagagcattgtggttaaatg

SEQ ID NO: 7975 - DNA, 20 bp, synthetic construct
  misc_feature 1..20: note = CRISPR gRNA sequence
  source 1..20: mol_type = other DNA
agagcattgtggttaaatgc

SEQ ID NO: 7976 - DNA, 20 bp, synthetic construct
  misc_feature 1..20: note = CRISPR gRNA sequence
  source 1..20: mol_type = other DNA
tgtggttaaatgcaggactt

SEQ ID NO: 7977 - DNA, 20 bp, synthetic construct
  misc_feature 1..20: note = CRISPR gRNA sequence
  source 1..20: mol_type = other DNA
gttaaatgcaggacttcagt

SEQ ID NO: 7978 - DNA, 20 bp, synthetic construct
  misc_feature 1..20: note = CRISPR gRNA sequence
  source 1..20: mol_type = other DNA
aggacttcagtcagactgtc

SEQ ID NO: 7979 - DNA, 20 bp, synthetic construct
  misc_feature 1..20: note = CRISPR gRNA sequence
  source 1..20: mol_type = other DNA
ggacttcagtcagactgtct

SEQ ID NO: 7980 - DNA, 20 bp, synthetic construct
  misc_feature 1..20: note = CRISPR gRNA sequence
  source 1..20: mol_type = other DNA
gactgtctgggttcaaatcc

SEQ ID NO: 7981 - DNA, 20 bp, synthetic construct
  misc_feature 1..20: note = CRISPR gRNA sequence
  source 1..20: mol_type = other DNA
gttcaaatcctggttccact

SEQ ID NO: 7982 - DNA, 20 bp, synthetic construct
  misc_feature 1..20: note = CRISPR gRNA sequence
  source 1..20: mol_type = other DNA
atcctggttccacttggaca

SEQ ID NO: 7983 - DNA, 20 bp, synthetic construct
  misc_feature 1..20: note = CRISPR gRNA sequence
  source 1..20: mol_type = other DNA
tcctggttccacttggacat

SEQ ID NO: 7984 - DNA, 20 bp, synthetic construct
  misc_feature 1..20: note = CRISPR gRNA sequence
  source 1..20: mol_type = other DNA
ataaatcacttcacctctct

SEQ ID NO: 7985 - DNA, 20 bp, synthetic construct
  misc_feature 1..20: note = CRISPR gRNA sequence
  source 1..20: mol_type = other DNA
cacttcacctctctgagcct

SEQ ID NO: 7986 - DNA, 20 bp, synthetic construct
  misc_feature 1..20: note = CRISPR gRNA sequence
  source 1..20: mol_type = other DNA
cctcagttttctcatatgca

SEQ ID NO: 7987 - DNA, 20 bp, synthetic construct
  misc_feature 1..20: note = CRISPR gRNA sequence
  source 1..20: mol_type = other DNA
agttttctcatatgcaaagt

SEQ ID NO: 7988 - DNA, 20 bp, synthetic construct
  misc_feature 1..20: note = CRISPR gRNA sequence
  source 1..20: mol_type = other DNA
gttttctcatatgcaaagtg

SEQ ID NO: 7989 - DNA, 20 bp, synthetic construct
  misc_feature 1..20: note = CRISPR gRNA sequence
  source 1..20: mol_type = other DNA
ataataataccttccttaca

SEQ ID NO: 7990 - DNA, 20 bp, synthetic construct
  misc_feature 1..20: note = CRISPR gRNA sequence
  source 1..20: mol_type = other DNA
ccttacatggttactgatat

SEQ ID NO: 7991 - DNA, 20 bp, synthetic construct
  misc_feature 1..20: note = CRISPR gRNA sequence
  source 1..20: mol_type = other DNA
gatatgagtattaaatgtgc

SEQ ID NO: 7992 - DNA, 20 bp, synthetic construct
  misc_feature 1..20: note = CRISPR gRNA sequence
  source 1..20: mol_type = other DNA
aatgtgccagctcatgtgcc

SEQ ID NO: 7993 - DNA, 20 bp, synthetic construct
  misc_feature 1..20: note = CRISPR gRNA sequence
  source 1..20: mol_type = other DNA
cagctcatgtgcctggcgta

SEQ ID NO: 7994 - DNA, 20 bp, synthetic construct
  misc_feature 1..20: note = CRISPR gRNA sequence
  source 1..20: mol_type = other DNA
agctcatgtgcctggcgtat

SEQ ID NO: 7995 - DNA, 20 bp, synthetic construct
  misc_feature 1..20: note = CRISPR gRNA sequence
  source 1..20: mol_type = other DNA
ctcatgtgcctggcgtatag

SEQ ID NO: 7996 - DNA, 20 bp, synthetic construct
  misc_feature 1..20: note = CRISPR gRNA sequence
  source 1..20: mol_type = other DNA
tcatgtgcctggcgtatagg

SEQ ID NO: 7997 - DNA, 20 bp, synthetic construct
  misc_feature 1..20: note = CRISPR gRNA sequence
  source 1..20: mol_type = other DNA
aggaggtgctttataaacct

SEQ ID NO: 7998 - DNA, 20 bp, synthetic construct
  misc_feature 1..20: note = CRISPR gRNA sequence
  source 1..20: mol_type = other DNA
accttagctgttaccactca

SEQ ID NO: 7999 - DNA, 20 bp, synthetic construct
  misc_feature 1..20: note = CRISPR gRNA sequence
  source 1..20: mol_type = other DNA
actcatggcattgccaaatg

SEQ ID NO: 8000 - DNA, 20 bp, synthetic construct
  misc_feature 1..20: note = CRISPR gRNA sequence
  source 1..20: mol_type = other DNA
ctcatggcattgccaaatgt

SEQ ID NO: 8001 - DNA, 20 bp, synthetic construct
  misc_feature 1..20: note = CRISPR gRNA sequence
  source 1..20: mol_type = other DNA
tggcattgccaaatgtggga

SEQ ID NO: 8002 - DNA, 20 bp, synthetic construct
  misc_feature 1..20: note = CRISPR gRNA sequence
  source 1..20: mol_type = other DNA
ggcattgccaaatgtgggac

SEQ ID NO: 8003 - DNA, 20 bp, synthetic construct
  misc_feature 1..20: note = CRISPR gRNA sequence
  source 1..20: mol_type = other DNA
ggacgggtctcctgactctc

SEQ ID NO: 8004 - DNA, 20 bp, synthetic construct
  misc_feature 1..20: note = CRISPR gRNA sequence
  source 1..20: mol_type = other DNA
gtctcctgactctctggtgt

SEQ ID NO: 8005 - DNA, 20 bp, synthetic construct
  misc_feature 1..20: note = CRISPR gRNA sequence
  source 1..20: mol_type = other DNA
actctctggtgtgagattga

SEQ ID NO: 8006 - DNA, 20 bp, synthetic construct
  misc_feature 1..20: note = CRISPR gRNA sequence
  source 1..20: mol_type = other DNA
ttgatggaatccacactttc

SEQ ID NO: 8007 - DNA, 20 bp, synthetic construct
  misc_feature 1..20: note = CRISPR gRNA sequence
  source 1..20: mol_type = other DNA
cagttcccttttctacctcc

SEQ ID NO: 8008 - DNA, 20 bp, synthetic construct
  misc_feature 1..20: note = CRISPR gRNA sequence
  source 1..20: mol_type = other DNA
agttcccttttctacctcct

SEQ ID NO: 8009 - DNA, 20 bp, synthetic construct
  misc_feature 1..20: note = CRISPR gRNA sequence
  source 1..20: mol_type = other DNA
ctcctgggtatcttctcata

SEQ ID NO: 8010 - DNA, 20 bp, synthetic construct
  misc_feature 1..20: note = CRISPR gRNA sequence
  source 1..20: mol_type = other DNA
gtatcttctcatatggttgt

SEQ ID NO: 8011 - DNA, 20 bp, synthetic construct
  misc_feature 1..20: note = CRISPR gRNA sequence
  source 1..20: mol_type = other DNA
tcatatggttgtaagttcct

SEQ ID NO: 8012 - DNA, 20 bp, synthetic construct
  misc_feature 1..20: note = CRISPR gRNA sequence
  source 1..20: mol_type = other DNA
atatggttgtaagttccttg

SEQ ID NO: 8013 - DNA, 20 bp, synthetic construct
  misc_feature 1..20: note = CRISPR gRNA sequence
  source 1..20: mol_type = other DNA
tatggttgtaagttccttgg

SEQ ID NO: 8014 - DNA, 20 bp, synthetic construct
  misc_feature 1..20: note = CRISPR gRNA sequence
  source 1..20: mol_type = other DNA
ggttgtaagttccttggagg

SEQ ID NO: 8015 - DNA, 20 bp, synthetic construct
  misc_feature 1..20: note = CRISPR gRNA sequence
  source 1..20: mol_type = other DNA
gttgtaagttccttggagga

SEQ ID NO: 8016 - DNA, 20 bp, synthetic construct
  misc_feature 1..20: note = CRISPR gRNA sequence
  source 1..20: mol_type = other DNA
ttgtaagttccttggaggaa

SEQ ID NO: 8017 - DNA, 20 bp, synthetic construct
  misc_feature 1..20: note = CRISPR gRNA sequence
  source 1..20: mol_type = other DNA
ttccttggaggaagggaatg

SEQ ID NO: 8018 - DNA, 20 bp, synthetic construct
  misc_feature 1..20: note = CRISPR gRNA sequence
  source 1..20: mol_type = other DNA
cttgctctctccaccacgct

SEQ ID NO: 8019 - DNA, 20 bp, synthetic construct
  misc_feature 1..20: note = CRISPR gRNA sequence
  source 1..20: mol_type = other DNA
ctccaccacgctgagcatat

SEQ ID NO: 8020 - DNA, 20 bp, synthetic construct
  misc_feature 1..20: note = CRISPR gRNA sequence
  source 1..20: mol_type = other DNA
ccaccacgctgagcatataa

SEQ ID NO: 8021 - DNA, 20 bp, synthetic construct
  misc_feature 1..20: note = CRISPR gRNA sequence
  source 1..20: mol_type = other DNA
caccacgctgagcatataag

SEQ ID NO: 8022 - DNA, 20 bp, synthetic construct
  misc_feature 1..20: note = CRISPR gRNA sequence
  source 1..20: mol_type = other DNA
gcatataagaggtgctgaat

SEQ ID NO: 8023 - DNA, 20 bp, synthetic construct
  misc_feature 1..20: note = CRISPR gRNA sequence
  source 1..20: mol_type = other DNA
ttattcactcctctcatccc

SEQ ID NO: 8024 - DNA, 20 bp, synthetic construct
  misc_feature 1..20: note = CRISPR gRNA sequence
  source 1..20: mol_type = other DNA
ctctcatccccagccctcac

SEQ ID NO: 8025 - DNA, 20 bp, synthetic construct
  misc_feature 1..20: note = CRISPR gRNA sequence
  source 1..20: mol_type = other DNA
catccccagccctcaccagc

SEQ ID NO: 8026 - DNA, 20 bp, synthetic construct
  misc_feature 1..20: note = CRISPR gRNA sequence
  source 1..20: mol_type = other DNA
atccccagccctcaccagct

SEQ ID NO: 8027 - DNA, 20 bp, synthetic construct
  misc_feature 1..20: note = CRISPR gRNA sequence
  source 1..20: mol_type = other DNA
ccccagccctcaccagctgg

SEQ ID NO: 8028 - DNA, 20 bp, synthetic construct
  misc_feature 1..20: note = CRISPR gRNA sequence
  source 1..20: mol_type = other DNA
tcaccagctgggagttgttg

SEQ ID NO: 8029 - DNA, 20 bp, synthetic construct
  misc_feature 1..20: note = CRISPR gRNA sequence
  source 1..20: mol_type = other DNA
caccagctgggagttgttgt

SEQ ID NO: 8030 - DNA, 20 bp, synthetic construct
  misc_feature 1..20: note = CRISPR gRNA sequence
  source 1..20: mol_type = other DNA
gcctctttccaacaccctgt

SEQ ID NO: 8031 - DNA, 20 bp, synthetic construct
  misc_feature 1..20: note = CRISPR gRNA sequence
  source 1..20: mol_type = other DNA
cctctttccaacaccctgtg

SEQ ID NO: 8032 - DNA, 20 bp, synthetic construct
  misc_feature 1..20: note = CRISPR gRNA sequence
  source 1..20: mol_type = other DNA
caacaccctgtgaggtgact

SEQ ID NO: 8033 - DNA, 20 bp, synthetic construct
  misc_feature 1..20: note = CRISPR gRNA sequence
  source 1..20: mol_type = other DNA
ctgagcattgtcttccctcc

SEQ ID NO: 8034 - DNA, 20 bp, synthetic construct
  misc_feature 1..20: note = CRISPR gRNA sequence
  source 1..20: mol_type = other DNA
tgagcattgtcttccctccc

SEQ ID NO: 8035 - DNA, 20 bp, synthetic construct
  misc_feature 1..20: note = CRISPR gRNA sequence
  source 1..20: mol_type = other DNA
gcattgtcttccctcccagg

SEQ ID NO: 8036 - DNA, 20 bp, synthetic construct
  misc_feature 1..20: note = CRISPR gRNA sequence
  source 1..20: mol_type = other DNA
cttccctcccaggcagctca

SEQ ID NO: 8037 - DNA, 20 bp, synthetic construct
  misc_feature 1..20: note = CRISPR gRNA sequence
  source 1..20: mol_type = other DNA
cagctcacagtgtgccacca

SEQ ID NO: 8038 - DNA, 20 bp, synthetic construct
  misc_feature 1..20: note = CRISPR gRNA sequence
  source 1..20: mol_type = other DNA
gctcacagtgtgccaccatg

SEQ ID NO: 8039 - DNA, 20 bp, synthetic construct
  misc_feature 1..20: note = CRISPR gRNA sequence
  source 1..20: mol_type = other DNA
acagtgtgccaccatggagt

SEQ ID NO: 8040 - DNA, 20 bp, synthetic construct
  misc_feature 1..20: note = CRISPR gRNA sequence
  source 1..20: mol_type = other DNA
cagtgtgccaccatggagtt

SEQ ID NO: 8041 - DNA, 20 bp, synthetic construct
  misc_feature 1..20: note = CRISPR gRNA sequence
  source 1..20: mol_type = other DNA
agtgtgccaccatggagttg

SEQ ID NO: 8042 - DNA, 20 bp, synthetic construct
  misc_feature 1..20: note = CRISPR gRNA sequence
  source 1..20: mol_type = other DNA
caccatggagttggggcccc

SEQ ID NO: 8043 - DNA, 20 bp, synthetic construct
  misc_feature 1..20: note = CRISPR gRNA sequence
  source 1..20: mol_type = other DNA
catggagttggggcccctag

SEQ ID NO: 8044 - DNA, 20 bp, synthetic construct
  misc_feature 1..20: note = CRISPR gRNA sequence
  source 1..20: mol_type = other DNA
atggagttggggcccctaga

SEQ ID NO: 8045 - DNA, 20 bp, synthetic construct
  misc_feature 1..20: note = CRISPR gRNA sequence
  source 1..20: mol_type = other DNA
gagttggggcccctagaagg

SEQ ID NO: 8046 - DNA, 20 bp, synthetic construct
  misc_feature 1..20: note = CRISPR gRNA sequence
  source 1..20: mol_type = other DNA
gcccctagaaggtggctacc

SEQ ID NO: 8047 - DNA, 20 bp, synthetic construct
  misc_feature 1..20: note = CRISPR gRNA sequence
  source 1..20: mol_type = other DNA
ccctagaaggtggctacctg

SEQ ID NO: 8048 - DNA, 20 bp, synthetic construct
  misc_feature 1..20: note = CRISPR gRNA sequence
  source 1..20: mol_type = other DNA
ggctacctggagcttcttaa

SEQ ID NO: 8049 - DNA, 20 bp, synthetic construct
  misc_feature 1..20: note = CRISPR gRNA sequence
  source 1..20: mol_type = other DNA
gcctctaccacttctatgac

SEQ ID NO: 8050 - DNA, 20 bp, synthetic construct
  misc_feature 1..20: note = CRISPR gRNA sequence
  source 1..20: mol_type = other DNA
ctaccacttctatgaccaga

SEQ ID NO: 8051 - DNA, 20 bp, synthetic construct
  misc_feature 1..20: note = CRISPR gRNA sequence
  source 1..20: mol_type = other DNA
cttctatgaccagatggacc

SEQ ID NO: 8052 - DNA, 20 bp, synthetic construct
  misc_feature 1..20: note = CRISPR gRNA sequence
  source 1..20: mol_type = other DNA
tatgaccagatggacctggc

SEQ ID NO: 8053 - DNA, 20 bp, synthetic construct
  misc_feature 1..20: note = CRISPR gRNA sequence
  source 1..20: mol_type = other DNA
tgaccagatggacctggctg

SEQ ID NO: 8054 - DNA, 20 bp, synthetic construct
  misc_feature 1..20: note = CRISPR gRNA sequence
  source 1..20: mol_type = other DNA
ccagatggacctggctggag

SEQ ID NO: 8055 - DNA, 20 bp, synthetic construct
  misc_feature 1..20: note = CRISPR gRNA sequence
  source 1..20: mol_type = other DNA
gatggacctggctggagaag

SEQ ID NO: 8056 - DNA, 20 bp, synthetic construct
  misc_feature 1..20: note = CRISPR gRNA sequence
  source 1..20: mol_type = other DNA
tggacctggctggagaagaa

SEQ ID NO: 8057 - DNA, 20 bp, synthetic construct
  misc_feature 1..20: note = CRISPR gRNA sequence
  source 1..20: mol_type = other DNA
tggctggagaagaagagatt

SEQ ID NO: 8058 - DNA, 20 bp, synthetic construct
  misc_feature 1..20: note = CRISPR gRNA sequence
  source 1..20: mol_type = other DNA
agaagagattgagctctact

SEQ ID NO: 8059 - DNA, 20 bp, synthetic construct
  misc_feature 1..20: note = CRISPR gRNA sequence
  source 1..20: mol_type = other DNA
gaagagattgagctctactc

SEQ ID NO: 8060 - DNA, 20 bp, synthetic construct
  misc_feature 1..20: note = CRISPR gRNA sequence
  source 1..20: mol_type = other DNA
gagattgagctctactcagg

SEQ ID NO: 8061 - DNA, 20 bp, synthetic construct
  misc_feature 1..20: note = CRISPR gRNA sequence
  source 1..20: mol_type = other DNA
agattgagctctactcaggt

SEQ ID NO: 8062 - DNA, 20 bp, synthetic construct
  misc_feature 1..20: note = CRISPR gRNA sequence
  source 1..20: mol_type = other DNA
caggtgggccctcctccctc

SEQ ID NO: 8063 - DNA, 20 bp, synthetic construct
  misc_feature 1..20: note = CRISPR gRNA sequence
  source 1..20: mol_type = other DNA
ctcctccctctggtctcttc

SEQ ID NO: 8064 - DNA, 20 bp, synthetic construct
  misc_feature 1..20: note = CRISPR gRNA sequence
  source 1..20: mol_type = other DNA
ttccggtatcccccacccct

SEQ ID NO: 8065 - DNA, 20 bp, synthetic construct
  misc_feature 1..20: note = CRISPR gRNA sequence
  source 1..20: mol_type = other DNA
ccccacccctcagcttgctg

SEQ ID NO: 8066 - DNA, 20 bp, synthetic construct
  misc_feature 1..20: note = CRISPR gRNA sequence
  source 1..20: mol_type = other DNA
ccacccctcagcttgctgta

SEQ ID NO: 8067 - DNA, 20 bp, synthetic construct
  misc_feature 1..20: note = CRISPR gRNA sequence
  source 1..20: mol_type = other DNA
ccctcagcttgctgtagaga

SEQ ID NO: 8068 - DNA, 20 bp, synthetic construct
  misc_feature 1..20: note = CRISPR gRNA sequence
  source 1..20: mol_type = other DNA
cttgctgtagagacggcaat

SEQ ID NO: 8069 - DNA, 20 bp, synthetic construct
  misc_feature 1..20: note = CRISPR gRNA sequence
  source 1..20: mol_type = other DNA
ttgctgtagagacggcaatc

SEQ ID NO: 8070 - DNA, 20 bp, synthetic construct
  misc_feature 1..20: note = CRISPR gRNA sequence
  source 1..20: mol_type = other DNA
tgctgtagagacggcaatca

SEQ ID NO: 8071 - DNA, 20 bp, synthetic construct
  misc_feature 1..20: note = CRISPR gRNA sequence
  source 1..20: mol_type = other DNA
gctgtagagacggcaatcag

SEQ ID NO: 8072 - DNA, 20 bp, synthetic construct
  misc_feature 1..20: note = CRISPR gRNA sequence
  source 1..20: mol_type = other DNA
acggcaatcaggggaaattc

SEQ ID NO: 8073 - DNA, 20 bp, synthetic construct
  misc_feature 1..20: note = CRISPR gRNA sequence
  source 1..20: mol_type = other DNA
tctggtccctgccctcccgt

SEQ ID NO: 8074 - DNA, 20 bp, synthetic construct
  misc_feature 1..20: note = CRISPR gRNA sequence
  source 1..20: mol_type = other DNA
ctgccctcccgtcagcacca

SEQ ID NO: 8075 - DNA, 20 bp, synthetic construct
  misc_feature 1..20: note = CRISPR gRNA sequence
  source 1..20: mol_type = other DNA
cctcccgtcagcaccacgga

SEQ ID NO: 8076 - DNA, 20 bp, synthetic construct
  misc_feature 1..20: note = CRISPR gRNA sequence
  source 1..20: mol_type = other DNA
acggacagctcccacgtctg

SEQ ID NO: 8077 - DNA, 20 bp, synthetic construct
  misc_feature 1..20: note = CRISPR gRNA sequence
  source 1..20: mol_type = other DNA
cggacagctcccacgtctgt

SEQ ID NO: 8078 - DNA, 20 bp, synthetic construct
  misc_feature 1..20: note = CRISPR gRNA sequence
  source 1..20: mol_type = other DNA
cgtctgtgggacgctctctg

SEQ ID NO: 8079 - DNA, 20 bp, synthetic construct
  misc_feature 1..20: note = CRISPR gRNA sequence
  source 1..20: mol_type = other DNA
tgtgggacgctctctgcaga

SEQ ID NO: 8080 - DNA, 20 bp, synthetic construct
  misc_feature 1..20: note = CRISPR gRNA sequence
  source 1..20: mol_type = other DNA
gtgggacgctctctgcagat

SEQ ID NO: 8081 - DNA, 20 bp, synthetic construct
  misc_feature 1..20: note = CRISPR gRNA sequence
  source 1..20: mol_type = other DNA
tgggacgctctctgcagatg

SEQ ID NO: 8082 - DNA, 20 bp, synthetic construct
  misc_feature 1..20: note = CRISPR gRNA sequence
  source 1..20: mol_type = other DNA
tgcagatggggatgatctcc

SEQ ID NO: 8083 - DNA, 20 bp, synthetic construct
  misc_feature 1..20: note = CRISPR gRNA sequence
  source 1..20: mol_type = other DNA
gcctctccctcgttccccac

SEQ ID NO: 8084 - DNA, 20 bp, synthetic construct
  misc_feature 1..20: note = CRISPR gRNA sequence
  source 1..20: mol_type = other DNA
ttccccaccagccctctttc

SEQ ID NO: 8085 - DNA, 20 bp, synthetic construct
  misc_feature 1..20: note = CRISPR gRNA sequence
  source 1..20: mol_type = other DNA
agaaatttccttcttcatcc

SEQ ID NO: 8086 - DNA, 20 bp, synthetic construct
  misc_feature 1..20: note = CRISPR gRNA sequence
  source 1..20: mol_type = other DNA
gaaatttccttcttcatcca

SEQ ID NO: 8087 - DNA, 20 bp, synthetic construct
  misc_feature 1..20: note = CRISPR gRNA sequence
  source 1..20: mol_type = other DNA
aaatttccttcttcatccaa

SEQ ID NO: 8088 - DNA, 20 bp, synthetic construct
  misc_feature 1..20: note = CRISPR gRNA sequence
  source 1..20: mol_type = other DNA
atccaagggacttttcctcc

SEQ ID NO: 8089 - DNA, 20 bp, synthetic construct
  misc_feature 1..20: note = CRISPR gRNA sequence
  source 1..20: mol_type = other DNA
tttcctcccagaacccgaca

SEQ ID NO: 8090 - DNA, 20 bp, synthetic construct
  misc_feature 1..20: note = CRISPR gRNA sequence
  source 1..20: mol_type = other DNA
cagacaccatcaactgcgac

SEQ ID NO: 8091 - DNA, 20 bp, synthetic construct
  misc_feature 1..20: note = CRISPR gRNA sequence
  source 1..20: mol_type = other DNA
accatcaactgcgaccagtt

SEQ ID NO: 8092 - DNA, 20 bp, synthetic construct
  misc_feature 1..20: note = CRISPR gRNA sequence
  source 1..20: mol_type = other DNA
atcaactgcgaccagttcag

SEQ ID NO: 8093 - DNA, 20 bp, synthetic construct
  misc_feature 1..20: note = CRISPR gRNA sequence
  source 1..20: mol_type = other DNA
tcaactgcgaccagttcagc

SEQ ID NO: 8094 - DNA, 20 bp, synthetic construct
  misc_feature 1..20: note = CRISPR gRNA sequence
  source 1..20: mol_type = other DNA
cagcaggctgttgtgtgaca

SEQ ID NO: 8095 - DNA, 20 bp, synthetic construct
  misc_feature 1..20: note = CRISPR gRNA sequence
  source 1..20: mol_type = other DNA
caggctgttgtgtgacatgg

SEQ ID NO: 8096 - DNA, 20 bp, synthetic construct
  misc_feature 1..20: note = CRISPR gRNA sequence
  source 1..20: mol_type = other DNA
aggctgttgtgtgacatgga

SEQ ID NO: 8097 - DNA, 20 bp, synthetic construct
  misc_feature 1..20: note = CRISPR gRNA sequence
  source 1..20: mol_type = other DNA
gtgtgacatggaaggtgatg

SEQ ID NO: 8098 - DNA, 20 bp, synthetic construct
  misc_feature 1..20: note = CRISPR gRNA sequence
  source 1..20: mol_type = other DNA
gtgacatggaaggtgatgaa

SEQ ID NO: 8099 - DNA, 20 bp, synthetic construct
  misc_feature 1..20: note = CRISPR gRNA sequence
  source 1..20: mol_type = other DNA
atggaaggtgatgaagagac

SEQ ID NO: 8100 - DNA, 20 bp, synthetic construct
  misc_feature 1..20: note = CRISPR gRNA sequence
  source 1..20: mol_type = other DNA
tggaaggtgatgaagagacc

SEQ ID NO: 8101 - DNA, 20 bp, synthetic construct
  misc_feature 1..20: note = CRISPR gRNA sequence
  source 1..20: mol_type = other DNA
ggaaggtgatgaagagacca

SEQ ID NO: 8102 - DNA, 20 bp, synthetic construct
  misc_feature 1..20: note = CRISPR gRNA sequence
  source 1..20: mol_type = other DNA
aaggtgatgaagagaccagg

SEQ ID NO: 8103 - DNA, 20 bp, synthetic construct
  misc_feature 1..20: note = CRISPR gRNA sequence
  source 1..20: mol_type = other DNA
aggtgatgaagagaccaggg

SEQ ID NO: 8104 - DNA, 20 bp, synthetic construct
  misc_feature 1..20: note = CRISPR gRNA sequence
  source 1..20: mol_type = other DNA
agggaggcttatgccaatat

SEQ ID NO: 8105 - DNA, 20 bp, synthetic construct
  misc_feature 1..20: note = CRISPR gRNA sequence
  source 1..20: mol_type = other DNA
aggcttatgccaatatcggt

SEQ ID NO: 8106 - DNA, 20 bp, synthetic construct
  misc_feature 1..20: note = CRISPR gRNA sequence
  source 1..20: mol_type = other DNA
ggcttatgccaatatcggtg

SEQ ID NO: 8107 - DNA, 20 bp, synthetic construct
  misc_feature 1..20: note = CRISPR gRNA sequence
  source 1..20: mol_type = other DNA
ttatgccaatatcggtgagg

SEQ ID NO: 8108 - DNA, 20 bp, synthetic construct
  misc_feature 1..20: note = CRISPR gRNA sequence
  source 1..20: mol_type = other DNA
atatcggtgaggaagcacct

SEQ ID NO: 8109 - DNA, 20 bp, synthetic construct
  misc_feature 1..20: note = CRISPR gRNA sequence
  source 1..20: mol_type = other DNA
ggtgaggaagcacctgagcc

SEQ ID NO: 8110 - DNA, 20 bp, synthetic construct
  misc_feature 1..20: note = CRISPR gRNA sequence
  source 1..20: mol_type = other DNA
ggaagcacctgagcccagaa

SEQ ID NO: 8111 - DNA, 20 bp, synthetic construct
  misc_feature 1..20: note = CRISPR gRNA sequence
  source 1..20: mol_type = other DNA
gaagcacctgagcccagaaa

SEQ ID NO: 8112 - DNA, 20 bp, synthetic construct
  misc_feature 1..20: note = CRISPR gRNA sequence
  source 1..20: mol_type = other DNA
gagcccagaaaaggacaatc

SEQ ID NO: 8113 - DNA, 20 bp, synthetic construct
  misc_feature 1..20: note = CRISPR gRNA sequence
  source 1..20: mol_type = other DNA
agcccagaaaaggacaatca

SEQ ID NO: 8114 - DNA, 20 bp, synthetic construct
  misc_feature 1..20: note = CRISPR gRNA sequence
  source 1..20: mol_type = other DNA
gcccagaaaaggacaatcaa

SEQ ID NO: 8115 - DNA, 20 bp, synthetic construct
  misc_feature 1..20: note = CRISPR gRNA sequence
  source 1..20: mol_type = other DNA
agaaaaggacaatcaagggc

SEQ ID NO: 8116 - DNA, 20 bp, synthetic construct
  misc_feature 1..20: note = CRISPR gRNA sequence
  source 1..20: mol_type = other DNA
aaaaggacaatcaagggcaa

SEQ ID NO: 8117 - DNA, 20 bp, synthetic construct
  misc_feature 1..20: note = CRISPR gRNA sequence
  source 1..20: mol_type = other DNA
caatatcacccattcatcat

SEQ ID NO: 8118 - DNA, 20 bp, synthetic construct
  misc_feature 1..20: note = CRISPR gRNA sequence
  source 1..20: mol_type = other DNA
ccattcatcatgagccacgt

SEQ ID NO: 8119 - DNA, 20 bp, synthetic construct
  misc_feature 1..20: note = CRISPR gRNA sequence
  source 1..20: mol_type = other DNA
gccacgtcagtcccctccca

SEQ ID NO: 8120 - DNA, 20 bp, synthetic construct
  misc_feature 1..20: note = CRISPR gRNA sequence
  source 1..20: mol_type = other DNA
cctcccacagaaatcattgc

SEQ ID NO: 8121 - DNA, 20 bp, synthetic construct
  misc_feature 1..20: note = CRISPR gRNA sequence
  source 1..20: mol_type = other DNA
ctcccacagaaatcattgca

SEQ ID NO: 8122 - DNA, 20 bp, synthetic construct
  misc_feature 1..20: note = CRISPR gRNA sequence
  source 1..20: mol_type = other DNA
tcccacagaaatcattgcaa

SEQ ID NO: 8123 - DNA, 20 bp, synthetic construct
  misc_feature 1..20: note = CRISPR gRNA sequence
  source 1..20: mol_type = other DNA
cccacagaaatcattgcaag

SEQ ID NO: 8124 - DNA, 20 bp, synthetic construct
  misc_feature 1..20: note = CRISPR gRNA sequence
  source 1..20: mol_type = other DNA
ccacagaaatcattgcaagg

SEQ ID NO: 8125 - DNA, 20 bp, synthetic construct
  misc_feature 1..20: note = CRISPR gRNA sequence
  source 1..20: mol_type = other DNA
aaatcattgcaagggggatg

SEQ ID NO: 8126 - DNA, 20 bp, synthetic construct
  misc_feature 1..20: note = CRISPR gRNA sequence
  source 1..20: mol_type = other DNA
atcattgcaagggggatgcg

SEQ ID NO: 8127 - DNA, 20 bp, synthetic construct
  misc_feature 1..20: note = CRISPR gRNA sequence
  source 1..20: mol_type = other DNA
gcaagggggatgcggagcaa

SEQ ID NO: 8128 - DNA, 20 bp, synthetic construct
  misc_feature 1..20: note = CRISPR gRNA sequence
  source 1..20: mol_type = other DNA
gggggatgcggagcaatggc

SEQ ID NO: 8129 - DNA, 20 bp, synthetic construct
  misc_feature 1..20: note = CRISPR gRNA sequence
  source 1..20: mol_type = other DNA
gggatgcggagcaatggctg

SEQ ID NO: 8130 - DNA, 20 bp, synthetic construct
  misc_feature 1..20: note = CRISPR gRNA sequence
  source 1..20: mol_type = other DNA
ggatgcggagcaatggctgg

SEQ ID NO: 8131 - DNA, 20 bp, synthetic construct
  misc_feature 1..20: note = CRISPR gRNA sequence
  source 1..20: mol_type = other DNA
cggagcaatggctggaggaa

SEQ ID NO: 8132 - DNA, 20 bp, synthetic construct
  misc_feature 1..20: note = CRISPR gRNA sequence
  source 1..20: mol_type = other DNA
gagcaatggctggaggaacg

SEQ ID NO: 8133 - DNA, 20 bp, synthetic construct
  misc_feature 1..20: note = CRISPR gRNA sequence
  source 1..20: mol_type = other DNA
ggctggaggaacggagactc

SEQ ID NO: 8134 - DNA, 20 bp, synthetic construct
  misc_feature 1..20: note = CRISPR gRNA sequence
  source 1..20: mol_type = other DNA
gctggaggaacggagactcc

SEQ ID NO: 8135 - DNA, 20 bp, synthetic construct
  misc_feature 1..20: note = CRISPR gRNA sequence
  source 1..20: mol_type = other DNA
ctggaggaacggagactcca

SEQ ID NO: 8136 - DNA, 20 bp, synthetic construct
  misc_feature 1..20: note = CRISPR gRNA sequence
  source 1..20: mol_type = other DNA
gaggaacggagactccaggg

SEQ ID NO: 8137 - DNA, 20 bp, synthetic construct
  misc_feature 1..20: note = CRISPR gRNA sequence
  source 1..20: mol_type = other DNA
ggaacggagactccagggaa

SEQ ID NO: 8138 - DNA, 20 bp, synthetic construct
  misc_feature 1..20: note = CRISPR gRNA sequence
  source 1..20: mol_type = other DNA
aacggagactccagggaaga

SEQ ID NO: 8139 - DNA, 20 bp, synthetic construct
  misc_feature 1..20: note = CRISPR gRNA sequence
  source 1..20: mol_type = other DNA
acggagactccagggaagag

SEQ ID NO: 8140 - DNA, 20 bp, synthetic construct
  misc_feature 1..20: note = CRISPR gRNA sequence
  source 1..20: mol_type = other DNA
cggagactccagggaagaga

SEQ ID NO: 8141 - DNA, 20 bp, synthetic construct
  misc_feature 1..20: note = CRISPR gRNA sequence
  source 1..20: mol_type = other DNA
ggagactccagggaagagag

SEQ ID NO: 8142 - DNA, 20 bp, synthetic construct
  misc_feature 1..20: note = CRISPR gRNA sequence
  source 1..20: mol_type = other DNA
agactccagggaagagaggg

SEQ ID NO: 8143 - DNA, 20 bp, synthetic construct
  misc_feature 1..20: note = CRISPR gRNA sequence
  source 1..20: mol_type = other DNA
tccagggaagagaggggaga

SEQ ID NO: 8144 - DNA, 20 bp, synthetic construct
  misc_feature 1..20: note = CRISPR gRNA sequence
  source 1..20: mol_type = other DNA
cagggaagagaggggagatg

SEQ ID NO: 8145 - DNA, 20 bp, synthetic construct
  misc_feature 1..20: note = CRISPR gRNA sequence
  source 1..20: mol_type = other DNA
agggaagagaggggagatgg

SEQ ID NO: 8146 - DNA, 20 bp, synthetic construct
  misc_feature 1..20: note = CRISPR gRNA sequence
  source 1..20: mol_type = other DNA
aagagaggggagatggaggc

SEQ ID NO: 8147 - DNA, 20 bp, synthetic construct
  misc_feature 1..20: note = CRISPR gRNA sequence
  source 1..20: mol_type = other DNA
agaggggagatggaggccag

SEQ ID NO: 8148 - DNA, 20 bp, synthetic construct
  misc_feature 1..20: note = CRISPR gRNA sequence
  source 1..20: mol_type = other DNA
gaggggagatggaggccagt

SEQ ID NO: 8149 - DNA, 20 bp, synthetic construct
  misc_feature 1..20: note = CRISPR gRNA sequence
  source 1..20: mol_type = other DNA
aggggagatggaggccagtg

SEQ ID NO: 8150 - DNA, 20 bp, synthetic construct
  misc_feature 1..20: note = CRISPR gRNA sequence
  source 1..20: mol_type = other DNA
ggggagatggaggccagtgg

SEQ ID NO: 8151 - DNA, 20 bp, synthetic construct
  misc_feature 1..20: note = CRISPR gRNA sequence
  source 1..20: mol_type = other DNA
atggaggccagtgggggaaa

SEQ ID NO: 8152 - DNA, 20 bp, synthetic construct
  misc_feature 1..20: note = CRISPR gRNA sequence
  source 1..20: mol_type = other DNA
tggaggccagtgggggaaat

SEQ ID NO: 8153 - DNA, 20 bp, synthetic construct
  misc_feature 1..20: note = CRISPR gRNA sequence
  source 1..20: mol_type = other DNA
ccccttcactaatgaccacc

SEQ ID NO: 8154 - DNA, 20 bp, synthetic construct
  misc_feature 1..20: note = CRISPR gRNA sequence
  source 1..20: mol_type = other DNA
ttctgtccatcctttctaca

SEQ ID NO: 8155 - DNA, 20 bp, synthetic construct
  misc_feature 1..20: note = CRISPR gRNA sequence
  source 1..20: mol_type = other DNA
acccctttcccttttcctcc

SEQ ID NO: 8156 - DNA, 20 bp, synthetic construct
  misc_feature 1..20: note = CRISPR gRNA sequence
  source 1..20: mol_type = other DNA
cccttttcctcccagctcct

SEQ ID NO: 8157 - DNA, 20 bp, synthetic construct
  misc_feature 1..20: note = CRISPR gRNA sequence
  source 1..20: mol_type = other DNA
ttcctcccagctccttagcc

SEQ ID NO: 8158 - DNA, 20 bp, synthetic construct
  misc_feature 1..20: note = CRISPR gRNA sequence
  source 1..20: mol_type = other DNA
gctccttagccaagctactc

SEQ ID NO: 8159 - DNA, 20 bp, synthetic construct
  misc_feature 1..20: note = CRISPR gRNA sequence
  source 1..20: mol_type = other DNA
actctagtatttgtaataac

SEQ ID NO: 8160 - DNA, 20 bp, synthetic construct
  misc_feature 1..20: note = CRISPR gRNA sequence
  source 1..20: mol_type = other DNA
ttgtaataactagcatttac

SEQ ID NO: 8161 - DNA, 20 bp, synthetic construct
  misc_feature 1..20: note = CRISPR gRNA sequence
  source 1..20: mol_type = other DNA
tagcatttactggatactca

SEQ ID NO: 8162 - DNA, 20 bp, synthetic construct
  misc_feature 1..20: note = CRISPR gRNA sequence
  source 1..20: mol_type = other DNA
gctgtccatacattatcatc

SEQ ID NO: 8163 - DNA, 20 bp, synthetic construct
  misc_feature 1..20: note = CRISPR gRNA sequence
  source 1..20: mol_type = other DNA
ctggaatccttacaacaaca

SEQ ID NO: 8164 - DNA, 20 bp, synthetic construct
  misc_feature 1..20: note = CRISPR gRNA sequence
  source 1..20: mol_type = other DNA
tggaatccttacaacaacaa

SEQ ID NO: 8165 - DNA, 20 bp, synthetic construct
  misc_feature 1..20: note = CRISPR gRNA sequence
  source 1..20: mol_type = other DNA
acaaaggaaatacatattat

SEQ ID NO: 8166 - DNA, 20 bp, synthetic construct
  misc_feature 1..20: note = CRISPR gRNA sequence
  source 1..20: mol_type = other DNA
agtttctgtcttttacaaat

SEQ ID NO: 8167 - DNA, 20 bp, synthetic construct
  misc_feature 1..20: note = CRISPR gRNA sequence
  source 1..20: mol_type = other DNA
gtttctgtcttttacaaatg

SEQ ID NO: 8168 - DNA, 20 bp, synthetic construct
  misc_feature 1..20: note = CRISPR gRNA sequence
  source 1..20: mol_type = other DNA
cttttacaaatgaggaaatt

SEQ ID NO: 8169 - DNA, 20 bp, synthetic construct
  misc_feature 1..20: note = CRISPR gRNA sequence
  source 1..20: mol_type = other DNA
ttttacaaatgaggaaattg

SEQ ID NO: 8170 - DNA, 20 bp, synthetic construct
  misc_feature 1..20: note = CRISPR gRNA sequence
  source 1..20: mol_type = other DNA
caaatgaggaaattgaggtt

SEQ ID NO: 8171 - DNA, 20 bp, synthetic construct
  misc_feature 1..20: note = CRISPR gRNA sequence
  source 1..20: mol_type = other DNA
aatgaggaaattgaggttta

SEQ ID NO: 8172 - DNA, 20 bp, synthetic construct
  misc_feature 1..20: note = CRISPR gRNA sequence
  source 1..20: mol_type = other DNA
tgaggaaattgaggtttaga

SEQ ID NO: 8173 - DNA, 20 bp, synthetic construct
  misc_feature 1..20: note = CRISPR gRNA sequence
  source 1..20: mol_type = other DNA
gaggaaattgaggtttagag

SEQ ID NO: 8174 - DNA, 20 bp, synthetic construct
  misc_feature 1..20: note = CRISPR gRNA sequence
  source 1..20: mol_type = other DNA
agaggtgaaacgacctaccc

SEQ ID NO: 8175 - DNA, 20 bp, synthetic construct
  misc_feature 1..20: note = CRISPR gRNA sequence
  source 1..20: mol_type = other DNA
cgacctacccaagtttgcat

SEQ ID NO: 8176 - DNA, 20 bp, synthetic construct
  misc_feature 1..20: note = CRISPR gRNA sequence
  source 1..20: mol_type = other DNA
acctacccaagtttgcatta

SEQ ID NO: 8177 - DNA, 20 bp, synthetic construct
  misc_feature 1..20: note = CRISPR gRNA sequence
  source 1..20: mol_type = other DNA
acccaagtttgcattagaga

SEQ ID NO: 8178 - DNA, 20 bp, synthetic construct
  misc_feature 1..20: note = CRISPR gRNA sequence
  source 1..20: mol_type = other DNA
gcattagagatagtaatgta

SEQ ID NO: 8179 - DNA, 20 bp, synthetic construct
  misc_feature 1..20: note = CRISPR gRNA sequence
  source 1..20: mol_type = other DNA
acagatctgaaattctaacc

SEQ ID NO: 8180 - DNA, 20 bp, synthetic construct
  misc_feature 1..20: note = CRISPR gRNA sequence
  source 1..20: mol_type = other DNA
cagatctgaaattctaacct

SEQ ID NO: 8181 - DNA, 20 bp, synthetic construct
  misc_feature 1..20: note = CRISPR gRNA sequence
  source 1..20: mol_type = other DNA
cctaggtctttctcgtttca

SEQ ID NO: 8182 - DNA, 20 bp, synthetic construct
  misc_feature 1..20: note = CRISPR gRNA sequence
  source 1..20: mol_type = other DNA
tccatttttaaccacaaaaa

SEQ ID NO: 8183 - DNA, 20 bp, synthetic construct
  misc_feature 1..20: note = CRISPR gRNA sequence
  source 1..20: mol_type = other DNA
tttttaaccacaaaaaaaga

SEQ ID NO: 8184 - DNA, 20 bp, synthetic construct
  misc_feature 1..20: note = CRISPR gRNA sequence
  source 1..20: mol_type = other DNA
ccacaaaaaaagaaagtgtc

SEQ ID NO: 8185 - DNA, 20 bp, synthetic construct
  misc_feature 1..20: note = CRISPR gRNA sequence
  source 1..20: mol_type = other DNA
cacaaaaaaagaaagtgtct

SEQ ID NO: 8186 - DNA, 20 bp, synthetic construct
  misc_feature 1..20: note = CRISPR gRNA sequence
  source 1..20: mol_type = other DNA
acaaaaaaagaaagtgtctg

SEQ ID NO: 8187 - DNA, 20 bp, synthetic construct
  misc_feature 1..20: note = CRISPR gRNA sequence
  source 1..20: mol_type = other DNA
aaaaagaaagtgtctggggt

SEQ ID NO: 8188 - DNA, 20 bp, synthetic construct
  misc_feature 1..20: note = CRISPR gRNA sequence
  source 1..20: mol_type = other DNA
aagaaagtgtctggggttgg

SEQ ID NO: 8189 - DNA, 20 bp, synthetic construct
  misc_feature 1..20: note = CRISPR gRNA sequence
  source 1..20: mol_type = other DNA
ctggggttggaagatttgct

SEQ ID NO: 8190 - DNA, 20 bp, synthetic construct
  misc_feature 1..20: note = CRISPR gRNA sequence
  source 1..20: mol_type = other DNA
tggggttggaagatttgcta

SEQ ID NO: 8191 - DNA, 20 bp, synthetic construct
  misc_feature 1..20: note = CRISPR gRNA sequence
  source 1..20: mol_type = other DNA
tggaagatttgctaaggctt

SEQ ID NO: 8192 - DNA, 20 bp, synthetic construct
  misc_feature 1..20: note = CRISPR gRNA sequence
  source 1..20: mol_type = other DNA
aagatttgctaaggcttaag

SEQ ID NO: 8193 - DNA, 20 bp, synthetic construct
  misc_feature 1..20: note = CRISPR gRNA sequence
  source 1..20: mol_type = other DNA
gatttgctaaggcttaagca

SEQ ID NO: 8194 - DNA, 20 bp, synthetic construct
  misc_feature 1..20: note = CRISPR gRNA sequence
  source 1..20: mol_type = other DNA
ttgctaaggcttaagcagag

SEQ ID NO: 8195 - DNA, 20 bp, synthetic construct
  misc_feature 1..20: note = CRISPR gRNA sequence
  source 1..20: mol_type = other DNA
taagcagagaagctaatttg

SEQ ID NO: 8196 - DNA, 20 bp, synthetic construct
  misc_feature 1..20: note = CRISPR gRNA sequence
  source 1..20: mol_type = other DNA
agaagctaatttgtagcctt

SEQ ID NO: 8197 - DNA, 20 bp, synthetic construct
  misc_feature 1..20: note = CRISPR gRNA sequence
  source 1..20: mol_type = other DNA
agctaatttgtagccttaag

SEQ ID NO: 8198 - DNA, 20 bp, synthetic construct
  misc_feature 1..20: note = CRISPR gRNA sequence
  source 1..20: mol_type = other DNA
ctaatttgtagccttaagaa

SEQ ID NO: 8199 - DNA, 20 bp, synthetic construct
  misc_feature 1..20: note = CRISPR gRNA sequence
  source 1..20: mol_type = other DNA
tgtagccttaagaagagcta

SEQ ID NO: 8200 - DNA, 20 bp, synthetic construct
  misc_feature 1..20: note = CRISPR gRNA sequence
  source 1..20: mol_type = other DNA
ttaagaagagctacagcttt

SEQ ID NO: 8201 - DNA, 20 bp, synthetic construct
  misc_feature 1..20: note = CRISPR gRNA sequence
  source 1..20: mol_type = other DNA
aagagctacagctttcagac

SEQ ID NO: 8202 - DNA, 20 bp, synthetic construct
  misc_feature 1..20: note = CRISPR gRNA sequence
  source 1..20: mol_type = other DNA
agagctacagctttcagaca

SEQ ID NO: 8203 - DNA, 20 bp, synthetic construct
  misc_feature 1..20: note = CRISPR gRNA sequence
  source 1..20: mol_type = other DNA
gagctacagctttcagacaa

SEQ ID NO: 8204 - DNA, 20 bp, synthetic construct
  misc_feature 1..20: note = CRISPR gRNA sequence
  source 1..20: mol_type = other DNA
ctacagctttcagacaaggg

SEQ ID NO: 8205 - DNA, 20 bp, synthetic construct
  misc_feature 1..20: note = CRISPR gRNA sequence
  source 1..20: mol_type = other DNA
tacagctttcagacaagggc

SEQ ID NO: 8206 - DNA, 20 bp, synthetic construct
  misc_feature 1..20: note = CRISPR gRNA sequence
  source 1..20: mol_type = other DNA
tcagacaagggcaggactct

SEQ ID NO: 8207 - DNA, 20 bp, synthetic construct
  misc_feature 1..20: note = CRISPR gRNA sequence
  source 1..20: mol_type = other DNA
cagacaagggcaggactctt

SEQ ID NO: 8208 - DNA, 20 bp, synthetic construct
  misc_feature 1..20: note = CRISPR gRNA sequence
  source 1..20: mol_type = other DNA
agacaagggcaggactcttg

SEQ ID NO: 8209 - DNA, 20 bp, synthetic construct
  misc_feature 1..20: note = CRISPR gRNA sequence
  source 1..20: mol_type = other DNA
acaagggcaggactcttggg

SEQ ID NO: 8210 - DNA, 20 bp, synthetic construct
  misc_feature 1..20: note = CRISPR gRNA sequence
  source 1..20: mol_type = other DNA
aagggcaggactcttgggga

SEQ ID NO: 8211 - DNA, 20 bp, synthetic construct
  misc_feature 1..20: note = CRISPR gRNA sequence
  source 1..20: mol_type = other DNA
agggcaggactcttggggag

SEQ ID NO: 8212 - DNA, 20 bp, synthetic construct
  misc_feature 1..20: note = CRISPR gRNA sequence
  source 1..20: mol_type = other DNA
gcaggactcttggggagagg

SEQ ID NO: 8213 - DNA, 20 bp, synthetic construct
  misc_feature 1..20: note = CRISPR gRNA sequence
  source 1..20: mol_type = other DNA
ggactcttggggagaggtgg

SEQ ID NO: 8214 - DNA, 20 bp, synthetic construct
  misc_feature 1..20: note = CRISPR gRNA sequence
  source 1..20: mol_type = other DNA
ctcttggggagaggtggtgg

SEQ ID NO: 8215 - DNA, 20 bp, synthetic construct
  misc_feature 1..20: note = CRISPR gRNA sequence
  source 1..20: mol_type = other DNA
ggtggtggtggtgttgctgc

SEQ ID NO: 8216 - DNA, 20 bp, synthetic construct
  misc_feature 1..20: note = CRISPR gRNA sequence
  source 1..20: mol_type = other DNA
ggtggtggtgttgctgctag

SEQ ID NO: 8217 - DNA, 20 bp, synthetic construct
  misc_feature 1..20: note = CRISPR gRNA sequence
  source 1..20: mol_type = other DNA
gctgctagtggtttgttttt

SEQ ID NO: 8218 - DNA, 20 bp, synthetic construct
  misc_feature 1..20: note = CRISPR gRNA sequence
  source 1..20: mol_type = other DNA
ctgctagtggtttgtttttt

SEQ ID NO: 8219 - DNA, 20 bp, synthetic construct
  misc_feature 1..20: note = CRISPR gRNA sequence
  source 1..20: mol_type = other DNA
tgctagtggtttgttttttg

SEQ ID NO: 8220 - DNA, 20 bp, synthetic construct
  misc_feature 1..20: note = CRISPR gRNA sequence
  source 1..20: mol_type = other DNA
gctagtggtttgttttttgg

SEQ ID NO: 8221 - DNA, 20 bp, synthetic construct
  misc_feature 1..20: note = CRISPR gRNA sequence
  source 1..20: mol_type = other DNA
tagtggtttgttttttgggg

SEQ ID NO: 8222 - DNA, 20 bp, synthetic construct
  misc_feature 1..20: note = CRISPR gRNA sequence
  source 1..20: mol_type = other DNA
gtggtttgttttttggggga

SEQ ID NO: 8223 - DNA, 20 bp, synthetic construct
  misc_feature 1..20: note = CRISPR gRNA sequence
  source 1..20: mol_type = other DNA
tgttttttgggggagagacg

SEQ ID NO: 8224 - DNA, 20 bp, synthetic construct
  misc_feature 1..20: note = CRISPR gRNA sequence
  source 1..20: mol_type = other DNA
gttttttgggggagagacgt

SEQ ID NO: 8225 - DNA, 20 bp, synthetic construct
  misc_feature 1..20: note = CRISPR gRNA sequence
  source 1..20: mol_type = other DNA
tttgggggagagacgtggga

SEQ ID NO: 8226 - DNA, 20 bp, synthetic construct
  misc_feature 1..20: note = CRISPR gRNA sequence
  source 1..20: mol_type = other DNA
tgggggagagacgtgggata

SEQ ID NO: 8227 - DNA, 20 bp, synthetic construct
  misc_feature 1..20: note = CRISPR gRNA sequence
  source 1..20: mol_type = other DNA
gatagagaatctcttctcac

SEQ ID NO: 8228 - DNA, 20 bp, synthetic construct
  misc_feature 1..20: note = CRISPR gRNA sequence
  source 1..20: mol_type = other DNA
agcatcaccaccacctcata

SEQ ID NO: 8229 - DNA, 20 bp, synthetic construct
  misc_feature 1..20: note = CRISPR gRNA sequence
  source 1..20: mol_type = other DNA
catcaccaccacctcataca

SEQ ID NO: 8230 - DNA, 20 bp, synthetic construct
  misc_feature 1..20: note = CRISPR gRNA sequence
  source 1..20: mol_type = other DNA
atacagagcctatgttgaaa

SEQ ID NO: 8231 - DNA, 20 bp, synthetic construct
  misc_feature 1..20: note = CRISPR gRNA sequence
  source 1..20: mol_type = other DNA
gcctatgttgaaatagaaaa

SEQ ID NO: 8232 - DNA, 20 bp, synthetic construct
  misc_feature 1..20: note = CRISPR gRNA sequence
  source 1..20: mol_type = other DNA
tatgttgaaatagaaaaaag

SEQ ID NO: 8233 - DNA, 20 bp, synthetic construct
  misc_feature 1..20: note = CRISPR gRNA sequence
  source 1..20: mol_type = other DNA
agaaaaaagtggcctttttc

SEQ ID NO: 8234 - DNA, 20 bp, synthetic construct
  misc_feature 1..20: note = CRISPR gRNA sequence
  source 1..20: mol_type = other DNA
aaaaaagtggcctttttctg

SEQ ID NO: 8235 - DNA, 20 bp, synthetic construct
  misc_feature 1..20: note = CRISPR gRNA sequence
  source 1..20: mol_type = other DNA
aaaaagtggcctttttctgg

SEQ ID NO: 8236 - DNA, 20 bp, synthetic construct
  misc_feature 1..20: note = CRISPR gRNA sequence
  source 1..20: mol_type = other DNA
tggcctttttctggaggatg

SEQ ID NO: 8237 - DNA, 20 bp, synthetic construct
  misc_feature 1..20: note = CRISPR gRNA sequence
  source 1..20: mol_type = other DNA
ctggaggatgcagcccctac

SEQ ID NO: 8238 - DNA, 20 bp, synthetic construct
  misc_feature 1..20: note = CRISPR gRNA sequence
  source 1..20: mol_type = other DNA
tggaggatgcagcccctacc

SEQ ID NO: 8239 - DNA, 20 bp, synthetic construct
  misc_feature 1..20: note = CRISPR gRNA sequence
  source 1..20: mol_type = other DNA
aggatgcagcccctaccagg

SEQ ID NO: 8240 - DNA, 20 bp, synthetic construct
  misc_feature 1..20: note = CRISPR gRNA sequence
  source 1..20: mol_type = other DNA
cctaccaggaagtaactgct

SEQ ID NO: 8241 - DNA, 20 bp, synthetic construct
  misc_feature 1..20: note = CRISPR gRNA sequence
  source 1..20: mol_type = other DNA
ccaggaagtaactgcttggc

SEQ ID NO: 8242 - DNA, 20 bp, synthetic construct
  misc_feature 1..20: note = CRISPR gRNA sequence
  source 1..20: mol_type = other DNA
aagtaactgcttggctagca

SEQ ID NO: 8243 - DNA, 20 bp, synthetic construct
  misc_feature 1..20: note = CRISPR gRNA sequence
  source 1..20: mol_type = other DNA
ctgcttggctagcaaagtgc

SEQ ID NO: 8244 - DNA, 20 bp, synthetic construct
  misc_feature 1..20: note = CRISPR gRNA sequence
  source 1..20: mol_type = other DNA
ttggctagcaaagtgcaagc

SEQ ID NO: 8245 - DNA, 20 bp, synthetic construct
  misc_feature 1..20: note = CRISPR gRNA sequence
  source 1..20: mol_type = other DNA
ggctagcaaagtgcaagccg

SEQ ID NO: 8246 - DNA, 20 bp, synthetic construct
  misc_feature 1..20: note = CRISPR gRNA sequence
  source 1..20: mol_type = other DNA
cctgcccccattttccttgt

SEQ ID NO: 8247 - DNA, 20 bp, synthetic construct
  misc_feature 1..20: note = CRISPR gRNA sequence
  source 1..20: mol_type = other DNA
ccccattttccttgttggct

SEQ ID NO: 8248 - DNA, 20 bp, synthetic construct
  misc_feature 1..20: note = CRISPR gRNA sequence
  source 1..20: mol_type = other DNA
cccattttccttgttggctt

SEQ ID NO: 8249 - DNA, 20 bp, synthetic construct
  misc_feature 1..20: note = CRISPR gRNA sequence
  source 1..20: mol_type = other DNA
ttggcttgggcacctgtgtg

SEQ ID NO: 8250 - DNA, 20 bp, synthetic construct
  misc_feature 1..20: note = CRISPR gRNA sequence
  source 1..20: mol_type = other DNA
acaacctgcaaaactcttct

SEQ ID NO: 8251 - DNA, 20 bp, synthetic construct
  misc_feature 1..20: note = CRISPR gRNA sequence
  source 1..20: mol_type = other DNA
acctgcaaaactcttcttag

SEQ ID NO: 8252 - DNA, 20 bp, synthetic construct
  misc_feature 1..20: note = CRISPR gRNA sequence
  source 1..20: mol_type = other DNA
tggtcttcttcctgccaacc

SEQ ID NO: 8253 - DNA, 20 bp, synthetic construct
  misc_feature 1..20: note = CRISPR gRNA sequence
  source 1..20: mol_type = other DNA
ggtcttcttcctgccaaccc

SEQ ID NO: 8254 - DNA, 20 bp, synthetic construct
  misc_feature 1..20: note = CRISPR gRNA sequence
  source 1..20: mol_type = other DNA
tcttcctgccaacccaggaa

SEQ ID NO: 8255 - DNA, 20 bp, synthetic construct
  misc_feature 1..20: note = CRISPR gRNA sequence
  source 1..20: mol_type = other DNA
tcctgccaacccaggaacag

SEQ ID NO: 8256 - DNA, 20 bp, synthetic construct
  misc_feature 1..20: note = CRISPR gRNA sequence
  source 1..20: mol_type = other DNA
aacccaggaacagcagcatt

SEQ ID NO: 8257 - DNA, 20 bp, synthetic construct
  misc_feature 1..20: note = CRISPR gRNA sequence
  source 1..20: mol_type = other DNA
ccaggaacagcagcattcag

SEQ ID NO: 8258 - DNA, 20 bp, synthetic construct
  misc_feature 1..20: note = CRISPR gRNA sequence
  source 1..20: mol_type = other DNA
ttctgtgcttgatccaaatg

SEQ ID NO: 8259 - DNA, 20 bp, synthetic construct
  misc_feature 1..20: note = CRISPR gRNA sequence
  source 1..20: mol_type = other DNA
aaatgtggccaatttttccc

SEQ ID NO: 8260 - DNA, 20 bp, synthetic construct
  misc_feature 1..20: note = CRISPR gRNA sequence
  source 1..20: mol_type = other DNA
atgtggccaatttttcccca

SEQ ID NO: 8261 - DNA, 20 bp, synthetic construct
  misc_feature 1..20: note = CRISPR gRNA sequence
  source 1..20: mol_type = other DNA
gccaatttttccccagagca

SEQ ID NO: 8262 - DNA, 20 bp, synthetic construct
  misc_feature 1..20: note = CRISPR gRNA sequence
  source 1..20: mol_type = other DNA
agtgtattgaaaatcatacc

SEQ ID NO: 8263 - DNA, 20 bp, synthetic construct
  misc_feature 1..20: note = CRISPR gRNA sequence
  source 1..20: mol_type = other DNA
gtgtattgaaaatcatacca

SEQ ID NO: 8264 - DNA, 20 bp, synthetic construct
  misc_feature 1..20: note = CRISPR gRNA sequence
  source 1..20: mol_type = other DNA
tattgaaaatcataccaagg

SEQ ID NO: 8265 - DNA, 20 bp, synthetic construct
  misc_feature 1..20: note = CRISPR gRNA sequence
  source 1..20: mol_type = other DNA
aatcataccaaggaagaaaa

SEQ ID NO: 8266 - DNA, 20 bp, synthetic construct
  misc_feature 1..20: note = CRISPR gRNA sequence
  source 1..20: mol_type = other DNA
tcataccaaggaagaaaatg

SEQ ID NO: 8267 - DNA, 20 bp, synthetic construct
  misc_feature 1..20: note = CRISPR gRNA sequence
  source 1..20: mol_type = other DNA
cataccaaggaagaaaatgg

SEQ ID NO: 8268 - DNA, 20 bp, synthetic construct
  misc_feature 1..20: note = CRISPR gRNA sequence
  source 1..20: mol_type = other DNA
ataccaaggaagaaaatgga

SEQ ID NO: 8269 - DNA, 20 bp, synthetic construct
  misc_feature 1..20: note = CRISPR gRNA sequence
  source 1..20: mol_type = other DNA
taccaaggaagaaaatggag

SEQ ID NO: 8270 - DNA, 20 bp, synthetic construct
  misc_feature 1..20: note = CRISPR gRNA sequence
  source 1..20: mol_type = other DNA
aggaagaaaatggaggggac

SEQ ID NO: 8271 - DNA, 20 bp, synthetic construct
  misc_feature 1..20: note = CRISPR gRNA sequence
  source 1..20: mol_type = other DNA
actagtaattgttcatgttt

SEQ ID NO: 8272 - DNA, 20 bp, synthetic construct
  misc_feature 1..20: note = CRISPR gRNA sequence
  source 1..20: mol_type = other DNA
tgttcatgtttcagaaatta

SEQ ID NO: 8273 - DNA, 20 bp, synthetic construct
  misc_feature 1..20: note = CRISPR gRNA sequence
  source 1..20: mol_type = other DNA
gtttcagaaattacagaact

SEQ ID NO: 8274 - DNA, 20 bp, synthetic construct
  misc_feature 1..20: note = CRISPR gRNA sequence
  source 1..20: mol_type = other DNA
ttcagaaattacagaactga

SEQ ID NO: 8275 - DNA, 20 bp, synthetic construct
  misc_feature 1..20: note = CRISPR gRNA sequence
  source 1..20: mol_type = other DNA
tgactgcttccttcccttcc

SEQ ID NO: 8276 - DNA, 20 bp, synthetic construct
  misc_feature 1..20: note = CRISPR gRNA sequence
  source 1..20: mol_type = other DNA
gactgcttccttcccttcct

SEQ ID NO: 8277 - DNA, 20 bp, synthetic construct
  misc_feature 1..20: note = CRISPR gRNA sequence
  source 1..20: mol_type = other DNA
actgcttccttcccttcctg

SEQ ID NO: 8278 - DNA, 20 bp, synthetic construct
  misc_feature 1..20: note = CRISPR gRNA sequence
  source 1..20: mol_type = other DNA
tcccttcctggggatttaca

SEQ ID NO: 8279 - DNA, 20 bp, synthetic construct
  misc_feature 1..20: note = CRISPR gRNA sequence
  source 1..20: mol_type = other DNA
cccttcctggggatttacat

SEQ ID NO: 8280 - DNA, 20 bp, synthetic construct
  misc_feature 1..20: note = CRISPR gRNA sequence
  source 1..20: mol_type = other DNA
ccttcctggggatttacatg

SEQ ID NO: 8281 - DNA, 20 bp, synthetic construct
  misc_feature 1..20: note = CRISPR gRNA sequence
  source 1..20: mol_type = other DNA
cttcctggggatttacatgg

SEQ ID NO: 8282 - DNA, 20 bp, synthetic construct
  misc_feature 1..20: note = CRISPR gRNA sequence
  source 1..20: mol_type = other DNA
cctggggatttacatggggg

SEQ ID NO: 8283 - DNA, 20 bp, synthetic construct
  misc_feature 1..20: note = CRISPR gRNA sequence
  source 1..20: mol_type = other DNA
ggggatttacatgggggaag

SEQ ID NO: 8284 - DNA, 20 bp, synthetic construct
  misc_feature 1..20: note = CRISPR gRNA sequence
  source 1..20: mol_type = other DNA
gatttacatgggggaagcag

SEQ ID NO: 8285 - DNA, 20 bp, synthetic construct
  misc_feature 1..20: note = CRISPR gRNA sequence
  source 1..20: mol_type = other DNA
atgggggaagcagaagtgat

SEQ ID NO: 8286 - DNA, 20 bp, synthetic construct
  misc_feature 1..20: note = CRISPR gRNA sequence
  source 1..20: mol_type = other DNA
tgggggaagcagaagtgatt

SEQ ID NO: 8287 - DNA, 20 bp, synthetic construct
  misc_feature 1..20: note = CRISPR gRNA sequence
  source 1..20: mol_type = other DNA
gggggaagcagaagtgattg

SEQ ID NO: 8288 - DNA, 20 bp, synthetic construct
  misc_feature 1..20: note = CRISPR gRNA sequence
  source 1..20: mol_type = other DNA
aagcagaagtgattggggct

SEQ ID NO: 8289 - DNA, 20 bp, synthetic construct
  misc_feature 1..20: note = CRISPR gRNA sequence
  source 1..20: mol_type = other DNA
agcagaagtgattggggctg

SEQ ID NO: 8290 - DNA, 20 bp, synthetic construct
  misc_feature 1..20: note = CRISPR gRNA sequence
  source 1..20: mol_type = other DNA
cattcacatttcctcacaac

SEQ ID NO: 8291 - DNA, 20 bp, synthetic construct
  misc_feature 1..20: note = CRISPR gRNA sequence
  source 1..20: mol_type = other DNA
ttcacatttcctcacaactg

SEQ ID NO: 8292 - DNA, 20 bp, synthetic construct
  misc_feature 1..20: note = CRISPR gRNA sequence
  source 1..20: mol_type = other DNA
tcacatttcctcacaactgg

SEQ ID NO: 8293 - DNA, 20 bp, synthetic construct
  misc_feature 1..20: note = CRISPR gRNA sequence
  source 1..20: mol_type = other DNA
catttcctcacaactggagg

SEQ ID NO: 8294 - DNA, 20 bp, synthetic construct
  misc_feature 1..20: note = CRISPR gRNA sequence
  source 1..20: mol_type = other DNA
cacaactggaggcagtcatt

SEQ ID NO: 8295 - DNA, 20 bp, synthetic construct
  misc_feature 1..20: note = CRISPR gRNA sequence
  source 1..20: mol_type = other DNA
acaactggaggcagtcatta

SEQ ID NO: 8296 - DNA, 20 bp, synthetic construct
  misc_feature 1..20: note = CRISPR gRNA sequence
  source 1..20: mol_type = other DNA
ggaggcagtcattaaggatt

SEQ ID NO: 8297 - DNA, 20 bp, synthetic construct
  misc_feature 1..20: note = CRISPR gRNA sequence
  source 1..20: mol_type = other DNA
gaggcagtcattaaggattt

SEQ ID NO: 8298 - DNA, 20 bp, synthetic construct
  misc_feature 1..20: note = CRISPR gRNA sequence
  source 1..20: mol_type = other DNA
ttaaggatttgggcatgtca

SEQ ID NO: 8299 - DNA, 20 bp, synthetic construct
  misc_feature 1..20: note = CRISPR gRNA sequence
  source 1..20: mol_type = other DNA
taaggatttgggcatgtcat

SEQ ID NO: 8300 - DNA, 20 bp, synthetic construct
  misc_feature 1..20: note = CRISPR gRNA sequence
  source 1..20: mol_type = other DNA
tttgggcatgtcataggatt

SEQ ID NO: 8301 - DNA, 20 bp, synthetic construct
  misc_feature 1..20: note = CRISPR gRNA sequence
  source 1..20: mol_type = other DNA
ttgggcatgtcataggattt

SEQ ID NO: 8302 - DNA, 20 bp, synthetic construct
  misc_feature 1..20: note = CRISPR gRNA sequence
  source 1..20: mol_type = other DNA
tgggtgtttttctcccccct

SEQ ID NO: 8303 - DNA, 20 bp, synthetic construct
  misc_feature 1..20: note = CRISPR gRNA sequence
  source 1..20: mol_type = other DNA
gtgtttttctccccccttag

SEQ ID NO: 8304 - DNA, 20 bp, synthetic construct
  misc_feature 1..20: note = CRISPR gRNA sequence
  source 1..20: mol_type = other DNA
cccccttagtggcatctcca

SEQ ID NO: 8305 - DNA, 20 bp, synthetic construct
  misc_feature 1..20: note = CRISPR gRNA sequence
  source 1..20: mol_type = other DNA
ccccttagtggcatctccac

SEQ ID NO: 8306 - DNA, 20 bp, synthetic construct
  misc_feature 1..20: note = CRISPR gRNA sequence
  source 1..20: mol_type = other DNA
cttagtggcatctccacagg

SEQ ID NO: 8307 - DNA, 20 bp, synthetic construct
  misc_feature 1..20: note = CRISPR gRNA sequence
  source 1..20: mol_type = other DNA
ggcatctccacaggcagcga

SEQ ID NO: 8308 - DNA, 20 bp, synthetic construct
  misc_feature 1..20: note = CRISPR gRNA sequence
  source 1..20: mol_type = other DNA
acaggcagcgaaagctgtct

SEQ ID NO: 8309 - DNA, 20 bp, synthetic construct
  misc_feature 1..20: note = CRISPR gRNA sequence
  source 1..20: mol_type = other DNA
gcgaaagctgtctaagcaaa

SEQ ID NO: 8310 - DNA, 20 bp, synthetic construct
  misc_feature 1..20: note = CRISPR gRNA sequence
  source 1..20: mol_type = other DNA
cgaaagctgtctaagcaaat

SEQ ID NO: 8311 - DNA, 20 bp, synthetic construct
  misc_feature 1..20: note = CRISPR gRNA sequence
  source 1..20: mol_type = other DNA
agctgtctaagcaaataggt

SEQ ID NO: 8312 - DNA, 20 bp, synthetic construct
  misc_feature 1..20: note = CRISPR gRNA sequence
  source 1..20: mol_type = other DNA
gctgtctaagcaaataggtg

SEQ ID NO: 8313 - DNA, 20 bp, synthetic construct
  misc_feature 1..20: note = CRISPR gRNA sequence
  source 1..20: mol_type = other DNA
gtctaagcaaataggtgagg

SEQ ID NO: 8314 - DNA, 20 bp, synthetic construct
  misc_feature 1..20: note = CRISPR gRNA sequence
  source 1..20: mol_type = other DNA
aaataggtgaggcagtgcgt

SEQ ID NO: 8315 - DNA, 20 bp, synthetic construct
  misc_feature 1..20: note = CRISPR gRNA sequence
  source 1..20: mol_type = other DNA
aaaacaacatacctgacact

SEQ ID NO: 8316 - DNA, 20 bp, synthetic construct
  misc_feature 1..20: note = CRISPR gRNA sequence
  source 1..20: mol_type = other DNA
ctgacactgagtaatttata

SEQ ID NO: 8317 - DNA, 20 bp, synthetic construct
  misc_feature 1..20: note = CRISPR gRNA sequence
  source 1..20: mol_type = other DNA
aagaaaaaaaatatttctta

SEQ ID NO: 8318 - DNA, 20 bp, synthetic construct
  misc_feature 1..20: note = CRISPR gRNA sequence
  source 1..20: mol_type = other DNA
aaaaatatttcttacagtta

SEQ ID NO: 8319 - DNA, 20 bp, synthetic construct
  misc_feature 1..20: note = CRISPR gRNA sequence
  source 1..20: mol_type = other DNA
aaatatttcttacagttatg

SEQ ID NO: 8320 - DNA, 20 bp, synthetic construct
  misc_feature 1..20: note = CRISPR gRNA sequence
  source 1..20: mol_type = other DNA
aatatttcttacagttatgg

SEQ ID NO: 8321 - DNA, 20 bp, synthetic construct
  misc_feature 1..20: note = CRISPR gRNA sequence
  source 1..20: mol_type = other DNA
ttcttacagttatggaggct

SEQ ID NO: 8322 - DNA, 20 bp, synthetic construct
  misc_feature 1..20: note = CRISPR gRNA sequence
  source 1..20: mol_type = other DNA
ttacagttatggaggctgag

SEQ ID NO: 8323 - DNA, 20 bp, synthetic construct
  misc_feature 1..20: note = CRISPR gRNA sequence
  source 1..20: mol_type = other DNA
ttatggaggctgagaagtcc

SEQ ID NO: 8324 - DNA, 20 bp, synthetic construct
  misc_feature 1..20: note = CRISPR gRNA sequence
  source 1..20: mol_type = other DNA
tatggaggctgagaagtcca

SEQ ID NO: 8325 - DNA, 20 bp, synthetic construct
  misc_feature 1..20: note = CRISPR gRNA sequence
  source 1..20: mol_type = other DNA
gaggctgagaagtccaaggt

SEQ ID NO: 8326 - DNA, 20 bp, synthetic construct
  misc_feature 1..20: note = CRISPR gRNA sequence
  source 1..20: mol_type = other DNA
aggctgagaagtccaaggtt

SEQ ID NO: 8327 - DNA, 20 bp, synthetic construct
  misc_feature 1..20: note = CRISPR gRNA sequence
  source 1..20: mol_type = other DNA
ggctgagaagtccaaggtta

SEQ ID NO: 8328 - DNA, 20 bp, synthetic construct
  misc_feature 1..20: note = CRISPR gRNA sequence
  source 1..20: mol_type = other DNA
gctgagaagtccaaggttag

SEQ ID NO: 8329 - DNA, 20 bp, synthetic construct
  misc_feature 1..20: note = CRISPR gRNA sequence
  source 1..20: mol_type = other DNA
ccaaggttaggggctgcatc

SEQ ID NO: 8330 - DNA, 20 bp, synthetic construct
  misc_feature 1..20: note = CRISPR gRNA sequence
  source 1..20: mol_type = other DNA
ggttaggggctgcatctggt

SEQ ID NO: 8331 - DNA, 20 bp, synthetic construct
  misc_feature 1..20: note = CRISPR gRNA sequence
  source 1..20: mol_type = other DNA
gttaggggctgcatctggtg

SEQ ID NO: 8332 - DNA, 20 bp, synthetic construct
  misc_feature 1..20: note = CRISPR gRNA sequence
  source 1..20: mol_type = other DNA
ttaggggctgcatctggtga

SEQ ID NO: 8333 - DNA, 20 bp, synthetic construct
  misc_feature 1..20: note = CRISPR gRNA sequence
  source 1..20: mol_type = other DNA
tctggtgagggccttcttac

SEQ ID NO: 8334 - DNA, 20 bp, synthetic construct
  misc_feature 1..20: note = CRISPR gRNA sequence
  source 1..20: mol_type = other DNA
gtgagggccttcttactggt

SEQ ID NO: 8335 - DNA, 20 bp, synthetic construct
  misc_feature 1..20: note = CRISPR gRNA sequence
  source 1..20: mol_type = other DNA
tgagggccttcttactggtg

SEQ ID NO: 8336 - DNA, 20 bp, synthetic construct
  misc_feature 1..20: note = CRISPR gRNA sequence
  source 1..20: mol_type = other DNA
ttactggtgaggactctctg

SEQ ID NO: 8337 - DNA, 20 bp, synthetic construct
  misc_feature 1..20: note = CRISPR gRNA sequence
  source 1..20: mol_type = other DNA
actggtgaggactctctgca

SEQ ID NO: 8338 - DNA, 20 bp, synthetic construct
  misc_feature 1..20: note = CRISPR gRNA sequence
  source 1..20: mol_type = other DNA
aggactctctgcagagtccc

SEQ ID NO: 8339 - DNA, 20 bp, synthetic construct
  misc_feature 1..20: note = CRISPR gRNA sequence
  source 1..20: mol_type = other DNA
ggactctctgcagagtccca

SEQ ID NO: 8340 - DNA, 20 bp, synthetic construct
  misc_feature 1..20: note = CRISPR gRNA sequence
  source 1..20: mol_type = other DNA
ctctctgcagagtcccaagg

SEQ ID NO: 8341 - DNA, 20 bp, synthetic construct
  misc_feature 1..20: note = CRISPR gRNA sequence
  source 1..20: mol_type = other DNA
tgcagagtcccaaggcagtg

SEQ ID NO: 8342 - DNA, 20 bp, synthetic construct
  misc_feature 1..20: note = CRISPR gRNA sequence
  source 1..20: mol_type = other DNA
gcagagtcccaaggcagtgt

SEQ ID NO: 8343 - DNA, 20 bp, synthetic construct
  misc_feature 1..20: note = CRISPR gRNA sequence
  source 1..20: mol_type = other DNA
cagagtcccaaggcagtgtg

SEQ ID NO: 8344 - DNA, 20 bp, synthetic construct
  misc_feature 1..20: note = CRISPR gRNA sequence
  source 1..20: mol_type = other DNA
aaggcagtgtggggcatcac

SEQ ID NO: 8345 - DNA, 20 bp, synthetic construct
  misc_feature 1..20: note = CRISPR gRNA sequence
  source 1..20: mol_type = other DNA
aggcagtgtggggcatcacg

SEQ ID NO: 8346 - DNA, 20 bp, synthetic construct
  misc_feature 1..20: note = CRISPR gRNA sequence
  source 1..20: mol_type = other DNA
agtgtggggcatcacgaggc

SEQ ID NO: 8347 - DNA, 20 bp, synthetic construct
  misc_feature 1..20: note = CRISPR gRNA sequence
  source 1..20: mol_type = other DNA
tgtggggcatcacgaggcaa

SEQ ID NO: 8348 - DNA, 20 bp, synthetic construct
  misc_feature 1..20: note = CRISPR gRNA sequence
  source 1..20: mol_type = other DNA
gtggggcatcacgaggcaag

SEQ ID NO: 8349 - DNA, 20 bp, synthetic construct
  misc_feature 1..20: note = CRISPR gRNA sequence
  source 1..20: mol_type = other DNA
catcacgaggcaagaggttt

SEQ ID NO: 8350 - DNA, 20 bp, synthetic construct
  misc_feature 1..20: note = CRISPR gRNA sequence
  source 1..20: mol_type = other DNA
ggcaagaggtttcggtgtga

SEQ ID NO: 8351 - DNA, 20 bp, synthetic construct
  misc_feature 1..20: note = CRISPR gRNA sequence
  source 1..20: mol_type = other DNA
tcctcttctcataaaaccac

SEQ ID NO: 8352 - DNA, 20 bp, synthetic construct
  misc_feature 1..20: note = CRISPR gRNA sequence
  source 1..20: mol_type = other DNA
tttatccactaatccatgaa

SEQ ID NO: 8353 - DNA, 20 bp, synthetic construct
  misc_feature 1..20: note = CRISPR gRNA sequence
  source 1..20: mol_type = other DNA
aacggattaacccattcatc

SEQ ID NO: 8354 - DNA, 20 bp, synthetic construct
  misc_feature 1..20: note = CRISPR gRNA sequence
  source 1..20: mol_type = other DNA
acggattaacccattcatca

SEQ ID NO: 8355 - DNA, 20 bp, synthetic construct
  misc_feature 1..20: note = CRISPR gRNA sequence
  source 1..20: mol_type = other DNA
ttaacccattcatcaaggaa

SEQ ID NO: 8356 - DNA, 20 bp, synthetic construct
  misc_feature 1..20: note = CRISPR gRNA sequence
  source 1..20: mol_type = other DNA
cattcatcaaggaaaagccc

SEQ ID NO: 8357 - DNA, 20 bp, synthetic construct
  misc_feature 1..20: note = CRISPR gRNA sequence
  source 1..20: mol_type = other DNA
aaagccccagtcacctctta

SEQ ID NO: 8358 - DNA, 20 bp, synthetic construct
  misc_feature 1..20: note = CRISPR gRNA sequence
  source 1..20: mol_type = other DNA
aagccccagtcacctcttaa

SEQ ID NO: 8359 - DNA, 20 bp, synthetic construct
  misc_feature 1..20: note = CRISPR gRNA sequence
  source 1..20: mol_type = other DNA
cacctctcaatactgccaca

SEQ ID NO: 8360 - DNA, 20 bp, synthetic construct
  misc_feature 1..20: note = CRISPR gRNA sequence
  source 1..20: mol_type = other DNA
acctctcaatactgccacat

SEQ ID NO: 8361 - DNA, 20 bp, synthetic construct
  misc_feature 1..20: note = CRISPR gRNA sequence
  source 1..20: mol_type = other DNA
cctctcaatactgccacata

SEQ ID NO: 8362 - DNA, 20 bp, synthetic construct
  misc_feature 1..20: note = CRISPR gRNA sequence
  source 1..20: mol_type = other DNA
ctctcaatactgccacatag

SEQ ID NO: 8363 - DNA, 20 bp, synthetic construct
  misc_feature 1..20: note = CRISPR gRNA sequence
  source 1..20: mol_type = other DNA
aggggattacatttatacat

SEQ ID NO: 8364 - DNA, 20 bp, synthetic construct
  misc_feature 1..20: note = CRISPR gRNA sequence
  source 1..20: mol_type = other DNA
ttacatttatacatgagttt

SEQ ID NO: 8365 - DNA, 20 bp, synthetic construct
  misc_feature 1..20: note = CRISPR gRNA sequence
  source 1..20: mol_type = other DNA
acatttatacatgagttttg

SEQ ID NO: 8366 - DNA, 20 bp, synthetic construct
  misc_feature 1..20: note = CRISPR gRNA sequence
  source 1..20: mol_type = other DNA
tttatacatgagttttggag

SEQ ID NO: 8367 - DNA, 20 bp, synthetic construct
  misc_feature 1..20: note = CRISPR gRNA sequence
  source 1..20: mol_type = other DNA
gacaaacattcacgtcataa

SEQ ID NO: 8368 - DNA, 20 bp, synthetic construct
  misc_feature 1..20: note = CRISPR gRNA sequence
  source 1..20: mol_type = other DNA
acaaacattcacgtcataac

SEQ ID NO: 8369 - DNA, 20 bp, synthetic construct
  misc_feature 1..20: note = CRISPR gRNA sequence
  source 1..20: mol_type = other DNA
aacattcacgtcataacagg

SEQ ID NO: 8370 - DNA, 20 bp, synthetic construct
  misc_feature 1..20: note = CRISPR gRNA sequence
  source 1..20: mol_type = other DNA
cataacaggcagcttcaccc

SEQ ID NO: 8371 - DNA, 20 bp, synthetic construct
  misc_feature 1..20: note = CRISPR gRNA sequence
  source 1..20: mol_type = other DNA
ttcacccaagtctgctcctc

SEQ ID NO: 8372 - DNA, 20 bp, synthetic construct
  misc_feature 1..20: note = CRISPR gRNA sequence
  source 1..20: mol_type = other DNA
aagtctgctcctcaagtctg

SEQ ID NO: 8373 - DNA, 20 bp, synthetic construct
  misc_feature 1..20: note = CRISPR gRNA sequence
  source 1..20: mol_type = other DNA
agtctgctcctcaagtctgt

SEQ ID NO: 8374 - DNA, 20 bp, synthetic construct
  misc_feature 1..20: note = CRISPR gRNA sequence
  source 1..20: mol_type = other DNA
gtgggttttctctctgcttc

SEQ ID NO: 8375 - DNA, 20 bp, synthetic construct
  misc_feature 1..20: note = CRISPR gRNA sequence
  source 1..20: mol_type = other DNA
ggttttctctctgcttctgg

SEQ ID NO: 8376 - DNA, 20 bp, synthetic construct
  misc_feature 1..20: note = CRISPR gRNA sequence
  source 1..20: mol_type = other DNA
gttttctctctgcttctgga

SEQ ID NO: 8377 - DNA, 20 bp, synthetic construct
  misc_feature 1..20: note = CRISPR gRNA sequence
  source 1..20: mol_type = other DNA
ctctctgcttctggaaggtg

SEQ ID NO: 8378 - DNA, 20 bp, synthetic construct
  misc_feature 1..20: note = CRISPR gRNA sequence
  source 1..20: mol_type = other DNA
tgcttctggaaggtgaagcc

SEQ ID NO: 8379 - DNA, 20 bp, synthetic construct
  misc_feature 1..20: note = CRISPR gRNA sequence
  source 1..20: mol_type = other DNA
gcttctggaaggtgaagccc

SEQ ID NO: 8380 - DNA, 20 bp, synthetic construct
  misc_feature 1..20: note = CRISPR gRNA sequence
  source 1..20: mol_type = other DNA
tggaaggtgaagcccaggcc

SEQ ID NO: 8381 - DNA, 20 bp, synthetic construct
  misc_feature 1..20: note = CRISPR gRNA sequence
  source 1..20: mol_type = other DNA
ggaaggtgaagcccaggcct

SEQ ID NO: 8382 - DNA, 20 bp, synthetic construct
  misc_feature 1..20: note = CRISPR gRNA sequence
  source 1..20: mol_type = other DNA
ggtgaagcccaggcctgggc

SEQ ID NO: 8383 - DNA, 20 bp, synthetic construct
  misc_feature 1..20: note = CRISPR gRNA sequence
  source 1..20: mol_type = other DNA
cctgggcaagtattcttttg

SEQ ID NO: 8384 - DNA, 20 bp, synthetic construct
  misc_feature 1..20: note = CRISPR gRNA sequence
  source 1..20: mol_type = other DNA
agcatcctgaaatatgacct

SEQ ID NO: 8385 - DNA, 20 bp, synthetic construct
  misc_feature 1..20: note = CRISPR gRNA sequence
  source 1..20: mol_type = other DNA
tagcttctaaatgtgtaaaa

SEQ ID NO: 8386 - DNA, 20 bp, synthetic construct
  misc_feature 1..20: note = CRISPR gRNA sequence
  source 1..20: mol_type = other DNA
gcttctaaatgtgtaaaatg

SEQ ID NO: 8387 - DNA, 20 bp, synthetic construct
  misc_feature 1..20: note = CRISPR gRNA sequence
  source 1..20: mol_type = other DNA
aataatcacacccaccatca

SEQ ID NO: 8388 - DNA, 20 bp, synthetic construct
  misc_feature 1..20: note = CRISPR gRNA sequence
  source 1..20: mol_type = other DNA
ataatcacacccaccatcac

SEQ ID NO: 8389 - DNA, 20 bp, synthetic construct
  misc_feature 1..20: note = CRISPR gRNA sequence
  source 1..20: mol_type = other DNA
tcacacccaccatcacggga

SEQ ID NO: 8390 - DNA, 20 bp, synthetic construct
  misc_feature 1..20: note = CRISPR gRNA sequence
  source 1..20: mol_type = other DNA
caccatcacgggatggttgt

SEQ ID NO: 8391 - DNA, 20 bp, synthetic construct
  misc_feature 1..20: note = CRISPR gRNA sequence
  source 1..20: mol_type = other DNA
ggatggttgtaagactgaat

SEQ ID NO: 8392 - DNA, 20 bp, synthetic construct
  misc_feature 1..20: note = CRISPR gRNA sequence
  source 1..20: mol_type = other DNA
tgaataagttacaatgtgta

SEQ ID NO: 8393 - DNA, 20 bp, synthetic construct
  misc_feature 1..20: note = CRISPR gRNA sequence
  source 1..20: mol_type = other DNA
gttacaatgtgtaaagcatt

SEQ ID NO: 8394 - DNA, 20 bp, synthetic construct
  misc_feature 1..20: note = CRISPR gRNA sequence
  source 1..20: mol_type = other DNA
aatgtgtaaagcatttagaa

SEQ ID NO: 8395 - DNA, 20 bp, synthetic construct
  misc_feature 1..20: note = CRISPR gRNA sequence
  source 1..20: mol_type = other DNA
atgtgtaaagcatttagaaa

SEQ ID NO: 8396 - DNA, 20 bp, synthetic construct
  misc_feature 1..20: note = CRISPR gRNA sequence
  source 1..20: mol_type = other DNA
atttagaaaaggaatttgca

SEQ ID NO: 8397 - DNA, 20 bp, synthetic construct
  misc_feature 1..20: note = CRISPR gRNA sequence
  source 1..20: mol_type = other DNA
ttagaaaaggaatttgcaca

SEQ ID NO: 8398 - DNA, 20 bp, synthetic construct
  misc_feature 1..20: note = CRISPR gRNA sequence
  source 1..20: mol_type = other DNA
aaaaggaatttgcacagagt

SEQ ID NO: 8399 - DNA, 20 bp, synthetic construct
  misc_feature 1..20: note = CRISPR gRNA sequence
  source 1..20: mol_type = other DNA
atttgcacagagtaagcatt

SEQ ID NO: 8400 - DNA, 20 bp, synthetic construct
  misc_feature 1..20: note = CRISPR gRNA sequence
  source 1..20: mol_type = other DNA
tgcacagagtaagcattcag

SEQ ID NO: 8401 - DNA, 20 bp, synthetic construct
  misc_feature 1..20: note = CRISPR gRNA sequence
  source 1..20: mol_type = other DNA
agtaagcattcagtagatgt

SEQ ID NO: 8402 - DNA, 20 bp, synthetic construct
  misc_feature 1..20: note = CRISPR gRNA sequence
  source 1..20: mol_type = other DNA
gtaagcattcagtagatgtt

SEQ ID NO: 8403 - DNA, 20 bp, synthetic construct
  misc_feature 1..20: note = CRISPR gRNA sequence
  source 1..20: mol_type = other DNA
cattttcatcaccttcatta

SEQ ID NO: 8404 - DNA, 20 bp, synthetic construct
  misc_feature 1..20: note = CRISPR gRNA sequence
  source 1..20: mol_type = other DNA
atggccatcattccattcct

SEQ ID NO: 8405 - DNA, 20 bp, synthetic construct
  misc_feature 1..20: note = CRISPR gRNA sequence
  source 1..20: mol_type = other DNA
catcattccattcctcagct

SEQ ID NO: 8406 - DNA, 20 bp, synthetic construct
  misc_feature 1..20: note = CRISPR gRNA sequence
  source 1..20: mol_type = other DNA
cattccattcctcagctcag

SEQ ID NO: 8407 - DNA, 20 bp, synthetic construct
  misc_feature 1..20: note = CRISPR gRNA sequence
  source 1..20: mol_type = other DNA
ctcagctcagaagccttcta

SEQ ID NO: 8408 - DNA, 20 bp, synthetic construct
  misc_feature 1..20: note = CRISPR gRNA sequence
  source 1..20: mol_type = other DNA
tccccattgcttataaaatc

SEQ ID NO: 8409 - DNA, 20 bp, synthetic construct
  misc_feature 1..20: note = CRISPR gRNA sequence
  source 1..20: mol_type = other DNA
aatcaagtcctaactttccc

SEQ ID NO: 8410 - DNA, 20 bp, synthetic construct
  misc_feature 1..20: note = CRISPR gRNA sequence
  source 1..20: mol_type = other DNA
taccaccgtcacctatctct

SEQ ID NO: 8411 - DNA, 20 bp, synthetic construct
  misc_feature 1..20: note = CRISPR gRNA sequence
  source 1..20: mol_type = other DNA
accaccgtcacctatctctc

SEQ ID NO: 8412 - DNA, 20 bp, synthetic construct
  misc_feature 1..20: note = CRISPR gRNA sequence
  source 1..20: mol_type = other DNA
ccaccgtcacctatctctca

SEQ ID NO: 8413 - DNA, 20 bp, synthetic construct
  misc_feature 1..20: note = CRISPR gRNA sequence
  source 1..20: mol_type = other DNA
ttcctaaacatactctgaac

SEQ ID NO: 8414 - DNA, 20 bp, synthetic construct
  misc_feature 1..20: note = CRISPR gRNA sequence
  source 1..20: mol_type = other DNA
ctcactctgccactgtgacc

SEQ ID NO: 8415 - DNA, 20 bp, synthetic construct
  misc_feature 1..20: note = CRISPR gRNA sequence
  source 1..20: mol_type = other DNA
ctctgccactgtgacccaga

SEQ ID NO: 8416 - DNA, 20 bp, synthetic construct
  misc_feature 1..20: note = CRISPR gRNA sequence
  source 1..20: mol_type = other DNA
gctatctgttctccttctcc

SEQ ID NO: 8417 - DNA, 20 bp, synthetic construct
  misc_feature 1..20: note = CRISPR gRNA sequence
  source 1..20: mol_type = other DNA
cagactctgcctcatctttc

SEQ ID NO: 8418 - DNA, 20 bp, synthetic construct
  misc_feature 1..20: note = CRISPR gRNA sequence
  source 1..20: mol_type = other DNA
agactctgcctcatctttca

SEQ ID NO: 8419 - DNA, 20 bp, synthetic construct
  misc_feature 1..20: note = CRISPR gRNA sequence
  source 1..20: mol_type = other DNA
ctgcctcatctttcaaggcc

SEQ ID NO: 8420 - DNA, 20 bp, synthetic construct
  misc_feature 1..20: note = CRISPR gRNA sequence
  source 1..20: mol_type = other DNA
catctttcaaggcctggttc

SEQ ID NO: 8421 - DNA, 20 bp, synthetic construct
  misc_feature 1..20: note = CRISPR gRNA sequence
  source 1..20: mol_type = other DNA
atctttcaaggcctggttcc

SEQ ID NO: 8422 - DNA, 20 bp, synthetic construct
  misc_feature 1..20: note = CRISPR gRNA sequence
  source 1..20: mol_type = other DNA
ggttccaggatcccttcctc

SEQ ID NO: 8423 - DNA, 20 bp, synthetic construct
  misc_feature 1..20: note = CRISPR gRNA sequence
  source 1..20: mol_type = other DNA
gttccaggatcccttcctcc

SEQ ID NO: 8424 - DNA, 20 bp, synthetic construct
  misc_feature 1..20: note = CRISPR gRNA sequence
  source 1..20: mol_type = other DNA
ccaggatcccttcctccagg

SEQ ID NO: 8425 - DNA, 20 bp, synthetic construct
  misc_feature 1..20: note = CRISPR gRNA sequence
  source 1..20: mol_type = other DNA
ccaccatacaccttttttct

SEQ ID NO: 8426 - DNA, 20 bp, synthetic construct
  misc_feature 1..20: note = CRISPR gRNA sequence
  source 1..20: mol_type = other DNA
ttttctcggacttcatgtca

SEQ ID NO: 8427 - DNA, 20 bp, synthetic construct
  misc_feature 1..20: note = CRISPR gRNA sequence
  source 1..20: mol_type = other DNA
tgtcatggtgcctatattcc

SEQ ID NO: 8428 - DNA, 20 bp, synthetic construct
  misc_feature 1..20: note = CRISPR gRNA sequence
  source 1..20: mol_type = other DNA
gtcatggtgcctatattcca

SEQ ID NO: 8429 - DNA, 20 bp, synthetic construct
  misc_feature 1..20: note = CRISPR gRNA sequence
  source 1..20: mol_type = other DNA
tcatggtgcctatattccaa

SEQ ID NO: 8430 - DNA, 20 bp, synthetic construct
  misc_feature 1..20: note = CRISPR gRNA sequence
  source 1..20: mol_type = other DNA
gcctatattccaagggctct

SEQ ID NO: 8431 - DNA, 20 bp, synthetic construct
  misc_feature 1..20: note = CRISPR gRNA sequence
  source 1..20: mol_type = other DNA
gagccatgtacccctttata

SEQ ID NO: 8432 - DNA, 20 bp, synthetic construct
  misc_feature 1..20: note = CRISPR gRNA sequence
  source 1..20: mol_type = other DNA
tatagttaccactatttact

SEQ ID NO: 8433 - DNA, 20 bp, synthetic construct
  misc_feature 1..20: note = CRISPR gRNA sequence
  source 1..20: mol_type = other DNA
actgagtgcctactgtatac

SEQ ID NO: 8434 - DNA, 20 bp, synthetic construct
  misc_feature 1..20: note = CRISPR gRNA sequence
  source 1..20: mol_type = other DNA
ctgtataccagctactgtgt

SEQ ID NO: 8435 - DNA, 20 bp, synthetic construct
  misc_feature 1..20: note = CRISPR gRNA sequence
  source 1..20: mol_type = other DNA
agctactgtgttggatgctc

SEQ ID NO: 8436 - DNA, 20 bp, synthetic construct
  misc_feature 1..20: note = CRISPR gRNA sequence
  source 1..20: mol_type = other DNA
tgtgttggatgctctagatg

SEQ ID NO: 8437 - DNA, 20 bp, synthetic construct
  misc_feature 1..20: note = CRISPR gRNA sequence
  source 1..20: mol_type = other DNA
taattatcaccatcgattcc

SEQ ID NO: 8438 - DNA, 20 bp, synthetic construct
  misc_feature 1..20: note = CRISPR gRNA sequence
  source 1..20: mol_type = other DNA
aattatcaccatcgattcct

SEQ ID NO: 8439 - DNA, 20 bp, synthetic construct
  misc_feature 1..20: note = CRISPR gRNA sequence
  source 1..20: mol_type = other DNA
tatcaccatcgattcctggg

SEQ ID NO: 8440 - DNA, 20 bp, synthetic construct
  misc_feature 1..20: note = CRISPR gRNA sequence
  source 1..20: mol_type = other DNA
caccatcgattcctgggtag

SEQ ID NO: 8441 - DNA, 20 bp, synthetic construct
  misc_feature 1..20: note = CRISPR gRNA sequence
  source 1..20: mol_type = other DNA
accatcgattcctgggtagt

SEQ ID NO: 8442 - DNA, 20 bp, synthetic construct
  misc_feature 1..20: note = CRISPR gRNA sequence
  source 1..20: mol_type = other DNA
cattatttattcatcttaca

SEQ ID NO: 8443 - DNA, 20 bp, synthetic construct
  misc_feature 1..20: note = CRISPR gRNA sequence
  source 1..20: mol_type = other DNA
tttattcatcttacacagat

SEQ ID NO: 8444 - DNA, 20 bp, synthetic construct
  misc_feature 1..20: note = CRISPR gRNA sequence
  source 1..20: mol_type = other DNA
atcttacacagatgagaaaa

SEQ ID NO: 8445 - DNA, 20 bp, synthetic construct
  misc_feature 1..20: note = CRISPR gRNA sequence
  source 1..20: mol_type = other DNA
cttacacagatgagaaaatg

SEQ ID NO: 8446 - DNA, 20 bp, synthetic construct
  misc_feature 1..20: note = CRISPR gRNA sequence
  source 1..20: mol_type = other DNA
ttacacagatgagaaaatgg

SEQ ID NO: 8447 - DNA, 20 bp, synthetic construct
  misc_feature 1..20: note = CRISPR gRNA sequence
  source 1..20: mol_type = other DNA
gatgagaaaatggaggccca

SEQ ID NO: 8448 - DNA, 20 bp, synthetic construct
  misc_feature 1..20: note = CRISPR gRNA sequence
  source 1..20: mol_type = other DNA
gagaaaatggaggcccacag

SEQ ID NO: 8449 - DNA, 20 bp, synthetic construct
  misc_feature 1..20: note = CRISPR gRNA sequence
  source 1..20: mol_type = other DNA
gaggcccacagtggttaaat

SEQ ID NO: 8450 - DNA, 20 bp, synthetic construct
  misc_feature 1..20: note = CRISPR gRNA sequence
  source 1..20: mol_type = other DNA
gcccacagtggttaaataag

SEQ ID NO: 8451 - DNA, 20 bp, synthetic construct
  misc_feature 1..20: note = CRISPR gRNA sequence
  source 1..20: mol_type = other DNA
agtggttaaataagtagccc

SEQ ID NO: 8452 - DNA, 20 bp, synthetic construct
  misc_feature 1..20: note = CRISPR gRNA sequence
  source 1..20: mol_type = other DNA
ataagtagcccaagattgca

SEQ ID NO: 8453 - DNA, 20 bp, synthetic construct
  misc_feature 1..20: note = CRISPR gRNA sequence
  source 1..20: mol_type = other DNA
gtagcccaagattgcacagc

SEQ ID NO: 8454 - DNA, 20 bp, synthetic construct
  misc_feature 1..20: note = CRISPR gRNA sequence
  source 1..20: mol_type = other DNA
gcccaagattgcacagctag

SEQ ID NO: 8455 - DNA, 20 bp, synthetic construct
  misc_feature 1..20: note = CRISPR gRNA sequence
  source 1..20: mol_type = other DNA
cccaagattgcacagctagt

SEQ ID NO: 8456 - DNA, 20 bp, synthetic construct
  misc_feature 1..20: note = CRISPR gRNA sequence
  source 1..20: mol_type = other DNA
ccaagattgcacagctagta

SEQ ID NO: 8457 - DNA, 20 bp, synthetic construct
  misc_feature 1..20: note = CRISPR gRNA sequence
  source 1..20: mol_type = other DNA
gattgcacagctagtagggc

SEQ ID NO: 8458 - DNA, 20 bp, synthetic construct
  misc_feature 1..20: note = CRISPR gRNA sequence
  source 1..20: mol_type = other DNA
tgcacagctagtagggctag

SEQ ID NO: 8459 - DNA, 20 bp, synthetic construct
  misc_feature 1..20: note = CRISPR gRNA sequence
  source 1..20: mol_type = other DNA
cagctagtagggctagtgga

SEQ ID NO: 8460 - DNA, 20 bp, synthetic construct
  misc_feature 1..20: note = CRISPR gRNA sequence
  source 1..20: mol_type = other DNA
ctagtagggctagtggaaag

SEQ ID NO: 8461 - DNA, 20 bp, synthetic construct
  misc_feature 1..20: note = CRISPR gRNA sequence
  source 1..20: mol_type = other DNA
agtagggctagtggaaagta

SEQ ID NO: 8462 - DNA, 20 bp, synthetic construct
  misc_feature 1..20: note = CRISPR gRNA sequence
  source 1..20: mol_type = other DNA
gtagggctagtggaaagtag

SEQ ID NO: 8463 - DNA, 20 bp, synthetic construct
  misc_feature 1..20: note = CRISPR gRNA sequence
  source 1..20: mol_type = other DNA
gggctagtggaaagtagagg

SEQ ID NO: 8464 - DNA, 20 bp, synthetic construct
  misc_feature 1..20: note = CRISPR gRNA sequence
  source 1..20: mol_type = other DNA
gaatttgaactcaaatcctg

SEQ ID NO: 8465 - DNA, 20 bp, synthetic construct
  misc_feature 1..20: note = CRISPR gRNA sequence
  source 1..20: mol_type = other DNA
ttctgccttgctcttctttg

SEQ ID NO: 8466 - DNA, 20 bp, synthetic construct
  misc_feature 1..20: note = CRISPR gRNA sequence
  source 1..20: mol_type = other DNA
tgccttgctcttctttgtag

SEQ ID NO: 8467 - DNA, 20 bp, synthetic construct
  misc_feature 1..20: note = CRISPR gRNA sequence
  source 1..20: mol_type = other DNA
cttgctcttctttgtagcag

SEQ ID NO: 8468 - DNA, 20 bp, synthetic construct
  misc_feature 1..20: note = CRISPR gRNA sequence
  source 1..20: mol_type = other DNA
tcttctttgtagcagtagat

SEQ ID NO: 8469 - DNA, 20 bp, synthetic construct
  misc_feature 1..20: note = CRISPR gRNA sequence
  source 1..20: mol_type = other DNA
tagcagtagataagttttca

SEQ ID NO: 8470 - DNA, 20 bp, synthetic construct
  misc_feature 1..20: note = CRISPR gRNA sequence
  source 1..20: mol_type = other DNA
acatacctcatccttttgat

SEQ ID NO: 8471 - DNA, 20 bp, synthetic construct
  misc_feature 1..20: note = CRISPR gRNA sequence
  source 1..20: mol_type = other DNA
ctcatccttttgattagatt

SEQ ID NO: 8472 - DNA, 20 bp, synthetic construct
  misc_feature 1..20: note = CRISPR gRNA sequence
  source 1..20: mol_type = other DNA
tcatccttttgattagatta

SEQ ID NO: 8473 - DNA, 20 bp, synthetic construct
  misc_feature 1..20: note = CRISPR gRNA sequence
  source 1..20: mol_type = other DNA
catccttttgattagattaa

SEQ ID NO: 8474 - DNA, 20 bp, synthetic construct
  misc_feature 1..20: note = CRISPR gRNA sequence
  source 1..20: mol_type = other DNA
ttgattagattaagggcccc

SEQ ID NO: 8475 - DNA, 20 bp, synthetic construct
  misc_feature 1..20: note = CRISPR gRNA sequence
  source 1..20: mol_type = other DNA
gattagattaagggcccctg

SEQ ID NO: 8476 - DNA, 20 bp, synthetic construct
  misc_feature 1..20: note = CRISPR gRNA sequence
  source 1..20: mol_type = other DNA
attaagggcccctggagtgt

SEQ ID NO: 8477 - DNA, 20 bp, synthetic construct
  misc_feature 1..20: note = CRISPR gRNA sequence
  source 1..20: mol_type = other DNA
tcattcaacaaacatttctt

SEQ ID NO: 8478 - DNA, 20 bp, synthetic construct
  misc_feature 1..20: note = CRISPR gRNA sequence
  source 1..20: mol_type = other DNA
cttgagtccccactgtgtgc

SEQ ID NO: 8479 - DNA, 20 bp, synthetic construct
  misc_feature 1..20: note = CRISPR gRNA sequence
  source 1..20: mol_type = other DNA
ttgagtccccactgtgtgcc

SEQ ID NO: 8480 - DNA, 20 bp, synthetic construct
  misc_feature 1..20: note = CRISPR gRNA sequence
  source 1..20: mol_type = other DNA
tccccactgtgtgccaggcc

SEQ ID NO: 8481 - DNA, 20 bp, synthetic construct
  misc_feature 1..20: note = CRISPR gRNA sequence
  source 1..20: mol_type = other DNA
cccactgtgtgccaggccca

SEQ ID NO: 8482 - DNA, 20 bp, synthetic construct
  misc_feature 1..20: note = CRISPR gRNA sequence
  source 1..20: mol_type = other DNA
ccactgtgtgccaggcccag

SEQ ID NO: 8483 - DNA, 20 bp, synthetic construct
  misc_feature 1..20: note = CRISPR gRNA sequence
  source 1..20: mol_type = other DNA
tgccaggcccagaggttccc

SEQ ID NO: 8484 - DNA, 20 bp, synthetic construct
  misc_feature 1..20: note = CRISPR gRNA sequence
  source 1..20: mol_type = other DNA
gcccagaggttccccagccc

SEQ ID NO: 8485 - DNA, 20 bp, synthetic construct
  misc_feature 1..20: note = CRISPR gRNA sequence
  source 1..20: mol_type = other DNA
cccagaggttccccagccca

SEQ ID NO: 8486 - DNA, 20 bp, synthetic construct
  misc_feature 1..20: note = CRISPR gRNA sequence
  source 1..20: mol_type = other DNA
aggttccccagcccaaggcc

SEQ ID NO: 8487 - DNA, 20 bp, synthetic construct
  misc_feature 1..20: note = CRISPR gRNA sequence
  source 1..20: mol_type = other DNA
ccagcccaaggcctggcaca

SEQ ID NO: 8488 - DNA, 20 bp, synthetic construct
  misc_feature 1..20: note = CRISPR gRNA sequence
  source 1..20: mol_type = other DNA
gcccaaggcctggcacacag

SEQ ID NO: 8489 - DNA, 20 bp, synthetic construct
  misc_feature 1..20: note = CRISPR gRNA sequence
  source 1..20: mol_type = other DNA
cccaaggcctggcacacagt

SEQ ID NO: 8490 - DNA, 20 bp, synthetic construct
  misc_feature 1..20: note = CRISPR gRNA sequence
  source 1..20: mol_type = other DNA
cctggcacacagtgggcctt

SEQ ID NO: 8491 - DNA, 20 bp, synthetic construct
  misc_feature 1..20: note = CRISPR gRNA sequence
  source 1..20: mol_type = other DNA
gcacacagtgggccttcagt

SEQ ID NO: 8492 - DNA, 20 bp, synthetic construct
  misc_feature 1..20: note = CRISPR gRNA sequence
  source 1..20: mol_type = other DNA
tgactgcgcttttccttgtc

SEQ ID NO: 8493 - DNA, 20 bp, synthetic construct
  misc_feature 1..20: note = CRISPR gRNA sequence
  source 1..20: mol_type = other DNA
gactgcgcttttccttgtct

SEQ ID NO: 8494 - DNA, 20 bp, synthetic construct
  misc_feature 1..20: note = CRISPR gRNA sequence
  source 1..20: mol_type = other DNA
tgcgcttttccttgtctggg

SEQ ID NO: 8495 - DNA, 20 bp, synthetic construct
  misc_feature 1..20: note = CRISPR gRNA sequence
  source 1..20: mol_type = other DNA
gcttttccttgtctgggcag

SEQ ID NO: 8496 - DNA, 20 bp, synthetic construct
  misc_feature 1..20: note = CRISPR gRNA sequence
  source 1..20: mol_type = other DNA
ccttgtctgggcagcggaac

SEQ ID NO: 8497 - DNA, 20 bp, synthetic construct
  misc_feature 1..20: note = CRISPR gRNA sequence
  source 1..20: mol_type = other DNA
tctgggcagcggaactggac

SEQ ID NO: 8498 - DNA, 20 bp, synthetic construct
  misc_feature 1..20: note = CRISPR gRNA sequence
  source 1..20: mol_type = other DNA
aactggaccagtatgtcttc

SEQ ID NO: 8499 - DNA, 20 bp, synthetic construct
  misc_feature 1..20: note = CRISPR gRNA sequence
  source 1..20: mol_type = other DNA
actggaccagtatgtcttcc

SEQ ID NO: 8500 - DNA, 20 bp, synthetic construct
  misc_feature 1..20: note = CRISPR gRNA sequence
  source 1..20: mol_type = other DNA
agtatgtcttccaggactcc

SEQ ID NO: 8501 - DNA, 20 bp, synthetic construct
  misc_feature 1..20: note = CRISPR gRNA sequence
  source 1..20: mol_type = other DNA
tgtcttccaggactcccagc

SEQ ID NO: 8502 - DNA, 20 bp, synthetic construct
  misc_feature 1..20: note = CRISPR gRNA sequence
  source 1..20: mol_type = other DNA
tcttccaggactcccagctg

SEQ ID NO: 8503 - DNA, 20 bp, synthetic construct
  misc_feature 1..20: note = CRISPR gRNA sequence
  source 1..20: mol_type = other DNA
cttccaggactcccagctgg

SEQ ID NO: 8504 - DNA, 20 bp, synthetic construct
  misc_feature 1..20: note = CRISPR gRNA sequence
  source 1..20: mol_type = other DNA
ttccaggactcccagctgga

SEQ ID NO: 8505 - DNA, 20 bp, synthetic construct
  misc_feature 1..20: note = CRISPR gRNA sequence
  source 1..20: mol_type = other DNA
gactcccagctggagggcct

SEQ ID NO: 8506 - DNA, 20 bp, synthetic construct
  misc_feature 1..20: note = CRISPR gRNA sequence
  source 1..20: mol_type = other DNA
cccagctggagggcctgagc

SEQ ID NO: 8507 - DNA, 20 bp, synthetic construct
  misc_feature 1..20: note = CRISPR gRNA sequence
  source 1..20: mol_type = other DNA
ccagctggagggcctgagca

SEQ ID NO: 8508 - DNA, 20 bp, synthetic construct
  misc_feature 1..20: note = CRISPR gRNA sequence
  source 1..20: mol_type = other DNA
ggcctgagcaaggacatttt

SEQ ID NO: 8509 - DNA, 20 bp, synthetic construct
  misc_feature 1..20: note = CRISPR gRNA sequence
  source 1..20: mol_type = other DNA
tgagcaaggacattttcagt

SEQ ID NO: 8510 - DNA, 20 bp, synthetic construct
  misc_feature 1..20: note = CRISPR gRNA sequence
  source 1..20: mol_type = other DNA
ggacattttcagtaagtttg

SEQ ID NO: 8511 - DNA, 20 bp, synthetic construct
  misc_feature 1..20: note = CRISPR gRNA sequence
  source 1..20: mol_type = other DNA
cattttcagtaagtttgtgg

SEQ ID NO: 8512 - DNA, 20 bp, synthetic construct
  misc_feature 1..20: note = CRISPR gRNA sequence
  source 1..20: mol_type = other DNA
attttcagtaagtttgtggt

SEQ ID NO: 8513 - DNA, 20 bp, synthetic construct
  misc_feature 1..20: note = CRISPR gRNA sequence
  source 1..20: mol_type = other DNA
ttcagtaagtttgtggtggg

SEQ ID NO: 8514 - DNA, 20 bp, synthetic construct
  misc_feature 1..20: note = CRISPR gRNA sequence
  source 1..20: mol_type = other DNA
tcagtaagtttgtggtgggt

SEQ ID NO: 8515 - DNA, 20 bp, synthetic construct
  misc_feature 1..20: note = CRISPR gRNA sequence
  source 1..20: mol_type = other DNA
cagtaagtttgtggtgggtg

SEQ ID NO: 8516 - DNA, 20 bp, synthetic construct
  misc_feature 1..20: note = CRISPR gRNA sequence
  source 1..20: mol_type = other DNA
gtaagtttgtggtgggtggg

SEQ ID NO: 8517 - DNA, 20 bp, synthetic construct
  misc_feature 1..20: note = CRISPR gRNA sequence
  source 1..20: mol_type = other DNA
taagtttgtggtgggtgggg

SEQ ID NO: 8518 - DNA, 20 bp, synthetic construct
  misc_feature 1..20: note = CRISPR gRNA sequence
  source 1..20: mol_type = other DNA
tgtggtgggtggggaggtct

SEQ ID NO: 8519 - DNA, 20 bp, synthetic construct
  misc_feature 1..20: note = CRISPR gRNA sequence
  source 1..20: mol_type = other DNA
tgggtggggaggtcttggct

SEQ ID NO: 8520 - DNA, 20 bp, synthetic construct
  misc_feature 1..20: note = CRISPR gRNA sequence
  source 1..20: mol_type = other DNA
gcatttcctgccttgttccc

SEQ ID NO: 8521 - DNA, 20 bp, synthetic construct
  misc_feature 1..20: note = CRISPR gRNA sequence
  source 1..20: mol_type = other DNA
catttcctgccttgttccct

SEQ ID NO: 8522 - DNA, 20 bp, synthetic construct
  misc_feature 1..20: note = CRISPR gRNA sequence
  source 1..20: mol_type = other DNA
atttcctgccttgttccctg

SEQ ID NO: 8523 - DNA, 20 bp, synthetic construct
  misc_feature 1..20: note = CRISPR gRNA sequence
  source 1..20: mol_type = other DNA
tttcctgccttgttccctgg

SEQ ID NO: 8524 - DNA, 20 bp, synthetic construct
  misc_feature 1..20: note = CRISPR gRNA sequence
  source 1..20: mol_type = other DNA
ttcctgccttgttccctggg

SEQ ID NO: 8525 - DNA, 20 bp, synthetic construct
  misc_feature 1..20: note = CRISPR gRNA sequence
  source 1..20: mol_type = other DNA
acctgacgaccattcattga

SEQ ID NO: 8526 - DNA, 20 bp, synthetic construct
  misc_feature 1..20: note = CRISPR gRNA sequence
  source 1..20: mol_type = other DNA
cctgacgaccattcattgat

SEQ ID NO: 8527 - DNA, 20 bp, synthetic construct
  misc_feature 1..20: note = CRISPR gRNA sequence
  source 1..20: mol_type = other DNA
gacgaccattcattgatggg

SEQ ID NO: 8528 - DNA, 20 bp, synthetic construct
  misc_feature 1..20: note = CRISPR gRNA sequence
  source 1..20: mol_type = other DNA
accattcattgatgggcagt

SEQ ID NO: 8529 - DNA, 20 bp, synthetic construct
  misc_feature 1..20: note = CRISPR gRNA sequence
  source 1..20: mol_type = other DNA
gcagtcagacccctctcccc

SEQ ID NO: 8530 - DNA, 20 bp, synthetic construct
  misc_feature 1..20: note = CRISPR gRNA sequence
  source 1..20: mol_type = other DNA
cagtcagacccctctcccca

SEQ ID NO: 8531 - DNA, 20 bp, synthetic construct
  misc_feature 1..20: note = CRISPR gRNA sequence
  source 1..20: mol_type = other DNA
tcagacccctctccccaagg

SEQ ID NO: 8532 - DNA, 20 bp, synthetic construct
  misc_feature 1..20: note = CRISPR gRNA sequence
  source 1..20: mol_type = other DNA
cagacccctctccccaaggt

SEQ ID NO: 8533 - DNA, 20 bp, synthetic construct
  misc_feature 1..20: note = CRISPR gRNA sequence
  source 1..20: mol_type = other DNA
tctccccaaggtgggtacaa

SEQ ID NO: 8534 - DNA, 20 bp, synthetic construct
  misc_feature 1..20: note = CRISPR gRNA sequence
  source 1..20: mol_type = other DNA
tccccaaggtgggtacaata

SEQ ID NO: 8535 - DNA, 20 bp, synthetic construct
  misc_feature 1..20: note = CRISPR gRNA sequence
  source 1..20: mol_type = other DNA
ggtacaatagagactcacct

SEQ ID NO: 8536 - DNA, 20 bp, synthetic construct
  misc_feature 1..20: note = CRISPR gRNA sequence
  source 1..20: mol_type = other DNA
gtacaatagagactcacctt

SEQ ID NO: 8537 - DNA, 20 bp, synthetic construct
  misc_feature 1..20: note = CRISPR gRNA sequence
  source 1..20: mol_type = other DNA
tgggctttcattgattgtgt

SEQ ID NO: 8538 - DNA, 20 bp, synthetic construct
  misc_feature 1..20: note = CRISPR gRNA sequence
  source 1..20: mol_type = other DNA
ctttcattgattgtgtgagt

SEQ ID NO: 8539 - DNA, 20 bp, synthetic construct
  misc_feature 1..20: note = CRISPR gRNA sequence
  source 1..20: mol_type = other DNA
tgattgtgtgagttggtctc

SEQ ID NO: 8540 - DNA, 20 bp, synthetic construct
  misc_feature 1..20: note = CRISPR gRNA sequence
  source 1..20: mol_type = other DNA
ttggtctctggtttttctca

SEQ ID NO: 8541 - DNA, 20 bp, synthetic construct
  misc_feature 1..20: note = CRISPR gRNA sequence
  source 1..20: mol_type = other DNA
gtctctggtttttctcaaag

SEQ ID NO: 8542 - DNA, 20 bp, synthetic construct
  misc_feature 1..20: note = CRISPR gRNA sequence
  source 1..20: mol_type = other DNA
ctctggtttttctcaaagta

SEQ ID NO: 8543 - DNA, 20 bp, synthetic construct
  misc_feature 1..20: note = CRISPR gRNA sequence
  source 1..20: mol_type = other DNA
ttttctcaaagtagagcaca

SEQ ID NO: 8544 - DNA, 20 bp, synthetic construct
  misc_feature 1..20: note = CRISPR gRNA sequence
  source 1..20: mol_type = other DNA
tttctcaaagtagagcacat

SEQ ID NO: 8545 - DNA, 20 bp, synthetic construct
  misc_feature 1..20: note = CRISPR gRNA sequence
  source 1..20: mol_type = other DNA
caaagtagagcacataggac

SEQ ID NO: 8546 - DNA, 20 bp, synthetic construct
  misc_feature 1..20: note = CRISPR gRNA sequence
  source 1..20: mol_type = other DNA
agagcacataggaccagatg

SEQ ID NO: 8547 - DNA, 20 bp, synthetic construct
  misc_feature 1..20: note = CRISPR gRNA sequence
  source 1..20: mol_type = other DNA
ataggaccagatgaagtgat

SEQ ID NO: 8548 - DNA, 20 bp, synthetic construct
  misc_feature 1..20: note = CRISPR gRNA sequence
  source 1..20: mol_type = other DNA
gaccagatgaagtgatcggt

SEQ ID NO: 8549 - DNA, 20 bp, synthetic construct
  misc_feature 1..20: note = CRISPR gRNA sequence
  source 1..20: mol_type = other DNA
ccagatgaagtgatcggtga

SEQ ID NO: 8550 - DNA, 20 bp, synthetic construct
  misc_feature 1..20: note = CRISPR gRNA sequence
  source 1..20: mol_type = other DNA
tgaagtgatcggtgagagta

SEQ ID NO: 8551 - DNA, 20 bp, synthetic construct
  misc_feature 1..20: note = CRISPR gRNA sequence
  source 1..20: mol_type = other DNA
aagtgatcggtgagagtatg

SEQ ID NO: 8552 - DNA, 20 bp, synthetic construct
  misc_feature 1..20: note = CRISPR gRNA sequence
  source 1..20: mol_type = other DNA
cggtgagagtatggagatgc

SEQ ID NO: 8553 - DNA, 20 bp, synthetic construct
  misc_feature 1..20: note = CRISPR gRNA sequence
  source 1..20: mol_type = other DNA
tgagagtatggagatgccag

SEQ ID NO: 8554 - DNA, 20 bp, synthetic construct
  misc_feature 1..20: note = CRISPR gRNA sequence
  source 1..20: mol_type = other DNA
gagtatggagatgccagcag

SEQ ID NO: 8555 - DNA, 20 bp, synthetic construct
  misc_feature 1..20: note = CRISPR gRNA sequence
  source 1..20: mol_type = other DNA
atggagatgccagcagaagt

SEQ ID NO: 8556 - DNA, 20 bp, synthetic construct
  misc_feature 1..20: note = CRISPR gRNA sequence
  source 1..20: mol_type = other DNA
tggagatgccagcagaagtt

SEQ ID NO: 8557 - DNA, 20 bp, synthetic construct
  misc_feature 1..20: note = CRISPR gRNA sequence
  source 1..20: mol_type = other DNA
agatgccagcagaagttggg

SEQ ID NO: 8558 - DNA, 20 bp, synthetic construct
  misc_feature 1..20: note = CRISPR gRNA sequence
  source 1..20: mol_type = other DNA
ccagcagaagttgggcagaa

SEQ ID NO: 8559 - DNA, 20 bp, synthetic construct
  misc_feature 1..20: note = CRISPR gRNA sequence
  source 1..20: mol_type = other DNA
cagaagttgggcagaaaagt

SEQ ID NO: 8560 - DNA, 20 bp, synthetic construct
  misc_feature 1..20: note = CRISPR gRNA sequence
  source 1..20: mol_type = other DNA
gttgggcagaaaagtcagaa

SEQ ID NO: 8561 - DNA, 20 bp, synthetic construct
  misc_feature 1..20: note = CRISPR gRNA sequence
  source 1..20: mol_type = other DNA
agaaaagtcagaaaagacgt

SEQ ID NO: 8562 - DNA, 20 bp, synthetic construct
  misc_feature 1..20: note = CRISPR gRNA sequence
  source 1..20: mol_type = other DNA
aagtcagaaaagacgtgagt

SEQ ID NO: 8563 - DNA, 20 bp, synthetic construct
  misc_feature 1..20: note = CRISPR gRNA sequence
  source 1..20: mol_type = other DNA
agcccctccctgatccaacc

SEQ ID NO: 8564 - DNA, 20 bp, synthetic construct
  misc_feature 1..20: note = CRISPR gRNA sequence
  source 1..20: mol_type = other DNA
gatccaacctagccttgctt

SEQ ID NO: 8565 - DNA, 20 bp, synthetic construct
  misc_feature 1..20: note = CRISPR gRNA sequence
  source 1..20: mol_type = other DNA
acctagccttgcttgagacc

SEQ ID NO: 8566 - DNA, 20 bp, synthetic construct
  misc_feature 1..20: note = CRISPR gRNA sequence
  source 1..20: mol_type = other DNA
ctggcctttccttgactcca

SEQ ID NO: 8567 - DNA, 20 bp, synthetic construct
  misc_feature 1..20: note = CRISPR gRNA sequence
  source 1..20: mol_type = other DNA
cttgactccaaagcctgctg

SEQ ID NO: 8568 - DNA, 20 bp, synthetic construct
  misc_feature 1..20: note = CRISPR gRNA sequence
  source 1..20: mol_type = other DNA
ttgactccaaagcctgctgt

SEQ ID NO: 8569 - DNA, 20 bp, synthetic construct
  misc_feature 1..20: note = CRISPR gRNA sequence
  source 1..20: mol_type = other DNA
tccaacttgcttccctcgct

SEQ ID NO: 8570 - DNA, 20 bp, synthetic construct
  misc_feature 1..20: note = CRISPR gRNA sequence
  source 1..20: mol_type = other DNA
ttccctcgctaagtcctgtc

SEQ ID NO: 8571 - DNA, 20 bp, synthetic construct
  misc_feature 1..20: note = CRISPR gRNA sequence
  source 1..20: mol_type = other DNA
ctcgctaagtcctgtctggt

SEQ ID NO: 8572 - DNA, 20 bp, synthetic construct
  misc_feature 1..20: note = CRISPR gRNA sequence
  source 1..20: mol_type = other DNA
tcgctaagtcctgtctggtt

SEQ ID NO: 8573 - DNA, 20 bp, synthetic construct
  misc_feature 1..20: note = CRISPR gRNA sequence
  source 1..20: mol_type = other DNA
gctaagtcctgtctggttgg

SEQ ID NO: 8574 - DNA, 20 bp, synthetic construct
  misc_feature 1..20: note = CRISPR gRNA sequence
  source 1..20: mol_type = other DNA
ctaagtcctgtctggttggg

SEQ ID NO: 8575 - DNA, 20 bp, synthetic construct
  misc_feature 1..20: note = CRISPR gRNA sequence
  source 1..20: mol_type = other DNA
ctggttgggaggccctttaa

SEQ ID NO: 8576 - DNA, 20 bp, synthetic construct
  misc_feature 1..20: note = CRISPR gRNA sequence
  source 1..20: mol_type = other DNA
ggaggccctttaaaagccaa

SEQ ID NO: 8577 - DNA, 20 bp, synthetic construct
  misc_feature 1..20: note = CRISPR gRNA sequence
  source 1..20: mol_type = other DNA
gaggccctttaaaagccaac

SEQ ID NO: 8578 - DNA, 20 bp, synthetic construct
  misc_feature 1..20: note = CRISPR gRNA sequence
  source 1..20: mol_type = other DNA
ggccctttaaaagccaacag

SEQ ID NO: 8579 - DNA, 20 bp, synthetic construct
  misc_feature 1..20: note = CRISPR gRNA sequence
  source 1..20: mol_type = other DNA
atgtacatctgattatttca

SEQ ID NO: 8580 - DNA, 20 bp, synthetic construct
  misc_feature 1..20: note = CRISPR gRNA sequence
  source 1..20: mol_type = other DNA
tggccctgataaccctccaa

SEQ ID NO: 8581 - DNA, 20 bp, synthetic construct
  misc_feature 1..20: note = CRISPR gRNA sequence
  source 1..20: mol_type = other DNA
ggctacaaaatacatgccac

SEQ ID NO: 8582 - DNA, 20 bp, synthetic construct
  misc_feature 1..20: note = CRISPR gRNA sequence
  source 1..20: mol_type = other DNA
gctacaaaatacatgccaca

SEQ ID NO: 8583 - DNA, 20 bp, synthetic construct
  misc_feature 1..20: note = CRISPR gRNA sequence
  source 1..20: mol_type = other DNA
tacatgccacaaggcctgta

SEQ ID NO: 8584 - DNA, 20 bp, synthetic construct
  misc_feature 1..20: note = CRISPR gRNA sequence
  source 1..20: mol_type = other DNA
tccctctccaaacccactat

SEQ ID NO: 8585 - DNA, 20 bp, synthetic construct
  misc_feature 1..20: note = CRISPR gRNA sequence
  source 1..20: mol_type = other DNA
cactatgagacaccacactt

SEQ ID NO: 8586 - DNA, 20 bp, synthetic construct
  misc_feature 1..20: note = CRISPR gRNA sequence
  source 1..20: mol_type = other DNA
caccacacttcagccaccac

SEQ ID NO: 8587 - DNA, 20 bp, synthetic construct
  misc_feature 1..20: note = CRISPR gRNA sequence
  source 1..20: mol_type = other DNA
tataacccatgtgccctttc

SEQ ID NO: 8588 - DNA, 20 bp, synthetic construct
  misc_feature 1..20: note = CRISPR gRNA sequence
  source 1..20: mol_type = other DNA
ccatgtgccctttcaagcct

SEQ ID NO: 8589 - DNA, 20 bp, synthetic construct
  misc_feature 1..20: note = CRISPR gRNA sequence
  source 1..20: mol_type = other DNA
catgtgccctttcaagcctc

SEQ ID NO: 8590 - DNA, 20 bp, synthetic construct
  misc_feature 1..20: note = CRISPR gRNA sequence
  source 1..20: mol_type = other DNA
atgtgccctttcaagcctcg

SEQ ID NO: 8591 - DNA, 20 bp, synthetic construct
  misc_feature 1..20: note = CRISPR gRNA sequence
  source 1..20: mol_type = other DNA
ttcaagcctcggggcctttg

SEQ ID NO: 8592 - DNA, 20 bp, synthetic construct
  misc_feature 1..20: note = CRISPR gRNA sequence
  source 1..20: mol_type = other DNA
cggggcctttgcagttgcta

SEQ ID NO: 8593 - DNA, 20 bp, synthetic construct
  misc_feature 1..20: note = CRISPR gRNA sequence
  source 1..20: mol_type = other DNA
cagttgctatagtctctatc

SEQ ID NO: 8594 - DNA, 20 bp, synthetic construct
  misc_feature 1..20: note = CRISPR gRNA sequence
  source 1..20: mol_type = other DNA
tatctggaatgcccttcccc

SEQ ID NO: 8595 - DNA, 20 bp, synthetic construct
  misc_feature 1..20: note = CRISPR gRNA sequence
  source 1..20: mol_type = other DNA
ccttcccccagttcttccca

SEQ ID NO: 8596 - DNA, 20 bp, synthetic construct
  misc_feature 1..20: note = CRISPR gRNA sequence
  source 1..20: mol_type = other DNA
ctgactcctttgaatctttc

SEQ ID NO: 8597 - DNA, 20 bp, synthetic construct
  misc_feature 1..20: note = CRISPR gRNA sequence
  source 1..20: mol_type = other DNA
cctttgaatctttctggtgt

SEQ ID NO: 8598 - DNA, 20 bp, synthetic construct
  misc_feature 1..20: note = CRISPR gRNA sequence
  source 1..20: mol_type = other DNA
gctaaactgtcacctcttcc

SEQ ID NO: 8599 - DNA, 20 bp, synthetic construct
  misc_feature 1..20: note = CRISPR gRNA sequence
  source 1..20: mol_type = other DNA
tctctgaccatccttccatg

SEQ ID NO: 8600 - DNA, 20 bp, synthetic construct
  misc_feature 1..20: note = CRISPR gRNA sequence
  source 1..20: mol_type = other DNA
gaccatccttccatgtagat

SEQ ID NO: 8601 - DNA, 20 bp, synthetic construct
  misc_feature 1..20: note = CRISPR gRNA sequence
  source 1..20: mol_type = other DNA
tccttccatgtagattagct

SEQ ID NO: 8602 - DNA, 20 bp, synthetic construct
  misc_feature 1..20: note = CRISPR gRNA sequence
  source 1..20: mol_type = other DNA
cttgtgtgtctttttccttg

SEQ ID NO: 8603 - DNA, 20 bp, synthetic construct
  misc_feature 1..20: note = CRISPR gRNA sequence
  source 1..20: mol_type = other DNA
gtgtctttttccttgcagtt

SEQ ID NO: 8604 - DNA, 20 bp, synthetic construct
  misc_feature 1..20: note = CRISPR gRNA sequence
  source 1..20: mol_type = other DNA
gtttagcactcattaccatc

SEQ ID NO: 8605 - DNA, 20 bp, synthetic construct
  misc_feature 1..20: note = CRISPR gRNA sequence
  source 1..20: mol_type = other DNA
acgccttgctctcccactgt

SEQ ID NO: 8606 - DNA, 20 bp, synthetic construct
  misc_feature 1..20: note = CRISPR gRNA sequence
  source 1..20: mol_type = other DNA
cgccttgctctcccactgtg

SEQ ID NO: 8607 - DNA, 20 bp, synthetic construct
  misc_feature 1..20: note = CRISPR gRNA sequence
  source 1..20: mol_type = other DNA
ttgctctcccactgtgagga

SEQ ID NO: 8608 - DNA, 20 bp, synthetic construct
  misc_feature 1..20: note = CRISPR gRNA sequence
  source 1..20: mol_type = other DNA
tgctctcccactgtgaggac

SEQ ID NO: 8609 - DNA, 20 bp, synthetic construct
  misc_feature 1..20: note = CRISPR gRNA sequence
  source 1..20: mol_type = other DNA
gctctcccactgtgaggaca

SEQ ID NO: 8610 - DNA, 20 bp, synthetic construct
  misc_feature 1..20: note = CRISPR gRNA sequence
  source 1..20: mol_type = other DNA
cttgctcgtgactgtttccc

SEQ ID NO: 8611 - DNA, 20 bp, synthetic construct
  misc_feature 1..20: note = CRISPR gRNA sequence
  source 1..20: mol_type = other DNA
gtgactgtttccccagcatc

SEQ ID NO: 8612 - DNA, 20 bp, synthetic construct
  misc_feature 1..20: note = CRISPR gRNA sequence
  source 1..20: mol_type = other DNA
tgtttccccagcatctagtg

SEQ ID NO: 8613 - DNA, 20 bp, synthetic construct
  misc_feature 1..20: note = CRISPR gRNA sequence
  source 1..20: mol_type = other DNA
ccagcatctagtgcagtgcc

SEQ ID NO: 8614 - DNA, 20 bp, synthetic construct
  misc_feature 1..20: note = CRISPR gRNA sequence
  source 1..20: mol_type = other DNA
ctagtgcagtgcctggtatg

SEQ ID NO: 8615 - DNA, 20 bp, synthetic construct
  misc_feature 1..20: note = CRISPR gRNA sequence
  source 1..20: mol_type = other DNA
gtgcagtgcctggtatgcag

SEQ ID NO: 8616 - DNA, 20 bp, synthetic construct
  misc_feature 1..20: note = CRISPR gRNA sequence
  source 1..20: mol_type = other DNA
cctggtatgcagtagcacct

SEQ ID NO: 8617 - DNA, 20 bp, synthetic construct
  misc_feature 1..20: note = CRISPR gRNA sequence
  source 1..20: mol_type = other DNA
ggtatgcagtagcacctcag

SEQ ID NO: 8618 - DNA, 20 bp, synthetic construct
  misc_feature 1..20: note = CRISPR gRNA sequence
  source 1..20: mol_type = other DNA
gaatgaaaacatctgtaaaa

SEQ ID NO: 8619 - DNA, 20 bp, synthetic construct
  misc_feature 1..20: note = CRISPR gRNA sequence
  source 1..20: mol_type = other DNA
aatgaaaacatctgtaaaat

SEQ ID NO: 8620 - DNA, 20 bp, synthetic construct
  misc_feature 1..20: note = CRISPR gRNA sequence
  source 1..20: mol_type = other DNA
catctgtaaaatgggtgtaa

SEQ ID NO: 8621 - DNA, 20 bp, synthetic construct
  misc_feature 1..20: note = CRISPR gRNA sequence
  source 1..20: mol_type = other DNA
aatgggtgtaacagttaact

SEQ ID NO: 8622 - DNA, 20 bp, synthetic construct
  misc_feature 1..20: note = CRISPR gRNA sequence
  source 1..20: mol_type = other DNA
agttaactgagtacttatta

SEQ ID NO: 8623 - DNA, 20 bp, synthetic construct
  misc_feature 1..20: note = CRISPR gRNA sequence
  source 1..20: mol_type = other DNA
gttaactgagtacttattat

SEQ ID NO: 8624 - DNA, 20 bp, synthetic construct
  misc_feature 1..20: note = CRISPR gRNA sequence
  source 1..20: mol_type = other DNA
ttatgggtctgaccatgtgt

SEQ ID NO: 8625 - DNA, 20 bp, synthetic construct
  misc_feature 1..20: note = CRISPR gRNA sequence
  source 1..20: mol_type = other DNA
aagtcctgtatctatttatt

SEQ ID NO: 8626 - DNA, 20 bp, synthetic construct
  misc_feature 1..20: note = CRISPR gRNA sequence
  source 1..20: mol_type = other DNA
ctatttattcagttcttaaa

SEQ ID NO: 8627 - DNA, 20 bp, synthetic construct
  misc_feature 1..20: note = CRISPR gRNA sequence
  source 1..20: mol_type = other DNA
tatttattcagttcttaaac

SEQ ID NO: 8628 - DNA, 20 bp, synthetic construct
  misc_feature 1..20: note = CRISPR gRNA sequence
  source 1..20: mol_type = other DNA
ttaaacaggtgaatcgcaca

SEQ ID NO: 8629 - DNA, 20 bp, synthetic construct
  misc_feature 1..20: note = CRISPR gRNA sequence
  source 1..20: mol_type = other DNA
taaacaggtgaatcgcacac

SEQ ID NO: 8630 - DNA, 20 bp, synthetic construct
  misc_feature 1..20: note = CRISPR gRNA sequence
  source 1..20: mol_type = other DNA
aaacaggtgaatcgcacaca

SEQ ID NO: 8631 - DNA, 20 bp, synthetic construct
  misc_feature 1..20: note = CRISPR gRNA sequence
  source 1..20: mol_type = other DNA
gtgaatcgcacacagggtat

SEQ ID NO: 8632 - DNA, 20 bp, synthetic construct
  misc_feature 1..20: note = CRISPR gRNA sequence
  source 1..20: mol_type = other DNA
cacagggtatgagattttaa

SEQ ID NO: 8633 - DNA, 20 bp, synthetic construct
  misc_feature 1..20: note = CRISPR gRNA sequence
  source 1..20: mol_type = other DNA
tatgagattttaaaagtgca

SEQ ID NO: 8634 - DNA, 20 bp, synthetic construct
  misc_feature 1..20: note = CRISPR gRNA sequence
  source 1..20: mol_type = other DNA
ttaaaagtgcaaagaatatt

SEQ ID NO: 8635 - DNA, 20 bp, synthetic construct
  misc_feature 1..20: note = CRISPR gRNA sequence
  source 1..20: mol_type = other DNA
agtgcaaagaatattcagtg

SEQ ID NO: 8636 - DNA, 20 bp, synthetic construct
  misc_feature 1..20: note = CRISPR gRNA sequence
  source 1..20: mol_type = other DNA
gtgcaaagaatattcagtga

SEQ ID NO: 8637 - DNA, 20 bp, synthetic construct
  misc_feature 1..20: note = CRISPR gRNA sequence
  source 1..20: mol_type = other DNA
aaagaatattcagtgaaggc

SEQ ID NO: 8638 - DNA, 20 bp, synthetic construct
  misc_feature 1..20: note = CRISPR gRNA sequence
  source 1..20: mol_type = other DNA
aagaatattcagtgaaggct

SEQ ID NO: 8639 - DNA, 20 bp, synthetic construct
  misc_feature 1..20: note = CRISPR gRNA sequence
  source 1..20: mol_type = other DNA
tattcagtgaaggctgggcg

SEQ ID NO: 8640 - DNA, 20 bp, synthetic construct
  misc_feature 1..20: note = CRISPR gRNA sequence
  source 1..20: mol_type = other DNA
tcagtgaaggctgggcgcag

SEQ ID NO: 8641 - DNA, 20 bp, synthetic construct
  misc_feature 1..20: note = CRISPR gRNA sequence
  source 1..20: mol_type = other DNA
gcggctcacacctgtaatcc

SEQ ID NO: 8642 - DNA, 20 bp, synthetic construct
  misc_feature 1..20: note = CRISPR gRNA sequence
  source 1..20: mol_type = other DNA
gctcacacctgtaatcccag

SEQ ID NO: 8643 - DNA, 20 bp, synthetic construct
  misc_feature 1..20: note = CRISPR gRNA sequence
  source 1..20: mol_type = other DNA
cacctgtaatcccagcagtt

SEQ ID NO: 8644 - DNA, 20 bp, synthetic construct
  misc_feature 1..20: note = CRISPR gRNA sequence
  source 1..20: mol_type = other DNA
acctgtaatcccagcagttt

SEQ ID NO: 8645 - DNA, 20 bp, synthetic construct
  misc_feature 1..20: note = CRISPR gRNA sequence
  source 1..20: mol_type = other DNA
ctgtaatcccagcagtttgg

SEQ ID NO: 8646 - DNA, 20 bp, synthetic construct
  misc_feature 1..20: note = CRISPR gRNA sequence
  source 1..20: mol_type = other DNA
tgtaatcccagcagtttggg

SEQ ID NO: 8647 - DNA, 20 bp, synthetic construct
  misc_feature 1..20: note = CRISPR gRNA sequence
  source 1..20: mol_type = other DNA
tcccagcagtttgggaggcc

SEQ ID NO: 8648 - DNA, 20 bp, synthetic construct
  misc_feature 1..20: note = CRISPR gRNA sequence
  source 1..20: mol_type = other DNA
cccagcagtttgggaggcca

SEQ ID NO: 8649 - DNA, 20 bp, synthetic construct
  misc_feature 1..20: note = CRISPR gRNA sequence
  source 1..20: mol_type = other DNA
ccagcagtttgggaggccaa

SEQ ID NO: 8650 - DNA, 20 bp, synthetic construct
  misc_feature 1..20: note = CRISPR gRNA sequence
  source 1..20: mol_type = other DNA
cagcagtttgggaggccaag

SEQ ID NO: 8651 - DNA, 20 bp, synthetic construct
  misc_feature 1..20: note = CRISPR gRNA sequence
  source 1..20: mol_type = other DNA
agcagtttgggaggccaagg

SEQ ID NO: 8652 - DNA, 20 bp, synthetic construct
  misc_feature 1..20: note = CRISPR gRNA sequence
  source 1..20: mol_type = other DNA
gtttgggaggccaaggggga

SEQ ID NO: 8653 - DNA, 20 bp, synthetic construct
  misc_feature 1..20: note = CRISPR gRNA sequence
  source 1..20: mol_type = other DNA
ccaagggggacggatcactt

SEQ ID NO: 8654 - DNA, 20 bp, synthetic construct
  misc_feature 1..20: note = CRISPR gRNA sequence
  source 1..20: mol_type = other DNA
caagggggacggatcacttg

SEQ ID NO: 8655 - DNA, 20 bp, synthetic construct
  misc_feature 1..20: note = CRISPR gRNA sequence
  source 1..20: mol_type = other DNA
ggggacggatcacttgaggt

SEQ ID NO: 8656 - DNA, 20 bp, synthetic construct
  misc_feature 1..20: note = CRISPR gRNA sequence
  source 1..20: mol_type = other DNA
gggacggatcacttgaggtc

SEQ ID NO: 8657 - DNA, 20 bp, synthetic construct
  misc_feature 1..20: note = CRISPR gRNA sequence
  source 1..20: mol_type = other DNA
gacggatcacttgaggtcag

SEQ ID NO: 8658 - DNA, 20 bp, synthetic construct
  misc_feature 1..20: note = CRISPR gRNA sequence
  source 1..20: mol_type = other DNA
tcaggagtttgatacctgcc

SEQ ID NO: 8659 - DNA, 20 bp, synthetic construct
  misc_feature 1..20: note = CRISPR gRNA sequence
  source 1..20: mol_type = other DNA
tgatacctgcctggccaaca

SEQ ID NO: 8660 - DNA, 20 bp, synthetic construct
  misc_feature 1..20: note = CRISPR gRNA sequence
  source 1..20: mol_type = other DNA
ctaccaaaaaatacaaaaat

SEQ ID NO: 8661 - DNA, 20 bp, synthetic construct
  misc_feature 1..20: note = CRISPR gRNA sequence
  source 1..20: mol_type = other DNA
caaaaaatacaaaaattagc

SEQ ID NO: 8662 - DNA, 20 bp, synthetic construct
  misc_feature 1..20: note = CRISPR gRNA sequence
  source 1..20: mol_type = other DNA
aaaaaatacaaaaattagcc

SEQ ID NO: 8663 - DNA, 20 bp, synthetic construct
  misc_feature 1..20: note = CRISPR gRNA sequence
  source 1..20: mol_type = other DNA
atacaaaaattagccgggtg

SEQ ID NO: 8664 - DNA, 20 bp, synthetic construct
  misc_feature 1..20: note = CRISPR gRNA sequence
  source 1..20: mol_type = other DNA
caaaaattagccgggtgtgg

SEQ ID NO: 8665 - DNA, 20 bp, synthetic construct
  misc_feature 1..20: note = CRISPR gRNA sequence
  source 1..20: mol_type = other DNA
gtggtgcacgcctgtaatcc

SEQ ID NO: 8666 - DNA, 20 bp, synthetic construct
  misc_feature 1..20: note = CRISPR gRNA sequence
  source 1..20: mol_type = other DNA
cgcctgtaatcccagctact

SEQ ID NO: 8667 - DNA, 20 bp, synthetic construct
  misc_feature 1..20: note = CRISPR gRNA sequence
  source 1..20: mol_type = other DNA
gcctgtaatcccagctactc

SEQ ID NO: 8668 - DNA, 20 bp, synthetic construct
  misc_feature 1..20: note = CRISPR gRNA sequence
  source 1..20: mol_type = other DNA
ctgtaatcccagctactcgg

SEQ ID NO: 8669 - DNA, 20 bp, synthetic construct
  misc_feature 1..20: note = CRISPR gRNA sequence
  source 1..20: mol_type = other DNA
tgtaatcccagctactcggg

SEQ ID NO: 8670 - DNA, 20 bp, synthetic construct
  misc_feature 1..20: note = CRISPR gRNA sequence
  source 1..20: mol_type = other DNA
tcccagctactcgggaggct

SEQ ID NO: 8671 - DNA, 20 bp, synthetic construct
  misc_feature 1..20: note = CRISPR gRNA sequence
  source 1..20: mol_type = other DNA
cccagctactcgggaggctg

SEQ ID NO: 8672 - DNA, 20 bp, synthetic construct
  misc_feature 1..20: note = CRISPR gRNA sequence
  source 1..20: mol_type = other DNA
agctactcgggaggctgagg

SEQ ID NO: 8673 - DNA, 20 bp, synthetic construct
  misc_feature 1..20: note = CRISPR gRNA sequence
  source 1..20: mol_type = other DNA
gctactcgggaggctgaggc

SEQ ID NO: 8674 - DNA, 20 bp, synthetic construct
  misc_feature 1..20: note = CRISPR gRNA sequence
  source 1..20: mol_type = other DNA
tactcgggaggctgaggcag

SEQ ID NO: 8675 - DNA, 20 bp, synthetic construct
  misc_feature 1..20: note = CRISPR gRNA sequence
  source 1..20: mol_type = other DNA
gcaggagaatcgcttgaacc

SEQ ID NO: 8676 - DNA, 20 bp, synthetic construct
  misc_feature 1..20: note = CRISPR gRNA sequence
  source 1..20: mol_type = other DNA
caggagaatcgcttgaaccc

SEQ ID NO: 8677 - DNA, 20 bp, synthetic construct
  misc_feature 1..20: note = CRISPR gRNA sequence
  source 1..20: mol_type = other DNA
ggagaatcgcttgaacccag

SEQ ID NO: 8678 - DNA, 20 bp, synthetic construct
  misc_feature 1..20: note = CRISPR gRNA sequence
  source 1..20: mol_type = other DNA
gagaatcgcttgaacccagg

SEQ ID NO: 8679 - DNA, 20 bp, synthetic construct
  misc_feature 1..20: note = CRISPR gRNA sequence
  source 1..20: mol_type = other DNA
aatcgcttgaacccaggagg

SEQ ID NO: 8680 - DNA, 20 bp, synthetic construct
  misc_feature 1..20: note = CRISPR gRNA sequence
  source 1..20: mol_type = other DNA
tcgcttgaacccaggaggtg

SEQ ID NO: 8681 - DNA, 20 bp, synthetic construct
  misc_feature 1..20: note = CRISPR gRNA sequence
  source 1..20: mol_type = other DNA
cgcttgaacccaggaggtgg

SEQ ID NO: 8682 - DNA, 20 bp, synthetic construct
  misc_feature 1..20: note = CRISPR gRNA sequence
  source 1..20: mol_type = other DNA
aacccaggaggtggaggttg

SEQ ID NO: 8683 - DNA, 20 bp, synthetic construct
  misc_feature 1..20: note = CRISPR gRNA sequence
  source 1..20: mol_type = other DNA
caggaggtggaggttgcagt

SEQ ID NO: 8684 - DNA, 20 bp, synthetic construct
  misc_feature 1..20: note = CRISPR gRNA sequence
  source 1..20: mol_type = other DNA
ggtggaggttgcagtgagct

SEQ ID NO: 8685 - DNA, 20 bp, synthetic construct
  misc_feature 1..20: note = CRISPR gRNA sequence
  source 1..20: mol_type = other DNA
aagatcacgccactgcactc

SEQ ID NO: 8686 - DNA, 20 bp, synthetic construct
  misc_feature 1..20: note = CRISPR gRNA sequence
  source 1..20: mol_type = other DNA
cacgccactgcactccagcc

SEQ ID NO: 8687 - DNA, 20 bp, synthetic construct
  misc_feature 1..20: note = CRISPR gRNA sequence
  source 1..20: mol_type = other DNA
acgccactgcactccagcct

SEQ ID NO: 8688 - DNA, 20 bp, synthetic construct
  misc_feature 1..20: note = CRISPR gRNA sequence
  source 1..20: mol_type = other DNA
ccactgcactccagcctggg

SEQ ID NO: 8689 - DNA, 20 bp, synthetic construct
  misc_feature 1..20: note = CRISPR gRNA sequence
  source 1..20: mol_type = other DNA
ctgcactccagcctgggtgg

SEQ ID NO: 8690 - DNA, 20 bp, synthetic construct
  misc_feature 1..20: note = CRISPR gRNA sequence
  source 1..20: mol_type = other DNA
gcactccagcctgggtggca

SEQ ID NO: 8691 - DNA, 20 bp, synthetic construct
  misc_feature 1..20: note = CRISPR gRNA sequence
  source 1..20: mol_type = other DNA
tccagcctgggtggcagagt

SEQ ID NO: 8692 - DNA, 20 bp, synthetic construct
  misc_feature 1..20: note = CRISPR gRNA sequence
  source 1..20: mol_type = other DNA
tctcaaacaacaacaaccaa

SEQ ID NO: 8693 - DNA, 20 bp, synthetic construct
  misc_feature 1..20: note = CRISPR gRNA sequence
  source 1..20: mol_type = other DNA
acaacaaccaaaagaatatt

SEQ ID NO: 8694 - DNA, 20 bp, synthetic construct
  misc_feature 1..20: note = CRISPR gRNA sequence
  source 1..20: mol_type = other DNA
tccctcccactcctgttctg

SEQ ID NO: 8695 - DNA, 20 bp, synthetic construct
  misc_feature 1..20: note = CRISPR gRNA sequence
  source 1..20: mol_type = other DNA
actcctgttctgtagtccct

SEQ ID NO: 8696 - DNA, 20 bp, synthetic construct
  misc_feature 1..20: note = CRISPR gRNA sequence
  source 1..20: mol_type = other DNA
cctcagttttgctcctatct

SEQ ID NO: 8697 - DNA, 20 bp, synthetic construct
  misc_feature 1..20: note = CRISPR gRNA sequence
  source 1..20: mol_type = other DNA
tcttagtcaacctatgtgac

SEQ ID NO: 8698 - DNA, 20 bp, synthetic construct
  misc_feature 1..20: note = CRISPR gRNA sequence
  source 1..20: mol_type = other DNA
cagcttcctttttgccttgt

SEQ ID NO: 8699 - DNA, 20 bp, synthetic construct
  misc_feature 1..20: note = CRISPR gRNA sequence
  source 1..20: mol_type = other DNA
tttttgccttgtcagaaata

SEQ ID NO: 8700 - DNA, 20 bp, synthetic construct
  misc_feature 1..20: note = CRISPR gRNA sequence
  source 1..20: mol_type = other DNA
tgccttgtcagaaataaagc

SEQ ID NO: 8701 - DNA, 20 bp, synthetic construct
  misc_feature 1..20: note = CRISPR gRNA sequence
  source 1..20: mol_type = other DNA
ttacttcattactccctgtc

SEQ ID NO: 8702 - DNA, 20 bp, synthetic construct
  misc_feature 1..20: note = CRISPR gRNA sequence
  source 1..20: mol_type = other DNA
tacttcattactccctgtct

SEQ ID NO: 8703 - DNA, 20 bp, synthetic construct
  misc_feature 1..20: note = CRISPR gRNA sequence
  source 1..20: mol_type = other DNA
cttcattactccctgtctgg

SEQ ID NO: 8704 - DNA, 20 bp, synthetic construct
  misc_feature 1..20: note = CRISPR gRNA sequence
  source 1..20: mol_type = other DNA
ttcattactccctgtctggg

SEQ ID NO: 8705 - DNA, 20 bp, synthetic construct
  misc_feature 1..20: note = CRISPR gRNA sequence
  source 1..20: mol_type = other DNA
aggtcacgttccatattatt

SEQ ID NO: 8706 - DNA, 20 bp, synthetic construct
  misc_feature 1..20: note = CRISPR gRNA sequence
  source 1..20: mol_type = other DNA
ggtcacgttccatattattg

SEQ ID NO: 8707 - DNA, 20 bp, synthetic construct
  misc_feature 1..20: note = CRISPR gRNA sequence
  source 1..20: mol_type = other DNA
gtcacgttccatattattga

SEQ ID NO: 8708 - DNA, 20 bp, synthetic construct
  misc_feature 1..20: note = CRISPR gRNA sequence
  source 1..20: mol_type = other DNA
cacgttccatattattgagg

SEQ ID NO: 8709 - DNA, 20 bp, synthetic construct
  misc_feature 1..20: note = CRISPR gRNA sequence
  source 1..20: mol_type = other DNA
cgttccatattattgaggga

SEQ ID NO: 8710 - DNA, 20 bp, synthetic construct
  misc_feature 1..20: note = CRISPR gRNA sequence
  source 1..20: mol_type = other DNA
gttccatattattgagggag

SEQ ID NO: 8711 - DNA, 20 bp, synthetic construct
  misc_feature 1..20: note = CRISPR gRNA sequence
  source 1..20: mol_type = other DNA
tattattgagggagaggaca

SEQ ID NO: 8712 - DNA, 20 bp, synthetic construct
  misc_feature 1..20: note = CRISPR gRNA sequence
  source 1..20: mol_type = other DNA
agaggacacggtcctatctt

SEQ ID NO: 8713 - DNA, 20 bp, synthetic construct
  misc_feature 1..20: note = CRISPR gRNA sequence
  source 1..20: mol_type = other DNA
ggacacggtcctatcttcag

SEQ ID NO: 8714 - DNA, 20 bp, synthetic construct
  misc_feature 1..20: note = CRISPR gRNA sequence
  source 1..20: mol_type = other DNA
tttgataaatatttcccccc

SEQ ID NO: 8715 - DNA, 20 bp, synthetic construct
  misc_feature 1..20: note = CRISPR gRNA sequence
  source 1..20: mol_type = other DNA
cccccaagattttattgtga

SEQ ID NO: 8716 - DNA, 20 bp, synthetic construct
  misc_feature 1..20: note = CRISPR gRNA sequence
  source 1..20: mol_type = other DNA
gattttattgtgaaagtttt

SEQ ID NO: 8717 - DNA, 20 bp, synthetic construct
  misc_feature 1..20: note = CRISPR gRNA sequence
  source 1..20: mol_type = other DNA
ttattgtgaaagttttcggc

SEQ ID NO: 8718 - DNA, 20 bp, synthetic construct
  misc_feature 1..20: note = CRISPR gRNA sequence
  source 1..20: mol_type = other DNA
tattgtgaaagttttcggcc

SEQ ID NO: 8719 - DNA, 20 bp, synthetic construct
  misc_feature 1..20: note = CRISPR gRNA sequence
  source 1..20: mol_type = other DNA
tgaaagttttcggccaggcg

SEQ ID NO: 8720 - DNA, 20 bp, synthetic construct
  misc_feature 1..20: note = CRISPR gRNA sequence
  source 1..20: mol_type = other DNA
aagttttcggccaggcgtgg

SEQ ID NO: 8721 - DNA, 20 bp, synthetic construct
  misc_feature 1..20: note = CRISPR gRNA sequence
  source 1..20: mol_type = other DNA
gtggctcacatctgtaatcc

SEQ ID NO: 8722 - DNA, 20 bp, synthetic construct
  misc_feature 1..20: note = CRISPR gRNA sequence
  source 1..20: mol_type = other DNA
catctgtaatcccagcactt

SEQ ID NO: 8723 - DNA, 20 bp, synthetic construct
  misc_feature 1..20: note = CRISPR gRNA sequence
  source 1..20: mol_type = other DNA
atctgtaatcccagcacttt

SEQ ID NO: 8724 - DNA, 20 bp, synthetic construct
  misc_feature 1..20: note = CRISPR gRNA sequence
  source 1..20: mol_type = other DNA
ctgtaatcccagcactttgg

SEQ ID NO: 8725 - DNA, 20 bp, synthetic construct
  misc_feature 1..20: note = CRISPR gRNA sequence
  source 1..20: mol_type = other DNA
tgtaatcccagcactttggg

SEQ ID NO: 8726 - DNA, 20 bp, synthetic construct
  misc_feature 1..20: note = CRISPR gRNA sequence
  source 1..20: mol_type = other DNA
tcccagcactttgggaggcc

SEQ ID NO: 8727 - DNA, 20 bp, synthetic construct
  misc_feature 1..20: note = CRISPR gRNA sequence
  source 1..20: mol_type = other DNA
cccagcactttgggaggcca

SEQ ID NO: 8728 - DNA, 20 bp, synthetic construct
  misc_feature 1..20: note = CRISPR gRNA sequence
  source 1..20: mol_type = other DNA
gcactttgggaggccaaggc

SEQ ID NO: 8729 - DNA, 20 bp, synthetic construct
  misc_feature 1..20: note = CRISPR gRNA sequence
  source 1..20: mol_type = other DNA
ctttgggaggccaaggctgg

SEQ ID NO: 8730 - DNA, 20 bp, synthetic construct
  misc_feature 1..20: note = CRISPR gRNA sequence
  source 1..20: mol_type = other DNA
ccaaggctggcagatcacct

SEQ ID NO: 8731 - DNA, 20 bp, synthetic construct
  misc_feature 1..20: note = CRISPR gRNA sequence
  source 1..20: mol_type = other DNA
caaggctggcagatcacctg

SEQ ID NO: 8732 - DNA, 20 bp, synthetic construct
  misc_feature 1..20: note = CRISPR gRNA sequence
  source 1..20: mol_type = other DNA
ctggcagatcacctgaggtc

SEQ ID NO: 8733 - DNA, 20 bp, synthetic construct
  misc_feature 1..20: note = CRISPR gRNA sequence
  source 1..20: mol_type = other DNA
ggcagatcacctgaggtcaa

SEQ ID NO: 8734 - DNA, 20 bp, synthetic construct
  misc_feature 1..20: note = CRISPR gRNA sequence
  source 1..20: mol_type = other DNA
tcacctgaggtcaagagttt

SEQ ID NO: 8735 - DNA, 20 bp, synthetic construct
  misc_feature 1..20: note = CRISPR gRNA sequence
  source 1..20: mol_type = other DNA
tgaggtcaagagtttgagac

SEQ ID NO: 8736 - DNA, 20 bp, synthetic construct
  misc_feature 1..20: note = CRISPR gRNA sequence
  source 1..20: mol_type = other DNA
tcaagagtttgagaccagcc

SEQ ID NO: 8737 - DNA, 20 bp, synthetic construct
  misc_feature 1..20: note = CRISPR gRNA sequence
  source 1..20: mol_type = other DNA
tgagaccagcctggccaaca

SEQ ID NO: 8738 - DNA, 20 bp, synthetic construct
  misc_feature 1..20: note = CRISPR gRNA sequence
  source 1..20: mol_type = other DNA
tctactaaaaatacaaaaat

SEQ ID NO: 8739 - DNA, 20 bp, synthetic construct
  misc_feature 1..20: note = CRISPR gRNA sequence
  source 1..20: mol_type = other DNA
ctaaaaatacaaaaattagc

SEQ ID NO: 8740 - DNA, 20 bp, synthetic construct
  misc_feature 1..20: note = CRISPR gRNA sequence
  source 1..20: mol_type = other DNA
taaaaatacaaaaattagcc

SEQ ID NO: 8741 - DNA, 20 bp, synthetic construct
  misc_feature 1..20: note = CRISPR gRNA sequence
  source 1..20: mol_type = other DNA
atacaaaaattagccaggcg

SEQ ID NO: 8742 - DNA, 20 bp, synthetic construct
  misc_feature 1..20: note = CRISPR gRNA sequence
  source 1..20: mol_type = other DNA
caaaaattagccaggcgtgg

SEQ ID NO: 8743 - DNA, 20 bp, synthetic construct
  misc_feature 1..20: note = CRISPR gRNA sequence
  source 1..20: mol_type = other DNA
gtggcgaacacctgtaatcc

SEQ ID NO: 8744 - DNA, 20 bp, synthetic construct
  misc_feature 1..20: note = CRISPR gRNA sequence
  source 1..20: mol_type = other DNA
acacctgtaatcccagctac

SEQ ID NO: 8745 - DNA, 20 bp, synthetic construct
  misc_feature 1..20: note = CRISPR gRNA sequence
  source 1..20: mol_type = other DNA
cacctgtaatcccagctacc

SEQ ID NO: 8746 - DNA, 20 bp, synthetic construct
  misc_feature 1..20: note = CRISPR gRNA sequence
  source 1..20: mol_type = other DNA
acctgtaatcccagctacca

SEQ ID NO: 8747 - DNA, 20 bp, synthetic construct
  misc_feature 1..20: note = CRISPR gRNA sequence
  source 1..20: mol_type = other DNA
ctgtaatcccagctaccagg

SEQ ID NO: 8748 - DNA, 20 bp, synthetic construct
  misc_feature 1..20: note = CRISPR gRNA sequence
  source 1..20: mol_type = other DNA
tgtaatcccagctaccaggg

SEQ ID NO: 8749 - DNA, 20 bp, synthetic construct
  misc_feature 1..20: note = CRISPR gRNA sequence
  source 1..20: mol_type = other DNA
atcccagctaccagggaggc

SEQ ID NO: 8750 - DNA, 20 bp, synthetic construct
  misc_feature 1..20: note = CRISPR gRNA sequence
  source 1..20: mol_type = other DNA
tcccagctaccagggaggct

SEQ ID NO: 8751 - DNA, 20 bp, synthetic construct
  misc_feature 1..20: note = CRISPR gRNA sequence
  source 1..20: mol_type = other DNA
cccagctaccagggaggcta

SEQ ID NO: 8752 - DNA, 20 bp, synthetic construct
  misc_feature 1..20: note = CRISPR gRNA sequence
  source 1..20: mol_type = other DNA
agctaccagggaggctaggg

SEQ ID NO: 8753 - DNA, 20 bp, synthetic construct
  misc_feature 1..20: note = CRISPR gRNA sequence
  source 1..20: mol_type = other DNA
gctaccagggaggctagggt

SEQ ID NO: 8754 - DNA, 20 bp, synthetic construct
  misc_feature 1..20: note = CRISPR gRNA sequence
  source 1..20: mol_type = other DNA
taccagggaggctagggtgg

SEQ ID NO: 8755 - DNA, 20 bp, synthetic construct
  misc_feature 1..20: note = CRISPR gRNA sequence
  source 1..20: mol_type = other DNA
tgggagaatcgcttgaacct

SEQ ID NO: 8756 - DNA, 20 bp, synthetic construct
  misc_feature 1..20: note = CRISPR gRNA sequence
  source 1..20: mol_type = other DNA
gagaatcgcttgaacctaag

SEQ ID NO: 8757 - DNA, 20 bp, synthetic construct
  misc_feature 1..20: note = CRISPR gRNA sequence
  source 1..20: mol_type = other DNA
aatcgcttgaacctaagaag

SEQ ID NO: 8758 - DNA, 20 bp, synthetic construct
  misc_feature 1..20: note = CRISPR gRNA sequence
  source 1..20: mol_type = other DNA
tcgcttgaacctaagaagca

SEQ ID NO: 8759 - DNA, 20 bp, synthetic construct
  misc_feature 1..20: note = CRISPR gRNA sequence
  source 1..20: mol_type = other DNA
cgcttgaacctaagaagcag

SEQ ID NO: 8760 - DNA, 20 bp, synthetic construct
  misc_feature 1..20: note = CRISPR gRNA sequence
  source 1..20: mol_type = other DNA
aacctaagaagcagaggttg

SEQ ID NO: 8761 - DNA, 20 bp, synthetic construct
  misc_feature 1..20: note = CRISPR gRNA sequence
  source 1..20: mol_type = other DNA
taagaagcagaggttgcagt

SEQ ID NO: 8762 - DNA, 20 bp, synthetic construct
  misc_feature 1..20: note = CRISPR gRNA sequence
  source 1..20: mol_type = other DNA
agcagaggttgcagtgagcc

SEQ ID NO: 8763 - DNA, 20 bp, synthetic construct
  misc_feature 1..20: note = CRISPR gRNA sequence
  source 1..20: mol_type = other DNA
gcagtgagccaagattgcgc

SEQ ID NO: 8764 - DNA, 20 bp, synthetic construct
  misc_feature 1..20: note = CRISPR gRNA sequence
  source 1..20: mol_type = other DNA
aagattgcgccagtgcactc

SEQ ID NO: 8765 - DNA, 20 bp, synthetic construct
  misc_feature 1..20: note = CRISPR gRNA sequence
  source 1..20: mol_type = other DNA
tgcgccagtgcactccagcc

SEQ ID NO: 8766 - DNA, 20 bp, synthetic construct
  misc_feature 1..20: note = CRISPR gRNA sequence
  source 1..20: mol_type = other DNA
gcgccagtgcactccagcct

SEQ ID NO: 8767 - DNA, 20 bp, synthetic construct
  misc_feature 1..20: note = CRISPR gRNA sequence
  source 1..20: mol_type = other DNA
gtgcactccagcctgggcaa

SEQ ID NO: 8768 - DNA, 20 bp, synthetic construct
  misc_feature 1..20: note = CRISPR gRNA sequence
  source 1..20: mol_type = other DNA
gcactccagcctgggcaaca

SEQ ID NO: 8769 - DNA, 20 bp, synthetic construct
  misc_feature 1..20: note = CRISPR gRNA sequence
  source 1..20: mol_type = other DNA
tccagcctgggcaacagagc

SEQ ID NO: 8770 - DNA, 20 bp, synthetic construct
  misc_feature 1..20: note = CRISPR gRNA sequence
  source 1..20: mol_type = other DNA
aaaaaaaaaaaaatgttttc

SEQ ID NO: 8771 - DNA, 20 bp, synthetic construct
  misc_feature 1..20: note = CRISPR gRNA sequence
  source 1..20: mol_type = other DNA
atgttttcaagatacaataa

SEQ ID NO: 8772 - DNA, 20 bp, synthetic construct
  misc_feature 1..20: note = CRISPR gRNA sequence
  source 1..20: mol_type = other DNA
tcaagatacaataaaagtga

SEQ ID NO: 8773 - DNA, 20 bp, synthetic construct
  misc_feature 1..20: note = CRISPR gRNA sequence
  source 1..20: mol_type = other DNA
atacaataaaagtgaaagaa

SEQ ID NO: 8774 - DNA, 20 bp, synthetic construct
  misc_feature 1..20: note = CRISPR gRNA sequence
  source 1..20: mol_type = other DNA
agtgaaagaatggtactatg

SEQ ID NO: 8775 - DNA, 20 bp, synthetic construct
  misc_feature 1..20: note = CRISPR gRNA sequence
  source 1..20: mol_type = other DNA
gtgaaagaatggtactatga

SEQ ID NO: 8776 - DNA, 20 bp, synthetic construct
  misc_feature 1..20: note = CRISPR gRNA sequence
  source 1..20: mol_type = other DNA
tttgattctacaattaatgt

SEQ ID NO: 8777 - DNA, 20 bp, synthetic construct
  misc_feature 1..20: note = CRISPR gRNA sequence
  source 1..20: mol_type = other DNA
ttgattctacaattaatgtt

SEQ ID NO: 8778 - DNA, 20 bp, synthetic construct
  misc_feature 1..20: note = CRISPR gRNA sequence
  source 1..20: mol_type = other DNA
acacccattcattatatttt

SEQ ID NO: 8779 - DNA, 20 bp, synthetic construct
  misc_feature 1..20: note = CRISPR gRNA sequence
  source 1..20: mol_type = other DNA
tacatttcaaatgtaaattg

SEQ ID NO: 8780 - DNA, 20 bp, synthetic construct
  misc_feature 1..20: note = CRISPR gRNA sequence
  source 1..20: mol_type = other DNA
tacactcccctcgtgtactt

SEQ ID NO: 8781 - DNA, 20 bp, synthetic construct
  misc_feature 1..20: note = CRISPR gRNA sequence
  source 1..20: mol_type = other DNA
acttcagcatcctttctttt

SEQ ID NO: 8782 - DNA, 20 bp, synthetic construct
  misc_feature 1..20: note = CRISPR gRNA sequence
  source 1..20: mol_type = other DNA
cttcagcatcctttctttta

SEQ ID NO: 8783 - DNA, 20 bp, synthetic construct
  misc_feature 1..20: note = CRISPR gRNA sequence
  source 1..20: mol_type = other DNA
tcctttcttttaaggccatg

SEQ ID NO: 8784 - DNA, 20 bp, synthetic construct
  misc_feature 1..20: note = CRISPR gRNA sequence
  source 1..20: mol_type = other DNA
aaggccatgcagtgtttcgt

SEQ ID NO: 8785 - DNA, 20 bp, synthetic construct
  misc_feature 1..20: note = CRISPR gRNA sequence
  source 1..20: mol_type = other DNA
aggccatgcagtgtttcgtt

SEQ ID NO: 8786 - DNA, 20 bp, synthetic construct
  misc_feature 1..20: note = CRISPR gRNA sequence
  source 1..20: mol_type = other DNA
ccatgcagtgtttcgttggg

SEQ ID NO: 8787 - DNA, 20 bp, synthetic construct
  misc_feature 1..20: note = CRISPR gRNA sequence
  source 1..20: mol_type = other DNA
agatgaaccataatttgttt

SEQ ID NO: 8788 - DNA, 20 bp, synthetic construct
  misc_feature 1..20: note = CRISPR gRNA sequence
  source 1..20: mol_type = other DNA
tgaaccataatttgtttaag

SEQ ID NO: 8789 - DNA, 20 bp, synthetic construct
  misc_feature 1..20: note = CRISPR gRNA sequence
  source 1..20: mol_type = other DNA
tgtttaagcagtcccttgct

SEQ ID NO: 8790 - DNA, 20 bp, synthetic construct
  misc_feature 1..20: note = CRISPR gRNA sequence
  source 1..20: mol_type = other DNA
gtttaagcagtcccttgcta

SEQ ID NO: 8791 - DNA, 20 bp, synthetic construct
  misc_feature 1..20: note = CRISPR gRNA sequence
  source 1..20: mol_type = other DNA
tttaagcagtcccttgctaa

SEQ ID NO: 8792 - DNA, 20 bp, synthetic construct
  misc_feature 1..20: note = CRISPR gRNA sequence
  source 1..20: mol_type = other DNA
gtcccttgctaagggacacg

SEQ ID NO: 8793 - DNA, 20 bp, synthetic construct
  misc_feature 1..20: note = CRISPR gRNA sequence
  source 1..20: mol_type = other DNA
tcccttgctaagggacacgt

SEQ ID NO: 8794 - DNA, 20 bp, synthetic construct
  misc_feature 1..20: note = CRISPR gRNA sequence
  source 1..20: mol_type = other DNA
ggtttttaatctgttgctgt

SEQ ID NO: 8795 - DNA, 20 bp, synthetic construct
  misc_feature 1..20: note = CRISPR gRNA sequence
  source 1..20: mol_type = other DNA
gatactcactcactgatttc

SEQ ID NO: 8796 - DNA, 20 bp, synthetic construct
  misc_feature 1..20: note = CRISPR gRNA sequence
  source 1..20: mol_type = other DNA
tctggcatactcctgcaatg

SEQ ID NO: 8797 - DNA, 20 bp, synthetic construct
  misc_feature 1..20: note = CRISPR gRNA sequence
  source 1..20: mol_type = other DNA
ctggcatactcctgcaatgt

SEQ ID NO: 8798 - DNA, 20 bp, synthetic construct
  misc_feature 1..20: note = CRISPR gRNA sequence
  source 1..20: mol_type = other DNA
gaaccaccacccccatttca

SEQ ID NO: 8799 - DNA, 20 bp, synthetic construct
  misc_feature 1..20: note = CRISPR gRNA sequence
  source 1..20: mol_type = other DNA
cacccccatttcatagatgt

SEQ ID NO: 8800 - DNA, 20 bp, synthetic construct
  misc_feature 1..20: note = CRISPR gRNA sequence
  source 1..20: mol_type = other DNA
atttcatagatgtgagatca

SEQ ID NO: 8801 - DNA, 20 bp, synthetic construct
  misc_feature 1..20: note = CRISPR gRNA sequence
  source 1..20: mol_type = other DNA
tttcatagatgtgagatcaa

SEQ ID NO: 8802 - DNA, 20 bp, synthetic construct
  misc_feature 1..20: note = CRISPR gRNA sequence
  source 1..20: mol_type = other DNA
tagatgtgagatcaaaggtt

SEQ ID NO: 8803 - DNA, 20 bp, synthetic construct
  misc_feature 1..20: note = CRISPR gRNA sequence
  source 1..20: mol_type = other DNA
gatgtgagatcaaaggttca

SEQ ID NO: 8804 - DNA, 20 bp, synthetic construct
  misc_feature 1..20: note = CRISPR gRNA sequence
  source 1..20: mol_type = other DNA
gtgagatcaaaggttcagag

SEQ ID NO: 8805 - DNA, 20 bp, synthetic construct
  misc_feature 1..20: note = CRISPR gRNA sequence
  source 1..20: mol_type = other DNA
ttcagagaagctgcattgca

SEQ ID NO: 8806 - DNA, 20 bp, synthetic construct
  misc_feature 1..20: note = CRISPR gRNA sequence
  source 1..20: mol_type = other DNA
tcagagaagctgcattgcaa

SEQ ID NO: 8807 - DNA, 20 bp, synthetic construct
  misc_feature 1..20: note = CRISPR gRNA sequence
  source 1..20: mol_type = other DNA
agctgcattgcaaaggcaca

SEQ ID NO: 8808 - DNA, 20 bp, synthetic construct
  misc_feature 1..20: note = CRISPR gRNA sequence
  source 1..20: mol_type = other DNA
gcattgcaaaggcacacagc

SEQ ID NO: 8809 - DNA, 20 bp, synthetic construct
  misc_feature 1..20: note = CRISPR gRNA sequence
  source 1..20: mol_type = other DNA
cattgcaaaggcacacagct

SEQ ID NO: 8810 - DNA, 20 bp, synthetic construct
  misc_feature 1..20: note = CRISPR gRNA sequence
  source 1..20: mol_type = other DNA
tgcaaaggcacacagctagg

SEQ ID NO: 8811 - DNA, 20 bp, synthetic construct
  misc_feature 1..20: note = CRISPR gRNA sequence
  source 1..20: mol_type = other DNA
aaaggcacacagctaggaag

SEQ ID NO: 8812 - DNA, 20 bp, synthetic construct
  misc_feature 1..20: note = CRISPR gRNA sequence
  source 1..20: mol_type = other DNA
acagctaggaagcggttcaa

SEQ ID NO: 8813 - DNA, 20 bp, synthetic construct
  misc_feature 1..20: note = CRISPR gRNA sequence
  source 1..20: mol_type = other DNA
gctaggaagcggttcaaaag

SEQ ID NO: 8814 - DNA, 20 bp, synthetic construct
  misc_feature 1..20: note = CRISPR gRNA sequence
  source 1..20: mol_type = other DNA
ctaggaagcggttcaaaagc

SEQ ID NO: 8815 - DNA, 20 bp, synthetic construct
  misc_feature 1..20: note = CRISPR gRNA sequence
  source 1..20: mol_type = other DNA
ttttgttttgttttgttttt

SEQ ID NO: 8816 - DNA, 20 bp, synthetic construct
  misc_feature 1..20: note = CRISPR gRNA sequence
  source 1..20: mol_type = other DNA
ttgtgtccccatttgtgact

SEQ ID NO: 8817 - DNA, 20 bp, synthetic construct
  misc_feature 1..20: note = CRISPR gRNA sequence
  source 1..20: mol_type = other DNA
tcttctgctgctacactgcc

SEQ ID NO: 8818 - DNA, 20 bp, synthetic construct
  misc_feature 1..20: note = CRISPR gRNA sequence
  source 1..20: mol_type = other DNA
tgctgctacactgcctggta

SEQ ID NO: 8819 - DNA, 20 bp, synthetic construct
  misc_feature 1..20: note = CRISPR gRNA sequence
  source 1..20: mol_type = other DNA
tacactgcctggtatggttt

SEQ ID NO: 8820 - DNA, 20 bp, synthetic construct
  misc_feature 1..20: note = CRISPR gRNA sequence
  source 1..20: mol_type = other DNA
ctgcctggtatggtttgaga

SEQ ID NO: 8821 - DNA, 20 bp, synthetic construct
  misc_feature 1..20: note = CRISPR gRNA sequence
  source 1..20: mol_type = other DNA
tgcctggtatggtttgagat

SEQ ID NO: 8822 - DNA, 20 bp, synthetic construct
  misc_feature 1..20: note = CRISPR gRNA sequence
  source 1..20: mol_type = other DNA
gcctggtatggtttgagatg

SEQ ID NO: 8823 - DNA, 20 bp, synthetic construct
  misc_feature 1..20: note = CRISPR gRNA sequence
  source 1..20: mol_type = other DNA
gtatggtttgagatggggtt

SEQ ID NO: 8824 - DNA, 20 bp, synthetic construct
  misc_feature 1..20: note = CRISPR gRNA sequence
  source 1..20: mol_type = other DNA
tatggtttgagatggggttt

SEQ ID NO: 8825 - DNA, 20 bp, synthetic construct
  misc_feature 1..20: note = CRISPR gRNA sequence
  source 1..20: mol_type = other DNA
ttgagatggggtttgggttc

SEQ ID NO: 8826 - DNA, 20 bp, synthetic construct
  misc_feature 1..20: note = CRISPR gRNA sequence
  source 1..20: mol_type = other DNA
atggggtttgggttcaagcc

SEQ ID NO: 8827 - DNA, 20 bp, synthetic construct
  misc_feature 1..20: note = CRISPR gRNA sequence
  source 1..20: mol_type = other DNA
tggggtttgggttcaagcca

SEQ ID NO: 8828 - DNA, 20 bp, synthetic construct
  misc_feature 1..20: note = CRISPR gRNA sequence
  source 1..20: mol_type = other DNA
gggtttgggttcaagccaag

SEQ ID NO: 8829 - DNA, 20 bp, synthetic construct
  misc_feature 1..20: note = CRISPR gRNA sequence
  source 1..20: mol_type = other DNA
ttgggttcaagccaaggagc

SEQ ID NO: 8830 - DNA, 20 bp, synthetic construct
  misc_feature 1..20: note = CRISPR gRNA sequence
  source 1..20: mol_type = other DNA
tgggttcaagccaaggagct

SEQ ID NO: 8831 - DNA, 20 bp, synthetic construct
  misc_feature 1..20: note = CRISPR gRNA sequence
  source 1..20: mol_type = other DNA
gggttcaagccaaggagctg

SEQ ID NO: 8832 - DNA, 20 bp, synthetic construct
  misc_feature 1..20: note = CRISPR gRNA sequence
  source 1..20: mol_type = other DNA
tcaagccaaggagctggggt

SEQ ID NO: 8833 - DNA, 20 bp, synthetic construct
  misc_feature 1..20: note = CRISPR gRNA sequence
  source 1..20: mol_type = other DNA
aggagctggggttggaatgt

SEQ ID NO: 8834 - DNA, 20 bp, synthetic construct
  misc_feature 1..20: note = CRISPR gRNA sequence
  source 1..20: mol_type = other DNA
gagctggggttggaatgtta

SEQ ID NO: 8835 - DNA, 20 bp, synthetic construct
  misc_feature 1..20: note = CRISPR gRNA sequence
  source 1..20: mol_type = other DNA
tggggttggaatgttagagc

SEQ ID NO: 8836 - DNA, 20 bp, synthetic construct
  misc_feature 1..20: note = CRISPR gRNA sequence
  source 1..20: mol_type = other DNA
ggggttggaatgttagagcg

SEQ ID NO: 8837 - DNA, 20 bp, synthetic construct
  misc_feature 1..20: note = CRISPR gRNA sequence
  source 1..20: mol_type = other DNA
gggttggaatgttagagcga

SEQ ID NO: 8838 - DNA, 20 bp, synthetic construct
  misc_feature 1..20: note = CRISPR gRNA sequence
  source 1..20: mol_type = other DNA
ggttggaatgttagagcgag

SEQ ID NO: 8839 - DNA, 20 bp, synthetic construct
  misc_feature 1..20: note = CRISPR gRNA sequence
  source 1..20: mol_type = other DNA
ttggaatgttagagcgaggg

SEQ ID NO: 8840 - DNA, 20 bp, synthetic construct
  misc_feature 1..20: note = CRISPR gRNA sequence
  source 1..20: mol_type = other DNA
tggaatgttagagcgagggg

SEQ ID NO: 8841 - DNA, 20 bp, synthetic construct
  misc_feature 1..20: note = CRISPR gRNA sequence
  source 1..20: mol_type = other DNA
ttagagcgaggggaggaaaa

SEQ ID NO: 8842 - DNA, 20 bp, synthetic construct
  misc_feature 1..20: note = CRISPR gRNA sequence
  source 1..20: mol_type = other DNA
ggggaggaaaatggaccccc

SEQ ID NO: 8843 - DNA, 20 bp, synthetic construct
  misc_feature 1..20: note = CRISPR gRNA sequence
  source 1..20: mol_type = other DNA
ggacccccaagaccactacc

SEQ ID NO: 8844 - DNA, 20 bp, synthetic construct
  misc_feature 1..20: note = CRISPR gRNA sequence
  source 1..20: mol_type = other DNA
aagaccactacccagccttg

SEQ ID NO: 8845 - DNA, 20 bp, synthetic construct
  misc_feature 1..20: note = CRISPR gRNA sequence
  source 1..20: mol_type = other DNA
cactacccagccttgaagtt

SEQ ID NO: 8846 - DNA, 20 bp, synthetic construct
  misc_feature 1..20: note = CRISPR gRNA sequence
  source 1..20: mol_type = other DNA
actacccagccttgaagtta

SEQ ID NO: 8847 - DNA, 20 bp, synthetic construct
  misc_feature 1..20: note = CRISPR gRNA sequence
  source 1..20: mol_type = other DNA
gccttgaagttaaggccgta

SEQ ID NO: 8848 - DNA, 20 bp, synthetic construct
  misc_feature 1..20: note = CRISPR gRNA sequence
  source 1..20: mol_type = other DNA
gttaaggccgtatagcctgc

SEQ ID NO: 8849 - DNA, 20 bp, synthetic construct
  misc_feature 1..20: note = CRISPR gRNA sequence
  source 1..20: mol_type = other DNA
taaggccgtatagcctgcta

SEQ ID NO: 8850 - DNA, 20 bp, synthetic construct
  misc_feature 1..20: note = CRISPR gRNA sequence
  source 1..20: mol_type = other DNA
gtatagcctgctagagtcct

SEQ ID NO: 8851 - DNA, 20 bp, synthetic construct
  misc_feature 1..20: note = CRISPR gRNA sequence
  source 1..20: mol_type = other DNA
ctagagtcctgagccccttc

SEQ ID NO: 8852 - DNA, 20 bp, synthetic construct
  misc_feature 1..20: note = CRISPR gRNA sequence
  source 1..20: mol_type = other DNA
gtcctgagccccttctggct

SEQ ID NO: 8853 - DNA, 20 bp, synthetic construct
  misc_feature 1..20: note = CRISPR gRNA sequence
  source 1..20: mol_type = other DNA
tcctgagccccttctggctt

SEQ ID NO: 8854 - DNA, 20 bp, synthetic construct
  misc_feature 1..20: note = CRISPR gRNA sequence
  source 1..20: mol_type = other DNA
ggcttgggacatcctctccc

SEQ ID NO: 8855 - DNA, 20 bp, synthetic construct
  misc_feature 1..20: note = CRISPR gRNA sequence
  source 1..20: mol_type = other DNA
gcttgggacatcctctccct

SEQ ID NO: 8856 - DNA, 20 bp, synthetic construct
  misc_feature 1..20: note = CRISPR gRNA sequence
  source 1..20: mol_type = other DNA
cttgggacatcctctccctg

SEQ ID NO: 8857 - DNA, 20 bp, synthetic construct
  misc_feature 1..20: note = CRISPR gRNA sequence
  source 1..20: mol_type = other DNA
gggacatcctctccctgggg

SEQ ID NO: 8858 - DNA, 20 bp, synthetic construct
  misc_feature 1..20: note = CRISPR gRNA sequence
  source 1..20: mol_type = other DNA
ctgatcacatgttttctctg

SEQ ID NO: 8859 - DNA, 20 bp, synthetic construct
  misc_feature 1..20: note = CRISPR gRNA sequence
  source 1..20: mol_type = other DNA
tgttttctctgcagccttcc

SEQ ID NO: 8860 - DNA, 20 bp, synthetic construct
  misc_feature 1..20: note = CRISPR gRNA sequence
  source 1..20: mol_type = other DNA
ttttctctgcagccttccca

SEQ ID NO: 8861 - DNA, 20 bp, synthetic construct
  misc_feature 1..20: note = CRISPR gRNA sequence
  source 1..20: mol_type = other DNA
tttctctgcagccttcccag

SEQ ID NO: 8862 - DNA, 20 bp, synthetic construct
  misc_feature 1..20: note = CRISPR gRNA sequence
  source 1..20: mol_type = other DNA
tctctgcagccttcccagag

SEQ ID NO: 8863 - DNA, 20 bp, synthetic construct
  misc_feature 1..20: note = CRISPR gRNA sequence
  source 1..20: mol_type = other DNA
agccttcccagaggagcttc

SEQ ID NO: 8864 - DNA, 20 bp, synthetic construct
  misc_feature 1..20: note = CRISPR gRNA sequence
  source 1..20: mol_type = other DNA
cttcccagaggagcttccgg

SEQ ID NO: 8865 - DNA, 20 bp, synthetic construct
  misc_feature 1..20: note = CRISPR gRNA sequence
  source 1..20: mol_type = other DNA
aggagcttccggcagacctg

SEQ ID NO: 8866 - DNA, 20 bp, synthetic construct
  misc_feature 1..20: note = CRISPR gRNA sequence
  source 1..20: mol_type = other DNA
ttccggcagacctgaagcac

SEQ ID NO: 8867 - DNA, 20 bp, synthetic construct
  misc_feature 1..20: note = CRISPR gRNA sequence
  source 1..20: mol_type = other DNA
cggcagacctgaagcactgg

SEQ ID NO: 8868 - DNA, 20 bp, synthetic construct
  misc_feature 1..20: note = CRISPR gRNA sequence
  source 1..20: mol_type = other DNA
agacctgaagcactggaagc

SEQ ID NO: 8869 - DNA, 20 bp, synthetic construct
  misc_feature 1..20: note = CRISPR gRNA sequence
  source 1..20: mol_type = other DNA
gacctgaagcactggaagcc

SEQ ID NO: 8870 - DNA, 20 bp, synthetic construct
  misc_feature 1..20: note = CRISPR gRNA sequence
  source 1..20: mol_type = other DNA
agcactggaagccaggtgtg

SEQ ID NO: 8871 - DNA, 20 bp, synthetic construct
  misc_feature 1..20: note = CRISPR gRNA sequence
  source 1..20: mol_type = other DNA
gcactggaagccaggtgtgc

SEQ ID NO: 8872 - DNA, 20 bp, synthetic construct
  misc_feature 1..20: note = CRISPR gRNA sequence
  source 1..20: mol_type = other DNA
cactggaagccaggtgtgca

SEQ ID NO: 8873 - DNA, 20 bp, synthetic construct
  misc_feature 1..20: note = CRISPR gRNA sequence
  source 1..20: mol_type = other DNA
tggaagccaggtgtgcaggg

SEQ ID NO: 8874 - DNA, 20 bp, synthetic construct
  misc_feature 1..20: note = CRISPR gRNA sequence
  source 1..20: mol_type = other DNA
ggaagccaggtgtgcagggc

SEQ ID NO: 8875 - DNA, 20 bp, synthetic construct
  misc_feature 1..20: note = CRISPR gRNA sequence
  source 1..20: mol_type = other DNA
agccaggtgtgcagggcagg

SEQ ID NO: 8876 - DNA, 20 bp, synthetic construct
  misc_feature 1..20: note = CRISPR gRNA sequence
  source 1..20: mol_type = other DNA
gccaggtgtgcagggcaggt

SEQ ID NO: 8877 - DNA, 20 bp, synthetic construct
  misc_feature 1..20: note = CRISPR gRNA sequence
  source 1..20: mol_type = other DNA
ggtgtgcagggcaggtgggc

SEQ ID NO: 8878 - DNA, 20 bp, synthetic construct
  misc_feature 1..20: note = CRISPR gRNA sequence
  source 1..20: mol_type = other DNA
gtgtgcagggcaggtgggct

SEQ ID NO: 8879 - DNA, 20 bp, synthetic construct
  misc_feature 1..20: note = CRISPR gRNA sequence
  source 1..20: mol_type = other DNA
tgtgcagggcaggtgggctg

SEQ ID NO: 8880 - DNA, 20 bp, synthetic construct
  misc_feature 1..20: note = CRISPR gRNA sequence
  source 1..20: mol_type = other DNA
cagggcaggtgggctggggt

SEQ ID NO: 8881 - DNA, 20 bp, synthetic construct
  misc_feature 1..20: note = CRISPR gRNA sequence
  source 1..20: mol_type = other DNA
agggcaggtgggctggggtt

SEQ ID NO: 8882 - DNA, 20 bp, synthetic construct
  misc_feature 1..20: note = CRISPR gRNA sequence
  source 1..20: mol_type = other DNA
gcaggtgggctggggttggg

SEQ ID NO: 8883 - DNA, 20 bp, synthetic construct
  misc_feature 1..20: note = CRISPR gRNA sequence
  source 1..20: mol_type = other DNA
caggtgggctggggttggga

SEQ ID NO: 8884 - DNA, 20 bp, synthetic construct
  misc_feature 1..20: note = CRISPR gRNA sequence
  source 1..20: mol_type = other DNA
aggtgggctggggttgggaa

SEQ ID NO: 8885 - DNA, 20 bp, synthetic construct
  misc_feature 1..20: note = CRISPR gRNA sequence
  source 1..20: mol_type = other DNA
tgggctggggttgggaaggg

SEQ ID NO: 8886 - DNA, 20 bp, synthetic construct
  misc_feature 1..20: note = CRISPR gRNA sequence
  source 1..20: mol_type = other DNA
gttgggaagggtggatgcct

SEQ ID NO: 8887 - DNA, 20 bp, synthetic construct
  misc_feature 1..20: note = CRISPR gRNA sequence
  source 1..20: mol_type = other DNA
ttgggaagggtggatgcctt

SEQ ID NO: 8888 - DNA, 20 bp, synthetic construct
  misc_feature 1..20: note = CRISPR gRNA sequence
  source 1..20: mol_type = other DNA
tgggaagggtggatgccttg

SEQ ID NO: 8889 - DNA, 20 bp, synthetic construct
  misc_feature 1..20: note = CRISPR gRNA sequence
  source 1..20: mol_type = other DNA
ggaagggtggatgccttggg

SEQ ID NO: 8890 - DNA, 20 bp, synthetic construct
  misc_feature 1..20: note = CRISPR gRNA sequence
  source 1..20: mol_type = other DNA
gaagggtggatgccttgggg

SEQ ID NO: 8891 - DNA, 20 bp, synthetic construct
  misc_feature 1..20: note = CRISPR gRNA sequence
  source 1..20: mol_type = other DNA
aagggtggatgccttgggga

SEQ ID NO: 8892 - DNA, 20 bp, synthetic construct
  misc_feature 1..20: note = CRISPR gRNA sequence
  source 1..20: mol_type = other DNA
agggtggatgccttggggag

SEQ ID NO: 8893 - DNA, 20 bp, synthetic construct
  misc_feature 1..20: note = CRISPR gRNA sequence
  source 1..20: mol_type = other DNA
tggatgccttggggagggga

SEQ ID NO: 8894 - DNA, 20 bp, synthetic construct
  misc_feature 1..20: note = CRISPR gRNA sequence
  source 1..20: mol_type = other DNA
atgccttggggaggggatgg

SEQ ID NO: 8895 - DNA, 20 bp, synthetic construct
  misc_feature 1..20: note = CRISPR gRNA sequence
  source 1..20: mol_type = other DNA
gccttggggaggggatggaa

SEQ ID NO: 8896 - DNA, 20 bp, synthetic construct
  misc_feature 1..20: note = CRISPR gRNA sequence
  source 1..20: mol_type = other DNA
gatggaagagattgaactcc

SEQ ID NO: 8897 - DNA, 20 bp, synthetic construct
  misc_feature 1..20: note = CRISPR gRNA sequence
  source 1..20: mol_type = other DNA
agagattgaactcctggccc

SEQ ID NO: 8898 - DNA, 20 bp, synthetic construct
  misc_feature 1..20: note = CRISPR gRNA sequence
  source 1..20: mol_type = other DNA
aactcctggcccaagtctga

SEQ ID NO: 8899 - DNA, 20 bp, synthetic construct
  misc_feature 1..20: note = CRISPR gRNA sequence
  source 1..20: mol_type = other DNA
actcctggcccaagtctgat

SEQ ID NO: 8900 - DNA, 20 bp, synthetic construct
  misc_feature 1..20: note = CRISPR gRNA sequence
  source 1..20: mol_type = other DNA
ctcctggcccaagtctgatg

SEQ ID NO: 8901 - DNA, 20 bp, synthetic construct
  misc_feature 1..20: note = CRISPR gRNA sequence
  source 1..20: mol_type = other DNA
tggcccaagtctgatgggga

SEQ ID NO: 8902 - DNA, 20 bp, synthetic construct
  misc_feature 1..20: note = CRISPR gRNA sequence
  source 1..20: mol_type = other DNA
agtctgatggggatggtgca

SEQ ID NO: 8903 - DNA, 20 bp, synthetic construct
  misc_feature 1..20: note = CRISPR gRNA sequence
  source 1..20: mol_type = other DNA
gatggggatggtgcatggtg

SEQ ID NO: 8904 - DNA, 20 bp, synthetic construct
  misc_feature 1..20: note = CRISPR gRNA sequence
  source 1..20: mol_type = other DNA
gtgcagcccctgcccttctt

SEQ ID NO: 8905 - DNA, 20 bp, synthetic construct
  misc_feature 1..20: note = CRISPR gRNA sequence
  source 1..20: mol_type = other DNA
tgcagcccctgcccttcttt

SEQ ID NO: 8906 - DNA, 20 bp, synthetic construct
  misc_feature 1..20: note = CRISPR gRNA sequence
  source 1..20: mol_type = other DNA
agcccctgcccttctttggg

SEQ ID NO: 8907 - DNA, 20 bp, synthetic construct
  misc_feature 1..20: note = CRISPR gRNA sequence
  source 1..20: mol_type = other DNA
cccctgcccttctttgggta

SEQ ID NO: 8908 - DNA, 20 bp, synthetic construct
  misc_feature 1..20: note = CRISPR gRNA sequence
  source 1..20: mol_type = other DNA
ccctgcccttctttgggtag

SEQ ID NO: 8909 - DNA, 20 bp, synthetic construct
  misc_feature 1..20: note = CRISPR gRNA sequence
  source 1..20: mol_type = other DNA
cccttctttgggtagaggct

SEQ ID NO: 8910 - DNA, 20 bp, synthetic construct
  misc_feature 1..20: note = CRISPR gRNA sequence
  source 1..20: mol_type = other DNA
cttctttgggtagaggctga

SEQ ID NO: 8911 - DNA, 20 bp, synthetic construct
  misc_feature 1..20: note = CRISPR gRNA sequence
  source 1..20: mol_type = other DNA
ttgggtagaggctgagagct

SEQ ID NO: 8912 - DNA, 20 bp, synthetic construct
  misc_feature 1..20: note = CRISPR gRNA sequence
  source 1..20: mol_type = other DNA
tgggtagaggctgagagctt

SEQ ID NO: 8913 - DNA, 20 bp, synthetic construct
  misc_feature 1..20: note = CRISPR gRNA sequence
  source 1..20: mol_type = other DNA
gggtagaggctgagagcttg

SEQ ID NO: 8914 - DNA, 20 bp, synthetic construct
  misc_feature 1..20: note = CRISPR gRNA sequence
  source 1..20: mol_type = other DNA
gctgagagcttggggtccct

SEQ ID NO: 8915 - DNA, 20 bp, synthetic construct
  misc_feature 1..20: note = CRISPR gRNA sequence
  source 1..20: mol_type = other DNA
tgagagcttggggtccctta

SEQ ID NO: 8916 - DNA, 20 bp, synthetic construct
  misc_feature 1..20: note = CRISPR gRNA sequence
  source 1..20: mol_type = other DNA
ggggtcccttagagtcctct

SEQ ID NO: 8917 - DNA, 20 bp, synthetic construct
  misc_feature 1..20: note = CRISPR gRNA sequence
  source 1..20: mol_type = other DNA
gggtcccttagagtcctcta

SEQ ID NO: 8918 - DNA, 20 bp, synthetic construct
  misc_feature 1..20: note = CRISPR gRNA sequence
  source 1..20: mol_type = other DNA
ggtcccttagagtcctctaa

SEQ ID NO: 8919 - DNA, 20 bp, synthetic construct
  misc_feature 1..20: note = CRISPR gRNA sequence
  source 1..20: mol_type = other DNA
gtcccttagagtcctctaag

SEQ ID NO: 8920 - DNA, 20 bp, synthetic construct
  misc_feature 1..20: note = CRISPR gRNA sequence
  source 1..20: mol_type = other DNA
aaggggctcacgactgtttg

SEQ ID NO: 8921 - DNA, 20 bp, synthetic construct
  misc_feature 1..20: note = CRISPR gRNA sequence
  source 1..20: mol_type = other DNA
gggctcacgactgtttgtgg

SEQ ID NO: 8922 - DNA, 20 bp, synthetic construct
  misc_feature 1..20: note = CRISPR gRNA sequence
  source 1..20: mol_type = other DNA
ggctcacgactgtttgtgga

SEQ ID NO: 8923 - DNA, 20 bp, synthetic construct
  misc_feature 1..20: note = CRISPR gRNA sequence
  source 1..20: mol_type = other DNA
tcacgactgtttgtggaagg

SEQ ID NO: 8924 - DNA, 20 bp, synthetic construct
  misc_feature 1..20: note = CRISPR gRNA sequence
  source 1..20: mol_type = other DNA
cgactgtttgtggaaggtgg

SEQ ID NO: 8925 - DNA, 20 bp, synthetic construct
  misc_feature 1..20: note = CRISPR gRNA sequence
  source 1..20: mol_type = other DNA
gactgtttgtggaaggtggt

SEQ ID NO: 8926 - DNA, 20 bp, synthetic construct
  misc_feature 1..20: note = CRISPR gRNA sequence
  source 1..20: mol_type = other DNA
actgtttgtggaaggtggta

SEQ ID NO: 8927 - DNA, 20 bp, synthetic construct
  misc_feature 1..20: note = CRISPR gRNA sequence
  source 1..20: mol_type = other DNA
ctgtttgtggaaggtggtag

SEQ ID NO: 8928 - DNA, 20 bp, synthetic construct
  misc_feature 1..20: note = CRISPR gRNA sequence
  source 1..20: mol_type = other DNA
tgtggaaggtggtaggggct

SEQ ID NO: 8929 - DNA, 20 bp, synthetic construct
  misc_feature 1..20: note = CRISPR gRNA sequence
  source 1..20: mol_type = other DNA
tggaaggtggtaggggcttg

SEQ ID NO: 8930 - DNA, 20 bp, synthetic construct
  misc_feature 1..20: note = CRISPR gRNA sequence
  source 1..20: mol_type = other DNA
tggtaggggcttggagctaa

SEQ ID NO: 8931 - DNA, 20 bp, synthetic construct
  misc_feature 1..20: note = CRISPR gRNA sequence
  source 1..20: mol_type = other DNA
tggagctaacagattgttca

SEQ ID NO: 8932 - DNA, 20 bp, synthetic construct
  misc_feature 1..20: note = CRISPR gRNA sequence
  source 1..20: mol_type = other DNA
ggagctaacagattgttcat

SEQ ID NO: 8933 - DNA, 20 bp, synthetic construct
  misc_feature 1..20: note = CRISPR gRNA sequence
  source 1..20: mol_type = other DNA
tcataggttctattctgccc

SEQ ID NO: 8934 - DNA, 20 bp, synthetic construct
  misc_feature 1..20: note = CRISPR gRNA sequence
  source 1..20: mol_type = other DNA
ttctgccccagctctccgtg

SEQ ID NO: 8935 - DNA, 20 bp, synthetic construct
  misc_feature 1..20: note = CRISPR gRNA sequence
  source 1..20: mol_type = other DNA
ctgccccagctctccgtgtg

SEQ ID NO: 8936 - DNA, 20 bp, synthetic construct
  misc_feature 1..20: note = CRISPR gRNA sequence
  source 1..20: mol_type = other DNA
tgccccagctctccgtgtgg

SEQ ID NO: 8937 - DNA, 20 bp, synthetic construct
  misc_feature 1..20: note = CRISPR gRNA sequence
  source 1..20: mol_type = other DNA
agctctccgtgtggaggccc

SEQ ID NO: 8938 - DNA, 20 bp, synthetic construct
  misc_feature 1..20: note = CRISPR gRNA sequence
  source 1..20: mol_type = other DNA
gctctccgtgtggaggccct

SEQ ID NO: 8939 - DNA, 20 bp, synthetic construct
  misc_feature 1..20: note = CRISPR gRNA sequence
  source 1..20: mol_type = other DNA
ctctccgtgtggaggcccta

SEQ ID NO: 8940 - DNA, 20 bp, synthetic construct
  misc_feature 1..20: note = CRISPR gRNA sequence
  source 1..20: mol_type = other DNA
ggaggccctagggtcctgct

SEQ ID NO: 8941 - DNA, 20 bp, synthetic construct
  misc_feature 1..20: note = CRISPR gRNA sequence
  source 1..20: mol_type = other DNA
ccctagggtcctgctcagca

SEQ ID NO: 8942 - DNA, 20 bp, synthetic construct
  misc_feature 1..20: note = CRISPR gRNA sequence
  source 1..20: mol_type = other DNA
gtcctgctcagcatagctct

SEQ ID NO: 8943 - DNA, 20 bp, synthetic construct
  misc_feature 1..20: note = CRISPR gRNA sequence
  source 1..20: mol_type = other DNA
cctgctcagcatagctctca

SEQ ID NO: 8944 - DNA, 20 bp, synthetic construct
  misc_feature 1..20: note = CRISPR gRNA sequence
  source 1..20: mol_type = other DNA
tcagcatagctctcagagcc

SEQ ID NO: 8945 - DNA, 20 bp, synthetic construct
  misc_feature 1..20: note = CRISPR gRNA sequence
  source 1..20: mol_type = other DNA
agctctcagagccaagtcac

SEQ ID NO: 8946 - DNA, 20 bp, synthetic construct
  misc_feature 1..20: note = CRISPR gRNA sequence
  source 1..20: mol_type = other DNA
gctctcagagccaagtcaca

SEQ ID NO: 8947 - DNA, 20 bp, synthetic construct
  misc_feature 1..20: note = CRISPR gRNA sequence
  source 1..20: mol_type = other DNA
tctcagagccaagtcacaag

SEQ ID NO: 8948 - DNA, 20 bp, synthetic construct
  misc_feature 1..20: note = CRISPR gRNA sequence
  source 1..20: mol_type = other DNA
tcagagccaagtcacaagga

SEQ ID NO: 8949 - DNA, 20 bp, synthetic construct
  misc_feature 1..20: note = CRISPR gRNA sequence
  source 1..20: mol_type = other DNA
cagagccaagtcacaaggag

SEQ ID NO: 8950 - DNA, 20 bp, synthetic construct
  misc_feature 1..20: note = CRISPR gRNA sequence
  source 1..20: mol_type = other DNA
ccaagtcacaaggagaggac

SEQ ID NO: 8951 - DNA, 20 bp, synthetic construct
  misc_feature 1..20: note = CRISPR gRNA sequence
  source 1..20: mol_type = other DNA
caagtcacaaggagaggact

SEQ ID NO: 8952 - DNA, 20 bp, synthetic construct
  misc_feature 1..20: note = CRISPR gRNA sequence
  source 1..20: mol_type = other DNA
aagtcacaaggagaggactg

SEQ ID NO: 8953 - DNA, 20 bp, synthetic construct
  misc_feature 1..20: note = CRISPR gRNA sequence
  source 1..20: mol_type = other DNA
agtcacaaggagaggactgg

SEQ ID NO: 8954 - DNA, 20 bp, synthetic construct
  misc_feature 1..20: note = CRISPR gRNA sequence
  source 1..20: mol_type = other DNA
gagaggactgggggactgcc

SEQ ID NO: 8955 - DNA, 20 bp, synthetic construct
  misc_feature 1..20: note = CRISPR gRNA sequence
  source 1..20: mol_type = other DNA
gactgggggactgcctggca

SEQ ID NO: 8956 - DNA, 20 bp, synthetic construct
  misc_feature 1..20: note = CRISPR gRNA sequence
  source 1..20: mol_type = other DNA
ctgggggactgcctggcaca

SEQ ID NO: 8957 - DNA, 20 bp, synthetic construct
  misc_feature 1..20: note = CRISPR gRNA sequence
  source 1..20: mol_type = other DNA
ggggactgcctggcacagag

SEQ ID NO: 8958 - DNA, 20 bp, synthetic construct
  misc_feature 1..20: note = CRISPR gRNA sequence
  source 1..20: mol_type = other DNA
agagcagttgctgatcaaca

SEQ ID NO: 8959 - DNA, 20 bp, synthetic construct
  misc_feature 1..20: note = CRISPR gRNA sequence
  source 1..20: mol_type = other DNA
gttgctgatcaacacagctg

SEQ ID NO: 8960 - DNA, 20 bp, synthetic construct
  misc_feature 1..20: note = CRISPR gRNA sequence
  source 1..20: mol_type = other DNA
ctgatcaacacagctgcagc

SEQ ID NO: 8961 - DNA, 20 bp, synthetic construct
  misc_feature 1..20: note = CRISPR gRNA sequence
  source 1..20: mol_type = other DNA
tgatcaacacagctgcagcc

SEQ ID NO: 8962 - DNA, 20 bp, synthetic construct
  misc_feature 1..20: note = CRISPR gRNA sequence
  source 1..20: mol_type = other DNA
gatcaacacagctgcagcca

SEQ ID NO: 8963 - DNA, 20 bp, synthetic construct
  misc_feature 1..20: note = CRISPR gRNA sequence
  source 1..20: mol_type = other DNA
acacagctgcagccagggct

SEQ ID NO: 8964 - DNA, 20 bp, synthetic construct
  misc_feature 1..20: note = CRISPR gRNA sequence
  source 1..20: mol_type = other DNA
cagctgcagccagggctgag

SEQ ID NO: 8965 - DNA, 20 bp, synthetic construct
  misc_feature 1..20: note = CRISPR gRNA sequence
  source 1..20: mol_type = other DNA
gccagggctgagaagatgac

SEQ ID NO: 8966 - DNA, 20 bp, synthetic construct
  misc_feature 1..20: note = CRISPR gRNA sequence
  source 1..20: mol_type = other DNA
atgacaagcatttcctctgt

SEQ ID NO: 8967 - DNA, 20 bp, synthetic construct
  misc_feature 1..20: note = CRISPR gRNA sequence
  source 1..20: mol_type = other DNA
tgacaagcatttcctctgtc

SEQ ID NO: 8968 - DNA, 20 bp, synthetic construct
  misc_feature 1..20: note = CRISPR gRNA sequence
  source 1..20: mol_type = other DNA
acaagcatttcctctgtcag

SEQ ID NO: 8969 - DNA, 20 bp, synthetic construct
  misc_feature 1..20: note = CRISPR gRNA sequence
  source 1..20: mol_type = other DNA
aagcatttcctctgtcagga

SEQ ID NO: 8970 - DNA, 20 bp, synthetic construct
  misc_feature 1..20: note = CRISPR gRNA sequence
  source 1..20: mol_type = other DNA
gagagacatccatgccactc

SEQ ID NO: 8971 - DNA, 20 bp, synthetic construct
  misc_feature 1..20: note = CRISPR gRNA sequence
  source 1..20: mol_type = other DNA
agagacatccatgccactcc

SEQ ID NO: 8972 - DNA, 20 bp, synthetic construct
  misc_feature 1..20: note = CRISPR gRNA sequence
  source 1..20: mol_type = other DNA
gagacatccatgccactcca

SEQ ID NO: 8973 - DNA, 20 bp, synthetic construct
  misc_feature 1..20: note = CRISPR gRNA sequence
  source 1..20: mol_type = other DNA
ctccagggccctccccatcc

SEQ ID NO: 8974 - DNA, 20 bp, synthetic construct
  misc_feature 1..20: note = CRISPR gRNA sequence
  source 1..20: mol_type = other DNA
tccagggccctccccatccc

SEQ ID NO: 8975 - DNA, 20 bp, synthetic construct
  misc_feature 1..20: note = CRISPR gRNA sequence
  source 1..20: mol_type = other DNA
agggccctccccatcccagg

SEQ ID NO: 8976 - DNA, 20 bp, synthetic construct
  misc_feature 1..20: note = CRISPR gRNA sequence
  source 1..20: mol_type = other DNA
gggccctccccatcccagga

SEQ ID NO: 8977 - DNA, 20 bp, synthetic construct
  misc_feature 1..20: note = CRISPR gRNA sequence
  source 1..20: mol_type = other DNA
catcccaggaaggcccctcc

SEQ ID NO: 8978 - DNA, 20 bp, synthetic construct
  misc_feature 1..20: note = CRISPR gRNA sequence
  source 1..20: mol_type = other DNA
ggaaggcccctccaagcacc

SEQ ID NO: 8979 - DNA, 20 bp, synthetic construct
  misc_feature 1..20: note = CRISPR gRNA sequence
  source 1..20: mol_type = other DNA
caagcacccagtctctaaca

SEQ ID NO: 8980 - DNA, 20 bp, synthetic construct
  misc_feature 1..20: note = CRISPR gRNA sequence
  source 1..20: mol_type = other DNA
taacacagcccacttcctca

SEQ ID NO: 8981 - DNA, 20 bp, synthetic construct
  misc_feature 1..20: note = CRISPR gRNA sequence
  source 1..20: mol_type = other DNA
cagcccacttcctcacagct

SEQ ID NO: 8982 - DNA, 20 bp, synthetic construct
  misc_feature 1..20: note = CRISPR gRNA sequence
  source 1..20: mol_type = other DNA
cacagctgagccccccactg

SEQ ID NO: 8983 - DNA, 20 bp, synthetic construct
  misc_feature 1..20: note = CRISPR gRNA sequence
  source 1..20: mol_type = other DNA
gagccccccactgtggtgac

SEQ ID NO: 8984 - DNA, 20 bp, synthetic construct
  misc_feature 1..20: note = CRISPR gRNA sequence
  source 1..20: mol_type = other DNA
ccccccactgtggtgactgg

SEQ ID NO: 8985 - DNA, 20 bp, synthetic construct
  misc_feature 1..20: note = CRISPR gRNA sequence
  source 1..20: mol_type = other DNA
tgtggtgactggcagtctcc

SEQ ID NO: 8986 - DNA, 20 bp, synthetic construct
  misc_feature 1..20: note = CRISPR gRNA sequence
  source 1..20: mol_type = other DNA
gtgactggcagtctcctagt

SEQ ID NO: 8987 - DNA, 20 bp, synthetic construct
  misc_feature 1..20: note = CRISPR gRNA sequence
  source 1..20: mol_type = other DNA
tggcagtctcctagtgagac

SEQ ID NO: 8988 - DNA, 20 bp, synthetic construct
  misc_feature 1..20: note = CRISPR gRNA sequence
  source 1..20: mol_type = other DNA
agtctcctagtgagaccagt

SEQ ID NO: 8989 - DNA, 20 bp, synthetic construct
  misc_feature 1..20: note = CRISPR gRNA sequence
  source 1..20: mol_type = other DNA
cactgcctgcgctgttcaac

SEQ ID NO: 8990 - DNA, 20 bp, synthetic construct
  misc_feature 1..20: note = CRISPR gRNA sequence
  source 1..20: mol_type = other DNA
actgcctgcgctgttcaacc

SEQ ID NO: 8991 - DNA, 20 bp, synthetic construct
  misc_feature 1..20: note = CRISPR gRNA sequence
  source 1..20: mol_type = other DNA
tgcctgcgctgttcaaccag

SEQ ID NO: 8992 - DNA, 20 bp, synthetic construct
  misc_feature 1..20: note = CRISPR gRNA sequence
  source 1..20: mol_type = other DNA
tgcgctgttcaaccaggagc

SEQ ID NO: 8993 - DNA, 20 bp, synthetic construct
  misc_feature 1..20: note = CRISPR gRNA sequence
  source 1..20: mol_type = other DNA
ttcaaccaggagccagcctc

SEQ ID NO: 8994 - DNA, 20 bp, synthetic construct
  misc_feature 1..20: note = CRISPR gRNA sequence
  source 1..20: mol_type = other DNA
accaggagccagcctccggc

SEQ ID NO: 8995 - DNA, 20 bp, synthetic construct
  misc_feature 1..20: note = CRISPR gRNA sequence
  source 1..20: mol_type = other DNA
agcctccggccagatgcgcc

SEQ ID NO: 8996 - DNA, 20 bp, synthetic construct
  misc_feature 1..20: note = CRISPR gRNA sequence
  source 1..20: mol_type = other DNA
cctccggccagatgcgcctg

SEQ ID NO: 8997 - DNA, 20 bp, synthetic construct
  misc_feature 1..20: note = CRISPR gRNA sequence
  source 1..20: mol_type = other DNA
tgcgcctggagaaaaccgac

SEQ ID NO: 8998 - DNA, 20 bp, synthetic construct
  misc_feature 1..20: note = CRISPR gRNA sequence
  source 1..20: mol_type = other DNA
gagaaaaccgaccagattcc

SEQ ID NO: 8999 - DNA, 20 bp, synthetic construct
  misc_feature 1..20: note = CRISPR gRNA sequence
  source 1..20: mol_type = other DNA
cgaccagattcccagtatgt

SEQ ID NO: 9000 - DNA, 20 bp, synthetic construct
  misc_feature 1..20: note = CRISPR gRNA sequence
  source 1..20: mol_type = other DNA
gaccagattcccagtatgtt

SEQ ID NO: 9001 - DNA, 20 bp, synthetic construct
  misc_feature 1..20: note = CRISPR gRNA sequence
  source 1..20: mol_type = other DNA
accagattcccagtatgtta

SEQ ID NO: 9002 - DNA, 20 bp, synthetic construct
  misc_feature 1..20: note = CRISPR gRNA sequence
  source 1..20: mol_type = other DNA
ccagattcccagtatgttag

SEQ ID NO: 9003 - DNA, 20 bp, synthetic construct
  misc_feature 1..20: note = CRISPR gRNA sequence
  source 1..20: mol_type = other DNA
cagattcccagtatgttagg

SEQ ID NO: 9004 - DNA, 20 bp, synthetic construct
  misc_feature 1..20: note = CRISPR gRNA sequence
  source 1..20: mol_type = other DNA
tcccagtatgttagggggct

SEQ ID NO: 9005 - DNA, 20 bp, synthetic construct
  misc_feature 1..20: note = CRISPR gRNA sequence
  source 1..20: mol_type = other DNA
ccagtatgttagggggcttg

SEQ ID NO: 9006 - DNA, 20 bp, synthetic construct
  misc_feature 1..20: note = CRISPR gRNA sequence
  source 1..20: mol_type = other DNA
agtatgttagggggcttgga

SEQ ID NO: 9007 - DNA, 20 bp, synthetic construct
  misc_feature 1..20: note = CRISPR gRNA sequence
  source 1..20: mol_type = other DNA
tatgttagggggcttggaga

SEQ ID NO: 9008 - DNA, 20 bp, synthetic construct
  misc_feature 1..20: note = CRISPR gRNA sequence
  source 1..20: mol_type = other DNA
gttagggggcttggagagag

SEQ ID NO: 9009 - DNA, 20 bp, synthetic construct
  misc_feature 1..20: note = CRISPR gRNA sequence
  source 1..20: mol_type = other DNA
ttagggggcttggagagagt

SEQ ID NO: 9010 - DNA, 20 bp, synthetic construct
  misc_feature 1..20: note = CRISPR gRNA sequence
  source 1..20: mol_type = other DNA
agagtgggctttctccctct

SEQ ID NO: 9011 - DNA, 20 bp, synthetic construct
  misc_feature 1..20: note = CRISPR gRNA sequence
  source 1..20: mol_type = other DNA
gagtgggctttctccctctt

SEQ ID NO: 9012 - DNA, 20 bp, synthetic construct
  misc_feature 1..20: note = CRISPR gRNA sequence
  source 1..20: mol_type = other DNA
gtgggctttctccctcttgg

SEQ ID NO: 9013 - DNA, 20 bp, synthetic construct
  misc_feature 1..20: note = CRISPR gRNA sequence
  source 1..20: mol_type = other DNA
tgggctttctccctcttggg

SEQ ID NO: 9014 - DNA, 20 bp, synthetic construct
  misc_feature 1..20: note = CRISPR gRNA sequence
  source 1..20: mol_type = other DNA
gctttctccctcttgggagg

SEQ ID NO: 9015 - DNA, 20 bp, synthetic construct
  misc_feature 1..20: note = CRISPR gRNA sequence
  source 1..20: mol_type = other DNA
ctccctcttgggaggtggat

SEQ ID NO: 9016 - DNA, 20 bp, synthetic construct
  misc_feature 1..20: note = CRISPR gRNA sequence
  source 1..20: mol_type = other DNA
tccctcttgggaggtggata

SEQ ID NO: 9017 - DNA, 20 bp, synthetic construct
  misc_feature 1..20: note = CRISPR gRNA sequence
  source 1..20: mol_type = other DNA
cctcttgggaggtggataag

SEQ ID NO: 9018 - DNA, 20 bp, synthetic construct
  misc_feature 1..20: note = CRISPR gRNA sequence
  source 1..20: mol_type = other DNA
gtggataaggagttgacact

SEQ ID NO: 9019 - DNA, 20 bp, synthetic construct
  misc_feature 1..20: note = CRISPR gRNA sequence
  source 1..20: mol_type = other DNA
tggataaggagttgacacta

SEQ ID NO: 9020 - DNA, 20 bp, synthetic construct
  misc_feature 1..20: note = CRISPR gRNA sequence
  source 1..20: mol_type = other DNA
ataaggagttgacactaagg

SEQ ID NO: 9021 - DNA, 20 bp, synthetic construct
  misc_feature 1..20: note = CRISPR gRNA sequence
  source 1..20: mol_type = other DNA
taaggagttgacactaaggc

SEQ ID NO: 9022 - DNA, 20 bp, synthetic construct
  misc_feature 1..20: note = CRISPR gRNA sequence
  source 1..20: mol_type = other DNA
aaggagttgacactaaggca

SEQ ID NO: 9023 - DNA, 20 bp, synthetic construct
  misc_feature 1..20: note = CRISPR gRNA sequence
  source 1..20: mol_type = other DNA
gacactaaggcagggactgt

SEQ ID NO: 9024 - DNA, 20 bp, synthetic construct
  misc_feature 1..20: note = CRISPR gRNA sequence
  source 1..20: mol_type = other DNA
acactaaggcagggactgtc

SEQ ID NO: 9025 - DNA, 20 bp, synthetic construct
  misc_feature 1..20: note = CRISPR gRNA sequence
  source 1..20: mol_type = other DNA
aggcagggactgtcaggaac

SEQ ID NO: 9026 - DNA, 20 bp, synthetic construct
  misc_feature 1..20: note = CRISPR gRNA sequence
  source 1..20: mol_type = other DNA
tcacctctccccaaccctat

SEQ ID NO: 9027 - DNA, 20 bp, synthetic construct
  misc_feature 1..20: note = CRISPR gRNA sequence
  source 1..20: mol_type = other DNA
agtgtcactcacctctgccc

SEQ ID NO: 9028 - DNA, 20 bp, synthetic construct
  misc_feature 1..20: note = CRISPR gRNA sequence
  source 1..20: mol_type = other DNA
tcactcacctctgccccagc

SEQ ID NO: 9029 - DNA, 20 bp, synthetic construct
  misc_feature 1..20: note = CRISPR gRNA sequence
  source 1..20: mol_type = other DNA
gccccagccagttttatcct

SEQ ID NO: 9030 - DNA, 20 bp, synthetic construct
  misc_feature 1..20: note = CRISPR gRNA sequence
  source 1..20: mol_type = other DNA
ccccagccagttttatcctt

SEQ ID NO: 9031 - DNA, 20 bp, synthetic construct
  misc_feature 1..20: note = CRISPR gRNA sequence
  source 1..20: mol_type = other DNA
cccagccagttttatccttg

SEQ ID NO: 9032 - DNA, 20 bp, synthetic construct
  misc_feature 1..20: note = CRISPR gRNA sequence
  source 1..20: mol_type = other DNA
tttatccttggggcccccgt

SEQ ID NO: 9033 - DNA, 20 bp, synthetic construct
  misc_feature 1..20: note = CRISPR gRNA sequence
  source 1..20: mol_type = other DNA
gcccccgtcagctcaatccc

SEQ ID NO: 9034 - DNA, 20 bp, synthetic construct
  misc_feature 1..20: note = CRISPR gRNA sequence
  source 1..20: mol_type = other DNA
cccgtcagctcaatccctgg

SEQ ID NO: 9035 - DNA, 20 bp, synthetic construct
  misc_feature 1..20: note = CRISPR gRNA sequence
  source 1..20: mol_type = other DNA
cgtcagctcaatccctggca

SEQ ID NO: 9036 - DNA, 20 bp, synthetic construct
  misc_feature 1..20: note = CRISPR gRNA sequence
  source 1..20: mol_type = other DNA
ccctggcagagaacatgcct

SEQ ID NO: 9037 - DNA, 20 bp, synthetic construct
  misc_feature 1..20: note = CRISPR gRNA sequence
  source 1..20: mol_type = other DNA
tggcagagaacatgcctcag

SEQ ID NO: 9038 - DNA, 20 bp, synthetic construct
  misc_feature 1..20: note = CRISPR gRNA sequence
  source 1..20: mol_type = other DNA
ggcagagaacatgcctcaga

SEQ ID NO: 9039 - DNA, 20 bp, synthetic construct
  misc_feature 1..20: note = CRISPR gRNA sequence
  source 1..20: mol_type = other DNA
agaaggaaacacatccgtgc

SEQ ID NO: 9040 - DNA, 20 bp, synthetic construct
  misc_feature 1..20: note = CRISPR gRNA sequence
  source 1..20: mol_type = other DNA
aaacacatccgtgcgagcat

SEQ ID NO: 9041 - DNA, 20 bp, synthetic construct
  misc_feature 1..20: note = CRISPR gRNA sequence
  source 1..20: mol_type = other DNA
aacacatccgtgcgagcatc

SEQ ID NO: 9042 - DNA, 20 bp, synthetic construct
  misc_feature 1..20: note = CRISPR gRNA sequence
  source 1..20: mol_type = other DNA
cacatccgtgcgagcatcag

SEQ ID NO: 9043 - DNA, 20 bp, synthetic construct
  misc_feature 1..20: note = CRISPR gRNA sequence
  source 1..20: mol_type = other DNA
acatccgtgcgagcatcagg

SEQ ID NO: 9044 - DNA, 20 bp, synthetic construct
  misc_feature 1..20: note = CRISPR gRNA sequence
  source 1..20: mol_type = other DNA
catccgtgcgagcatcagga

SEQ ID NO: 9045 - DNA, 20 bp, synthetic construct
  misc_feature 1..20: note = CRISPR gRNA sequence
  source 1..20: mol_type = other DNA
aggagggaatctccaccaat

SEQ ID NO: 9046 - DNA, 20 bp, synthetic construct
  misc_feature 1..20: note = CRISPR gRNA sequence
  source 1..20: mol_type = other DNA
gagggaatctccaccaatta

SEQ ID NO: 9047 - DNA, 20 bp, synthetic construct
  misc_feature 1..20: note = CRISPR gRNA sequence
  source 1..20: mol_type = other DNA
caattagagcattcacctgc

SEQ ID NO: 9048 - DNA, 20 bp, synthetic construct
  misc_feature 1..20: note = CRISPR gRNA sequence
  source 1..20: mol_type = other DNA
tgccagccttattcgttcat

SEQ ID NO: 9049 - DNA, 20 bp, synthetic construct
  misc_feature 1..20: note = CRISPR gRNA sequence
  source 1..20: mol_type = other DNA
attcgttcatcagctcttca

SEQ ID NO: 9050 - DNA, 20 bp, synthetic construct
  misc_feature 1..20: note = CRISPR gRNA sequence
  source 1..20: mol_type = other DNA
tcgttcatcagctcttcatg

SEQ ID NO: 9051 - DNA, 20 bp, synthetic construct
  misc_feature 1..20: note = CRISPR gRNA sequence
  source 1..20: mol_type = other DNA
ctctgtgccaactgctctgc

SEQ ID NO: 9052 - DNA, 20 bp, synthetic construct
  misc_feature 1..20: note = CRISPR gRNA sequence
  source 1..20: mol_type = other DNA
tctgtgccaactgctctgct

SEQ ID NO: 9053 - DNA, 20 bp, synthetic construct
  misc_feature 1..20: note = CRISPR gRNA sequence
  source 1..20: mol_type = other DNA
caactgctctgctaggtgct

SEQ ID NO: 9054 - DNA, 20 bp, synthetic construct
  misc_feature 1..20: note = CRISPR gRNA sequence
  source 1..20: mol_type = other DNA
ctaggtgctaagaattccat

SEQ ID NO: 9055 - DNA, 20 bp, synthetic construct
  misc_feature 1..20: note = CRISPR gRNA sequence
  source 1..20: mol_type = other DNA
taggtgctaagaattccatc

SEQ ID NO: 9056 - DNA, 20 bp, synthetic construct
  misc_feature 1..20: note = CRISPR gRNA sequence
  source 1..20: mol_type = other DNA
aggtgctaagaattccatca

SEQ ID NO: 9057 - DNA, 20 bp, synthetic construct
  misc_feature 1..20: note = CRISPR gRNA sequence
  source 1..20: mol_type = other DNA
tgctaagaattccatcaggg

SEQ ID NO: 9058 - DNA, 20 bp, synthetic construct
  misc_feature 1..20: note = CRISPR gRNA sequence
  source 1..20: mol_type = other DNA
gctaagaattccatcagggc

SEQ ID NO: 9059 - DNA, 20 bp, synthetic construct
  misc_feature 1..20: note = CRISPR gRNA sequence
  source 1..20: mol_type = other DNA
agaattccatcagggcagga

SEQ ID NO: 9060 - DNA, 20 bp, synthetic construct
  misc_feature 1..20: note = CRISPR gRNA sequence
  source 1..20: mol_type = other DNA
ccatcagggcaggacagaaa

SEQ ID NO: 9061 - DNA, 20 bp, synthetic construct
  misc_feature 1..20: note = CRISPR gRNA sequence
  source 1..20: mol_type = other DNA
acagaaacagctactgctct

SEQ ID NO: 9062 - DNA, 20 bp, synthetic construct
  misc_feature 1..20: note = CRISPR gRNA sequence
  source 1..20: mol_type = other DNA
cagaaacagctactgctctt

SEQ ID NO: 9063 - DNA, 20 bp, synthetic construct
  misc_feature 1..20: note = CRISPR gRNA sequence
  source 1..20: mol_type = other DNA
agaaacagctactgctctta

SEQ ID NO: 9064 - DNA, 20 bp, synthetic construct
  misc_feature 1..20: note = CRISPR gRNA sequence
  source 1..20: mol_type = other DNA
gctactgctcttagggaaat

SEQ ID NO: 9065 - DNA, 20 bp, synthetic construct
  misc_feature 1..20: note = CRISPR gRNA sequence
  source 1..20: mol_type = other DNA
ctactgctcttagggaaatt

SEQ ID NO: 9066 - DNA, 20 bp, synthetic construct
  misc_feature 1..20: note = CRISPR gRNA sequence
  source 1..20: mol_type = other DNA
tactgctcttagggaaatta

SEQ ID NO: 9067 - DNA, 20 bp, synthetic construct
  misc_feature 1..20: note = CRISPR gRNA sequence
  source 1..20: mol_type = other DNA
ttagggaaattagggccctt

SEQ ID NO: 9068 - DNA, 20 bp, synthetic construct
  misc_feature 1..20: note = CRISPR gRNA sequence
  source 1..20: mol_type = other DNA
tagggaaattagggcccttt

SEQ ID NO: 9069 - DNA, 20 bp, synthetic construct
  misc_feature 1..20: note = CRISPR gRNA sequence
  source 1..20: mol_type = other DNA
agggaaattagggcccttta

SEQ ID NO: 9070 - DNA, 20 bp, synthetic construct
  misc_feature 1..20: note = CRISPR gRNA sequence
  source 1..20: mol_type = other DNA
gggaaattagggccctttag

SEQ ID NO: 9071 - DNA, 20 bp, synthetic construct
  misc_feature 1..20: note = CRISPR gRNA sequence
  source 1..20: mol_type = other DNA
ggaaattagggccctttagg

SEQ ID NO: 9072 - DNA, 20 bp, synthetic construct
  misc_feature 1..20: note = CRISPR gRNA sequence
  source 1..20: mol_type = other DNA
gaaattagggccctttaggg

SEQ ID NO: 9073 - DNA, 20 bp, synthetic construct
  misc_feature 1..20: note = CRISPR gRNA sequence
  source 1..20: mol_type = other DNA
ttagggccctttaggggggt

SEQ ID NO: 9074 - DNA, 20 bp, synthetic construct
  misc_feature 1..20: note = CRISPR gRNA sequence
  source 1..20: mol_type = other DNA
gggtcagacattaatcaaat

SEQ ID NO: 9075 - DNA, 20 bp, synthetic construct
  misc_feature 1..20: note = CRISPR gRNA sequence
  source 1..20: mol_type = other DNA
gacattaatcaaataagcaa

SEQ ID NO: 9076 - DNA, 20 bp, synthetic construct
  misc_feature 1..20: note = CRISPR gRNA sequence
  source 1..20: mol_type = other DNA
attaatcaaataagcaaaag

SEQ ID NO: 9077 - DNA, 20 bp, synthetic construct
  misc_feature 1..20: note = CRISPR gRNA sequence
  source 1..20: mol_type = other DNA
caaaagcagaatcgcaaaca

SEQ ID NO: 9078 - DNA, 20 bp, synthetic construct
  misc_feature 1..20: note = CRISPR gRNA sequence
  source 1..20: mol_type = other DNA
aaaagcagaatcgcaaacac

SEQ ID NO: 9079 - DNA, 20 bp, synthetic construct
  misc_feature 1..20: note = CRISPR gRNA sequence
  source 1..20: mol_type = other DNA
cgcaaacacaggtgctatgc

SEQ ID NO: 9080 - DNA, 20 bp, synthetic construct
  misc_feature 1..20: note = CRISPR gRNA sequence
  source 1..20: mol_type = other DNA
ctcactgcctttgtctcttg

SEQ ID NO: 9081 - DNA, 20 bp, synthetic construct
  misc_feature 1..20: note = CRISPR gRNA sequence
  source 1..20: mol_type = other DNA
tctcttgcagtgcctttctc

SEQ ID NO: 9082 - DNA, 20 bp, synthetic construct
  misc_feature 1..20: note = CRISPR gRNA sequence
  source 1..20: mol_type = other DNA
cctttctccagttcctcgtt

SEQ ID NO: 9083 - DNA, 20 bp, synthetic construct
  misc_feature 1..20: note = CRISPR gRNA sequence
  source 1..20: mol_type = other DNA
tgagctgcctgaatctccct

SEQ ID NO: 9084 - DNA, 20 bp, synthetic construct
  misc_feature 1..20: note = CRISPR gRNA sequence
  source 1..20: mol_type = other DNA
gagctgcctgaatctccctg

SEQ ID NO: 9085 - DNA, 20 bp, synthetic construct
  misc_feature 1..20: note = CRISPR gRNA sequence
  source 1..20: mol_type = other DNA
agctgcctgaatctccctga

SEQ ID NO: 9086 - DNA, 20 bp, synthetic construct
  misc_feature 1..20: note = CRISPR gRNA sequence
  source 1..20: mol_type = other DNA
atctccctgagggacccatc

SEQ ID NO: 9087 - DNA, 20 bp, synthetic construct
  misc_feature 1..20: note = CRISPR gRNA sequence
  source 1..20: mol_type = other DNA
accatctccactctgcccca

SEQ ID NO: 9088 - DNA, 20 bp, synthetic construct
  misc_feature 1..20: note = CRISPR gRNA sequence
  source 1..20: mol_type = other DNA
ccatctccactctgccccat

SEQ ID NO: 9089 - DNA, 20 bp, synthetic construct
  misc_feature 1..20: note = CRISPR gRNA sequence
  source 1..20: mol_type = other DNA
ccactctgccccatgggctc

SEQ ID NO: 9090 - DNA, 20 bp, synthetic construct
  misc_feature 1..20: note = CRISPR gRNA sequence
  source 1..20: mol_type = other DNA
atgggctctggcaaatctct

SEQ ID NO: 9091 - DNA, 20 bp, synthetic construct
  misc_feature 1..20: note = CRISPR gRNA sequence
  source 1..20: mol_type = other DNA
tgggctctggcaaatctctg

SEQ ID NO: 9092 - DNA, 20 bp, synthetic construct
  misc_feature 1..20: note = CRISPR gRNA sequence
  source 1..20: mol_type = other DNA
ctctggcaaatctctgaggc

SEQ ID NO: 9093 - DNA, 20 bp, synthetic construct
  misc_feature 1..20: note = CRISPR gRNA sequence
  source 1..20: mol_type = other DNA
gcaaatctctgaggctggaa

SEQ ID NO: 9094 - DNA, 20 bp, synthetic construct
  misc_feature 1..20: note = CRISPR gRNA sequence
  source 1..20: mol_type = other DNA
caaatctctgaggctggaac

SEQ ID NO: 9095 - DNA, 20 bp, synthetic construct
  misc_feature 1..20: note = CRISPR gRNA sequence
  source 1..20: mol_type = other DNA
aaatctctgaggctggaaca

SEQ ID NO: 9096 - DNA, 20 bp, synthetic construct
  misc_feature 1..20: note = CRISPR gRNA sequence
  source 1..20: mol_type = other DNA
aatctctgaggctggaacag

SEQ ID NO: 9097 - DNA, 20 bp, synthetic construct
  misc_feature 1..20: note = CRISPR gRNA sequence
  source 1..20: mol_type = other DNA
gaggctggaacaggggtctc

SEQ ID NO: 9098 - DNA, 20 bp, synthetic construct
  misc_feature 1..20: note = CRISPR gRNA sequence
  source 1..20: mol_type = other DNA
tccagtatattcatctacca

SEQ ID NO: 9099 - DNA, 20 bp, synthetic construct
  misc_feature 1..20: note = CRISPR gRNA sequence
  source 1..20: mol_type = other DNA
gtatattcatctaccatggt

SEQ ID NO: 9100 - DNA, 20 bp, synthetic construct
  misc_feature 1..20: note = CRISPR gRNA sequence
  source 1..20: mol_type = other DNA
ttcatctaccatggtgagtg

SEQ ID NO: 9101 - DNA, 20 bp, synthetic construct
  misc_feature 1..20: note = CRISPR gRNA sequence
  source 1..20: mol_type = other DNA
tcatctaccatggtgagtgc

SEQ ID NO: 9102 - DNA, 20 bp, synthetic construct
  misc_feature 1..20: note = CRISPR gRNA sequence
  source 1..20: mol_type = other DNA
catctaccatggtgagtgcg

SEQ ID NO: 9103 - DNA, 20 bp, synthetic construct
  misc_feature 1..20: note = CRISPR gRNA sequence
  source 1..20: mol_type = other DNA
accatggtgagtgcggggcc

SEQ ID NO: 9104 - DNA, 20 bp, synthetic construct
  misc_feature 1..20: note = CRISPR gRNA sequence
  source 1..20: mol_type = other DNA
ctccccatactccatgcact

SEQ ID NO: 9105 - DNA, 20 bp, synthetic construct
  misc_feature 1..20: note = CRISPR gRNA sequence
  source 1..20: mol_type = other DNA
cccatactccatgcacttgg

SEQ ID NO: 9106 - DNA, 20 bp, synthetic construct
  misc_feature 1..20: note = CRISPR gRNA sequence
  source 1..20: mol_type = other DNA
atactccatgcacttggcag

SEQ ID NO: 9107 - DNA, 20 bp, synthetic construct
  misc_feature 1..20: note = CRISPR gRNA sequence
  source 1..20: mol_type = other DNA
tgcacttggcagtggtgccc

SEQ ID NO: 9108 - DNA, 20 bp, synthetic construct
  misc_feature 1..20: note = CRISPR gRNA sequence
  source 1..20: mol_type = other DNA
ttctcatgatcctccctccc

SEQ ID NO: 9109 - DNA, 20 bp, synthetic construct
  misc_feature 1..20: note = CRISPR gRNA sequence
  source 1..20: mol_type = other DNA
tccctatttcccaaaaatca

SEQ ID NO: 9110 - DNA, 20 bp, synthetic construct
  misc_feature 1..20: note = CRISPR gRNA sequence
  source 1..20: mol_type = other DNA
ctatttcccaaaaatcaaag

SEQ ID NO: 9111 - DNA, 20 bp, synthetic construct
  misc_feature 1..20: note = CRISPR gRNA sequence
  source 1..20: mol_type = other DNA
tttcccaaaaatcaaagcag

SEQ ID NO: 9112 - DNA, 20 bp, synthetic construct
  misc_feature 1..20: note = CRISPR gRNA sequence
  source 1..20: mol_type = other DNA
tcccaaaaatcaaagcagaa

SEQ ID NO: 9113 - DNA, 20 bp, synthetic construct
  misc_feature 1..20: note = CRISPR gRNA sequence
  source 1..20: mol_type = other DNA
caaaaatcaaagcagaagag

SEQ ID NO: 9114 - DNA, 20 bp, synthetic construct
  misc_feature 1..20: note = CRISPR gRNA sequence
  source 1..20: mol_type = other DNA
aaaatcaaagcagaagagca

SEQ ID NO: 9115 - DNA, 20 bp, synthetic construct
  misc_feature 1..20: note = CRISPR gRNA sequence
  source 1..20: mol_type = other DNA
gcagaagagcagagattcct

SEQ ID NO: 9116 - DNA, 20 bp, synthetic construct
  misc_feature 1..20: note = CRISPR gRNA sequence
  source 1..20: mol_type = other DNA
cagaagagcagagattcctg

SEQ ID NO: 9117 - DNA, 20 bp, synthetic construct
  misc_feature 1..20: note = CRISPR gRNA sequence
  source 1..20: mol_type = other DNA
aagagcagagattcctgagg

SEQ ID NO: 9118 - DNA, 20 bp, synthetic construct
  misc_feature 1..20: note = CRISPR gRNA sequence
  source 1..20: mol_type = other DNA
cagagattcctgaggtggtc

SEQ ID NO: 9119 - DNA, 20 bp, synthetic construct
  misc_feature 1..20: note = CRISPR gRNA sequence
  source 1..20: mol_type = other DNA
agagattcctgaggtggtct

SEQ ID NO: 9120 - DNA, 20 bp, synthetic construct
  misc_feature 1..20: note = CRISPR gRNA sequence
  source 1..20: mol_type = other DNA
ggtggtctgggtgcatgacc

SEQ ID NO: 9121 - DNA, 20 bp, synthetic construct
  misc_feature 1..20: note = CRISPR gRNA sequence
  source 1..20: mol_type = other DNA
tggtctgggtgcatgaccaa

SEQ ID NO: 9122 - DNA, 20 bp, synthetic construct
  misc_feature 1..20: note = CRISPR gRNA sequence
  source 1..20: mol_type = other DNA
tctgggtgcatgaccaagag

SEQ ID NO: 9123 - DNA, 20 bp, synthetic construct
  misc_feature 1..20: note = CRISPR gRNA sequence
  source 1..20: mol_type = other DNA
catgaccaagagtggttgtg

SEQ ID NO: 9124 - DNA, 20 bp, synthetic construct
  misc_feature 1..20: note = CRISPR gRNA sequence
  source 1..20: mol_type = other DNA
tgctttccccttctgaccct

SEQ ID NO: 9125 - DNA, 20 bp, synthetic construct
  misc_feature 1..20: note = CRISPR gRNA sequence
  source 1..20: mol_type = other DNA
atcaatacatgctcactaat

SEQ ID NO: 9126 - DNA, 20 bp, synthetic construct
  misc_feature 1..20: note = CRISPR gRNA sequence
  source 1..20: mol_type = other DNA
ctcactaataagctaatgac

SEQ ID NO: 9127 - DNA, 20 bp, synthetic construct
  misc_feature 1..20: note = CRISPR gRNA sequence
  source 1..20: mol_type = other DNA
taatgacaagtgatgtttac

SEQ ID NO: 9128 - DNA, 20 bp, synthetic construct
  misc_feature 1..20: note = CRISPR gRNA sequence
  source 1..20: mol_type = other DNA
cactgtctctctcactcttt

SEQ ID NO: 9129 - DNA, 20 bp, synthetic construct
  misc_feature 1..20: note = CRISPR gRNA sequence
  source 1..20: mol_type = other DNA
ttttagtatactgatgtgaa

SEQ ID NO: 9130 - DNA, 20 bp, synthetic construct
  misc_feature 1..20: note = CRISPR gRNA sequence
  source 1..20: mol_type = other DNA
gtatactgatgtgaatagtt

SEQ ID NO: 9131 - DNA, 20 bp, synthetic construct
  misc_feature 1..20: note = CRISPR gRNA sequence
  source 1..20: mol_type = other DNA
gtttggtgtgcatccttgca

SEQ ID NO: 9132 - DNA, 20 bp, synthetic construct
  misc_feature 1..20: note = CRISPR gRNA sequence
  source 1..20: mol_type = other DNA
gatttgtcttgtttcctaat

SEQ ID NO: 9133 - DNA, 20 bp, synthetic construct
  misc_feature 1..20: note = CRISPR gRNA sequence
  source 1..20: mol_type = other DNA
ttgtttcctaatcagtaaaa

SEQ ID NO: 9134 - DNA, 20 bp, synthetic construct
  misc_feature 1..20: note = CRISPR gRNA sequence
  source 1..20: mol_type = other DNA
ccctactgacccaccacact

SEQ ID NO: 9135 - DNA, 20 bp, synthetic construct
  misc_feature 1..20: note = CRISPR gRNA sequence
  source 1..20: mol_type = other DNA
cctactgacccaccacactg

SEQ ID NO: 9136 - DNA, 20 bp, synthetic construct
  misc_feature 1..20: note = CRISPR gRNA sequence
  source 1..20: mol_type = other DNA
ctactgacccaccacactga

SEQ ID NO: 9137 - DNA, 20 bp, synthetic construct
  misc_feature 1..20: note = CRISPR gRNA sequence
  source 1..20: mol_type = other DNA
tactgacccaccacactgag

SEQ ID NO: 9138 - DNA, 20 bp, synthetic construct
  misc_feature 1..20: note = CRISPR gRNA sequence
  source 1..20: mol_type = other DNA
tgaggggttgtgacttgtct

SEQ ID NO: 9139 - DNA, 20 bp, synthetic construct
  misc_feature 1..20: note = CRISPR gRNA sequence
  source 1..20: mol_type = other DNA
gaggggttgtgacttgtctc

SEQ ID NO: 9140 - DNA, 20 bp, synthetic construct
  misc_feature 1..20: note = CRISPR gRNA sequence
  source 1..20: mol_type = other DNA
aggggttgtgacttgtctca

SEQ ID NO: 9141 - DNA, 20 bp, synthetic construct
  misc_feature 1..20: note = CRISPR gRNA sequence
  source 1..20: mol_type = other DNA
ggttgtgacttgtctcaggg

SEQ ID NO: 9142 - DNA, 20 bp, synthetic construct
  misc_feature 1..20: note = CRISPR gRNA sequence
  source 1..20: mol_type = other DNA
gttgtgacttgtctcaggga

SEQ ID NO: 9143 - DNA, 20 bp, synthetic construct
  misc_feature 1..20: note = CRISPR gRNA sequence
  source 1..20: mol_type = other DNA
tgtctcagggaaggtgtgtt

SEQ ID NO: 9144 - DNA, 20 bp, synthetic construct
  misc_feature 1..20: note = CRISPR gRNA sequence
  source 1..20: mol_type = other DNA
gtctcagggaaggtgtgttt

SEQ ID NO: 9145 - DNA, 20 bp, synthetic construct
  misc_feature 1..20: note = CRISPR gRNA sequence
  source 1..20: mol_type = other DNA
ggaaggtgtgtttgggctgt

SEQ ID NO: 9146 - DNA, 20 bp, synthetic construct
  misc_feature 1..20: note = CRISPR gRNA sequence
  source 1..20: mol_type = other DNA
gaaggtgtgtttgggctgtc

SEQ ID NO: 9147 - DNA, 20 bp, synthetic construct
  misc_feature 1..20: note = CRISPR gRNA sequence
  source 1..20: mol_type = other DNA
aaggtgtgtttgggctgtca

SEQ ID NO: 9148 - DNA, 20 bp, synthetic construct
  misc_feature 1..20: note = CRISPR gRNA sequence
  source 1..20: mol_type = other DNA
gtgtttgggctgtcagggat

SEQ ID NO: 9149 - DNA, 20 bp, synthetic construct
  misc_feature 1..20: note = CRISPR gRNA sequence
  source 1..20: mol_type = other DNA
tgggctgtcagggatgagac

SEQ ID NO: 9150 - DNA, 20 bp, synthetic construct
  misc_feature 1..20: note = CRISPR gRNA sequence
  source 1..20: mol_type = other DNA
gggctgtcagggatgagacc

SEQ ID NO: 9151 - DNA, 20 bp, synthetic construct
  misc_feature 1..20: note = CRISPR gRNA sequence
  source 1..20: mol_type = other DNA
gctgtcagggatgagaccag

SEQ ID NO: 9152 - DNA, 20 bp, synthetic construct
  misc_feature 1..20: note = CRISPR gRNA sequence
  source 1..20: mol_type = other DNA
ctgtcagggatgagaccagg

SEQ ID NO: 9153 - DNA, 20 bp, synthetic construct
  misc_feature 1..20: note = CRISPR gRNA sequence
  source 1..20: mol_type = other DNA
ccaggaggatgcttccactc

SEQ ID NO: 9154 - DNA, 20 bp, synthetic construct
  misc_feature 1..20: note = CRISPR gRNA sequence
  source 1..20: mol_type = other DNA
aggatgcttccactcaagtc

SEQ ID NO: 9155 - DNA, 20 bp, synthetic construct
  misc_feature 1..20: note = CRISPR gRNA sequence
  source 1..20: mol_type = other DNA
gatgcttccactcaagtcca

SEQ ID NO: 9156 - DNA, 20 bp, synthetic construct
  misc_feature 1..20: note = CRISPR gRNA sequence
  source 1..20: mol_type = other DNA
aagtccagagcatccattcc

SEQ ID NO: 9157 - DNA, 20 bp, synthetic construct
  misc_feature 1..20: note = CRISPR gRNA sequence
  source 1..20: mol_type = other DNA
gagcatccattcctggttgc

SEQ ID NO: 9158 - DNA, 20 bp, synthetic construct
  misc_feature 1..20: note = CRISPR gRNA sequence
  source 1..20: mol_type = other DNA
atccattcctggttgcaaga

SEQ ID NO: 9159 - DNA, 20 bp, synthetic construct
  misc_feature 1..20: note = CRISPR gRNA sequence
  source 1..20: mol_type = other DNA
tcctggttgcaagacagttt

SEQ ID NO: 9160 - DNA, 20 bp, synthetic construct
  misc_feature 1..20: note = CRISPR gRNA sequence
  source 1..20: mol_type = other DNA
acagtttcagtataacgcac

SEQ ID NO: 9161 - DNA, 20 bp, synthetic construct
  misc_feature 1..20: note = CRISPR gRNA sequence
  source 1..20: mol_type = other DNA
agtataacgcactggtatct

SEQ ID NO: 9162 - DNA, 20 bp, synthetic construct
  misc_feature 1..20: note = CRISPR gRNA sequence
  source 1..20: mol_type = other DNA
ataacgcactggtatctcag

SEQ ID NO: 9163 - DNA, 20 bp, synthetic construct
  misc_feature 1..20: note = CRISPR gRNA sequence
  source 1..20: mol_type = other DNA
acgcactggtatctcagaag

SEQ ID NO: 9164 - DNA, 20 bp, synthetic construct
  misc_feature 1..20: note = CRISPR gRNA sequence
  source 1..20: mol_type = other DNA
gcactggtatctcagaagca

SEQ ID NO: 9165 - DNA, 20 bp, synthetic construct
  misc_feature 1..20: note = CRISPR gRNA sequence
  source 1..20: mol_type = other DNA
ctggtatctcagaagcagag

SEQ ID NO: 9166 - DNA, 20 bp, synthetic construct
  misc_feature 1..20: note = CRISPR gRNA sequence
  source 1..20: mol_type = other DNA
gtatctcagaagcagagaag

SEQ ID NO: 9167 - DNA, 20 bp, synthetic construct
  misc_feature 1..20: note = CRISPR gRNA sequence
  source 1..20: mol_type = other DNA
gagaagcagttcctgatatc

SEQ ID NO: 9168 - DNA, 20 bp, synthetic construct
  misc_feature 1..20: note = CRISPR gRNA sequence
  source 1..20: mol_type = other DNA
agaagcagttcctgatatct

SEQ ID NO: 9169 - DNA, 20 bp, synthetic construct
  misc_feature 1..20: note = CRISPR gRNA sequence
  source 1..20: mol_type = other DNA
ttcctgatatctaggaaaat

SEQ ID NO: 9170 - DNA, 20 bp, synthetic construct
  misc_feature 1..20: note = CRISPR gRNA sequence
  source 1..20: mol_type = other DNA
gaaaatgagcactgaccaca

SEQ ID NO: 9171 - DNA, 20 bp, synthetic construct
  misc_feature 1..20: note = CRISPR gRNA sequence
  source 1..20: mol_type = other DNA
aatgagcactgaccacacag

SEQ ID NO: 9172 - DNA, 20 bp, synthetic construct
  misc_feature 1..20: note = CRISPR gRNA sequence
  source 1..20: mol_type = other DNA
atgagcactgaccacacagc

SEQ ID NO: 9173 - DNA, 20 bp, synthetic construct
  misc_feature 1..20: note = CRISPR gRNA sequence
  source 1..20: mol_type = other DNA
agcactgaccacacagcagg

SEQ ID NO: 9174 - DNA, 20 bp, synthetic construct
  misc_feature 1..20: note = CRISPR gRNA sequence
  source 1..20: mol_type = other DNA
cactgaccacacagcaggaa

SEQ ID NO: 9175 - DNA, 20 bp, synthetic construct
  misc_feature 1..20: note = CRISPR gRNA sequence
  source 1..20: mol_type = other DNA
acacagcaggaagagtgcaa

SEQ ID NO: 9176 - DNA, 20 bp, synthetic construct
  misc_feature 1..20: note = CRISPR gRNA sequence
  source 1..20: mol_type = other DNA
cagcaggaagagtgcaatag

SEQ ID NO: 9177 - DNA, 20 bp, synthetic construct
  misc_feature 1..20: note = CRISPR gRNA sequence
  source 1..20: mol_type = other DNA
gcaatagtagtacctgccct

SEQ ID NO: 9178 - DNA, 20 bp, synthetic construct
  misc_feature 1..20: note = CRISPR gRNA sequence
  source 1..20: mol_type = other DNA
acctgccctaagttccttat

SEQ ID NO: 9179 - DNA, 20 bp, synthetic construct
  misc_feature 1..20: note = CRISPR gRNA sequence
  source 1..20: mol_type = other DNA
agctaattgcacccatttca

SEQ ID NO: 9180 - DNA, 20 bp, synthetic construct
  misc_feature 1..20: note = CRISPR gRNA sequence
  source 1..20: mol_type = other DNA
attgcacccatttcacagat

SEQ ID NO: 9181 - DNA, 20 bp, synthetic construct
  misc_feature 1..20: note = CRISPR gRNA sequence
  source 1..20: mol_type = other DNA
acccatttcacagattggaa

SEQ ID NO: 9182 - DNA, 20 bp, synthetic construct
  misc_feature 1..20: note = CRISPR gRNA sequence
  source 1..20: mol_type = other DNA
atttcacagattggaaaagc

SEQ ID NO: 9183 - DNA, 20 bp, synthetic construct
  misc_feature 1..20: note = CRISPR gRNA sequence
  source 1..20: mol_type = other DNA
tttcacagattggaaaagca

SEQ ID NO: 9184 - DNA, 20 bp, synthetic construct
  misc_feature 1..20: note = CRISPR gRNA sequence
  source 1..20: mol_type = other DNA
agattggaaaagcaaggttc

SEQ ID NO: 9185 - DNA, 20 bp, synthetic construct
  misc_feature 1..20: note = CRISPR gRNA sequence
  source 1..20: mol_type = other DNA
gattggaaaagcaaggttcc

SEQ ID NO: 9186 - DNA, 20 bp, synthetic construct
  misc_feature 1..20: note = CRISPR gRNA sequence
  source 1..20: mol_type = other DNA
ttggaaaagcaaggttccag

SEQ ID NO: 9187 - DNA, 20 bp, synthetic construct
  misc_feature 1..20: note = CRISPR gRNA sequence
  source 1..20: mol_type = other DNA
aaaagcaaggttccaggagc

SEQ ID NO: 9188 - DNA, 20 bp, synthetic construct
  misc_feature 1..20: note = CRISPR gRNA sequence
  source 1..20: mol_type = other DNA
ccaggagctagatgtaactc

SEQ ID NO: 9189 - DNA, 20 bp, synthetic construct
  misc_feature 1..20: note = CRISPR gRNA sequence
  source 1..20: mol_type = other DNA
aggagctagatgtaactcca

SEQ ID NO: 9190 - DNA, 20 bp, synthetic construct
  misc_feature 1..20: note = CRISPR gRNA sequence
  source 1..20: mol_type = other DNA
taactccagagctctttctt

SEQ ID NO: 9191 - DNA, 20 bp, synthetic construct
  misc_feature 1..20: note = CRISPR gRNA sequence
  source 1..20: mol_type = other DNA
tgtcctgaaatatcttcctt

SEQ ID NO: 9192 - DNA, 20 bp, synthetic construct
  misc_feature 1..20: note = CRISPR gRNA sequence
  source 1..20: mol_type = other DNA
cctgaaatatcttcctttgg

SEQ ID NO: 9193 - DNA, 20 bp, synthetic construct
  misc_feature 1..20: note = CRISPR gRNA sequence
  source 1..20: mol_type = other DNA
aagttctactctcttctctc

SEQ ID NO: 9194 - DNA, 20 bp, synthetic construct
  misc_feature 1..20: note = CRISPR gRNA sequence
  source 1..20: mol_type = other DNA
ctcttctctccagacttcct

SEQ ID NO: 9195 - DNA, 20 bp, synthetic construct
  misc_feature 1..20: note = CRISPR gRNA sequence
  source 1..20: mol_type = other DNA
tccagacttcctgagctcca

SEQ ID NO: 9196 - DNA, 20 bp, synthetic construct
  misc_feature 1..20: note = CRISPR gRNA sequence
  source 1..20: mol_type = other DNA
acttcctgagctccacagcc

SEQ ID NO: 9197 - DNA, 20 bp, synthetic construct
  misc_feature 1..20: note = CRISPR gRNA sequence
  source 1..20: mol_type = other DNA
ctgagctccacagcccagtt

SEQ ID NO: 9198 - DNA, 20 bp, synthetic construct
  misc_feature 1..20: note = CRISPR gRNA sequence
  source 1..20: mol_type = other DNA
gagctccacagcccagtttg

SEQ ID NO: 9199 - DNA, 20 bp, synthetic construct
  misc_feature 1..20: note = CRISPR gRNA sequence
  source 1..20: mol_type = other DNA
ctccacagcccagtttggag

SEQ ID NO: 9200 - DNA, 20 bp, synthetic construct
  misc_feature 1..20: note = CRISPR gRNA sequence
  source 1..20: mol_type = other DNA
tccacagcccagtttggagt

SEQ ID NO: 9201 - DNA, 20 bp, synthetic construct
  misc_feature 1..20: note = CRISPR gRNA sequence
  source 1..20: mol_type = other DNA
ccacagcccagtttggagta

SEQ ID NO: 9202 - DNA, 20 bp, synthetic construct
  misc_feature 1..20: note = CRISPR gRNA sequence
  source 1..20: mol_type = other DNA
cacagcccagtttggagtag

SEQ ID NO: 9203 - DNA, 20 bp, synthetic construct
  misc_feature 1..20: note = CRISPR gRNA sequence
  source 1..20: mol_type = other DNA
gtttggagtaggggtgaccc

SEQ ID NO: 9204 - DNA, 20 bp, synthetic construct
  misc_feature 1..20: note = CRISPR gRNA sequence
  source 1..20: mol_type = other DNA
gggtgacccaagtgcatttc

SEQ ID NO: 9205 - DNA, 20 bp, synthetic construct
  misc_feature 1..20: note = CRISPR gRNA sequence
  source 1..20: mol_type = other DNA
gcatttctggaatcaatacc

SEQ ID NO: 9206 - DNA, 20 bp, synthetic construct
  misc_feature 1..20: note = CRISPR gRNA sequence
  source 1..20: mol_type = other DNA
accactctccacccccaatg

SEQ ID NO: 9207 - DNA, 20 bp, synthetic construct
  misc_feature 1..20: note = CRISPR gRNA sequence
  source 1..20: mol_type = other DNA
ccactctccacccccaatgt

SEQ ID NO: 9208 - DNA, 20 bp, synthetic construct
  misc_feature 1..20: note = CRISPR gRNA sequence
  source 1..20: mol_type = other DNA
tctccacccccaatgtaggt

SEQ ID NO: 9209 - DNA, 20 bp, synthetic construct
  misc_feature 1..20: note = CRISPR gRNA sequence
  source 1..20: mol_type = other DNA
ctccacccccaatgtaggtg

SEQ ID NO: 9210 - DNA, 20 bp, synthetic construct
  misc_feature 1..20: note = CRISPR gRNA sequence
  source 1..20: mol_type = other DNA
ccaatgtaggtgaggtgccc

SEQ ID NO: 9211 - DNA, 20 bp, synthetic construct
  misc_feature 1..20: note = CRISPR gRNA sequence
  source 1..20: mol_type = other DNA
caatgtaggtgaggtgcccc

SEQ ID NO: 9212 - DNA, 20 bp, synthetic construct
  misc_feature 1..20: note = CRISPR gRNA sequence
  source 1..20: mol_type = other DNA
gtaggtgaggtgccccaggc

SEQ ID NO: 9213 - DNA, 20 bp, synthetic construct
  misc_feature 1..20: note = CRISPR gRNA sequence
  source 1..20: mol_type = other DNA
tgaggtgccccaggccagcc

SEQ ID NO: 9214 - DNA, 20 bp, synthetic construct
  misc_feature 1..20: note = CRISPR gRNA sequence
  source 1..20: mol_type = other DNA
gccagccaagtaccccctcc

SEQ ID NO: 9215 - DNA, 20 bp, synthetic construct
  misc_feature 1..20: note = CRISPR gRNA sequence
  source 1..20: mol_type = other DNA
agccaagtaccccctcccag

SEQ ID NO: 9216 - DNA, 20 bp, synthetic construct
  misc_feature 1..20: note = CRISPR gRNA sequence
  source 1..20: mol_type = other DNA
cccagtggattcactgtcca

SEQ ID NO: 9217 - DNA, 20 bp, synthetic construct
  misc_feature 1..20: note = CRISPR gRNA sequence
  source 1..20: mol_type = other DNA
ccacggcctcccaacatctc

SEQ ID NO: 9218 - DNA, 20 bp, synthetic construct
  misc_feature 1..20: note = CRISPR gRNA sequence
  source 1..20: mol_type = other DNA
gcctcccaacatctccagac

SEQ ID NO: 9219 - DNA, 20 bp, synthetic construct
  misc_feature 1..20: note = CRISPR gRNA sequence
  source 1..20: mol_type = other DNA
cccaacatctccagaccggc

SEQ ID NO: 9220 - DNA, 20 bp, synthetic construct
  misc_feature 1..20: note = CRISPR gRNA sequence
  source 1..20: mol_type = other DNA
ccaacatctccagaccggcc

SEQ ID NO: 9221 - DNA, 20 bp, synthetic construct
  misc_feature 1..20: note = CRISPR gRNA sequence
  source 1..20: mol_type = other DNA
ccagaccggccaggctccac

SEQ ID NO: 9222 - DNA, 20 bp, synthetic construct
  misc_feature 1..20: note = CRISPR gRNA sequence
  source 1..20: mol_type = other DNA
caccagccccttcgctccat

SEQ ID NO: 9223 - DNA, 20 bp, synthetic construct
  misc_feature 1..20: note = CRISPR gRNA sequence
  source 1..20: mol_type = other DNA
ccatcagccactgacctgcc

SEQ ID NO: 9224 - DNA, 20 bp, synthetic construct
  misc_feature 1..20: note = CRISPR gRNA sequence
  source 1..20: mol_type = other DNA
tgaacctgccctgacctccc

SEQ ID NO: 9225 - DNA, 20 bp, synthetic construct
  misc_feature 1..20: note = CRISPR gRNA sequence
  source 1..20: mol_type = other DNA
gacctcccgagcaaacatga

SEQ ID NO: 9226 - DNA, 20 bp, synthetic construct
  misc_feature 1..20: note = CRISPR gRNA sequence
  source 1..20: mol_type = other DNA
acctcccgagcaaacatgac

SEQ ID NO: 9227 - DNA, 20 bp, synthetic construct
  misc_feature 1..20: note = CRISPR gRNA sequence
  source 1..20: mol_type = other DNA
cccgagcaaacatgacaggt

SEQ ID NO: 9228 - DNA, 20 bp, synthetic construct
  misc_feature 1..20: note = CRISPR gRNA sequence
  source 1..20: mol_type = other DNA
ccgagcaaacatgacaggta

SEQ ID NO: 9229 - DNA, 20 bp, synthetic construct
  misc_feature 1..20: note = CRISPR gRNA sequence
  source 1..20: mol_type = other DNA
acatgacaggtaaggaccct

SEQ ID NO: 9230 - DNA, 20 bp, synthetic construct
  misc_feature 1..20: note = CRISPR gRNA sequence
  source 1..20: mol_type = other DNA
catgacaggtaaggaccctt

SEQ ID NO: 9231 - DNA, 20 bp, synthetic construct
  misc_feature 1..20: note = CRISPR gRNA sequence
  source 1..20: mol_type = other DNA
atgacaggtaaggaccctta

SEQ ID NO: 9232 - DNA, 20 bp, synthetic construct
  misc_feature 1..20: note = CRISPR gRNA sequence
  source 1..20: mol_type = other DNA
taaggacccttagggcctgt

SEQ ID NO: 9233 - DNA, 20 bp, synthetic construct
  misc_feature 1..20: note = CRISPR gRNA sequence
  source 1..20: mol_type = other DNA
aggacccttagggcctgtga

SEQ ID NO: 9234 - DNA, 20 bp, synthetic construct
  misc_feature 1..20: note = CRISPR gRNA sequence
  source 1..20: mol_type = other DNA
ggacccttagggcctgtgag

SEQ ID NO: 9235 - DNA, 20 bp, synthetic construct
  misc_feature 1..20: note = CRISPR gRNA sequence
  source 1..20: mol_type = other DNA
ttagggcctgtgagaggtac

SEQ ID NO: 9236 - DNA, 20 bp, synthetic construct
  misc_feature 1..20: note = CRISPR gRNA sequence
  source 1..20: mol_type = other DNA
gggcctgtgagaggtactag

SEQ ID NO: 9237 - DNA, 20 bp, synthetic construct
  misc_feature 1..20: note = CRISPR gRNA sequence
  source 1..20: mol_type = other DNA
cctgtgagaggtactagaag

SEQ ID NO: 9238 - DNA, 20 bp, synthetic construct
  misc_feature 1..20: note = CRISPR gRNA sequence
  source 1..20: mol_type = other DNA
ctgtgagaggtactagaagc

SEQ ID NO: 9239 - DNA, 20 bp, synthetic construct
  misc_feature 1..20: note = CRISPR gRNA sequence
  source 1..20: mol_type = other DNA
gaggtactagaagcaggatc

SEQ ID NO: 9240 - DNA, 20 bp, synthetic construct
  misc_feature 1..20: note = CRISPR gRNA sequence
  source 1..20: mol_type = other DNA
aggtactagaagcaggatcg

SEQ ID NO: 9241 - DNA, 20 bp, synthetic construct
  misc_feature 1..20: note = CRISPR gRNA sequence
  source 1..20: mol_type = other DNA
tagaagcaggatcgaggccc

SEQ ID NO: 9242 - DNA, 20 bp, synthetic construct
  misc_feature 1..20: note = CRISPR gRNA sequence
  source 1..20: mol_type = other DNA
agaagcaggatcgaggccct

SEQ ID NO: 9243 - DNA, 20 bp, synthetic construct
  misc_feature 1..20: note = CRISPR gRNA sequence
  source 1..20: mol_type = other DNA
gaagcaggatcgaggccctg

SEQ ID NO: 9244 - DNA, 20 bp, synthetic construct
  misc_feature 1..20: note = CRISPR gRNA sequence
  source 1..20: mol_type = other DNA
gcaggatcgaggccctgggg

SEQ ID NO: 9245 - DNA, 20 bp, synthetic construct
  misc_feature 1..20: note = CRISPR gRNA sequence
  source 1..20: mol_type = other DNA
caggatcgaggccctgggga

SEQ ID NO: 9246 - DNA, 20 bp, synthetic construct
  misc_feature 1..20: note = CRISPR gRNA sequence
  source 1..20: mol_type = other DNA
gggaaggaattgtctcaaat

SEQ ID NO: 9247 - DNA, 20 bp, synthetic construct
  misc_feature 1..20: note = CRISPR gRNA sequence
  source 1..20: mol_type = other DNA
ttgtctcaaataagatccac

SEQ ID NO: 9248 - DNA, 20 bp, synthetic construct
  misc_feature 1..20: note = CRISPR gRNA sequence
  source 1..20: mol_type = other DNA
tcaaataagatccacaagca

SEQ ID NO: 9249 - DNA, 20 bp, synthetic construct
  misc_feature 1..20: note = CRISPR gRNA sequence
  source 1..20: mol_type = other DNA
tccacaagcaaagctgcctg

SEQ ID NO: 9250 - DNA, 20 bp, synthetic construct
  misc_feature 1..20: note = CRISPR gRNA sequence
  source 1..20: mol_type = other DNA
ccacaagcaaagctgcctgt

SEQ ID NO: 9251 - DNA, 20 bp, synthetic construct
  misc_feature 1..20: note = CRISPR gRNA sequence
  source 1..20: mol_type = other DNA
cacaagcaaagctgcctgta

SEQ ID NO: 9252 - DNA, 20 bp, synthetic construct
  misc_feature 1..20: note = CRISPR gRNA sequence
  source 1..20: mol_type = other DNA
aaagctgcctgtagggacaa

SEQ ID NO: 9253 - DNA, 20 bp, synthetic construct
  misc_feature 1..20: note = CRISPR gRNA sequence
  source 1..20: mol_type = other DNA
aagctgcctgtagggacaac

SEQ ID NO: 9254 - DNA, 20 bp, synthetic construct
  misc_feature 1..20: note = CRISPR gRNA sequence
  source 1..20: mol_type = other DNA
tagggacaacaggtcatgtt

SEQ ID NO: 9255 - DNA, 20 bp, synthetic construct
  misc_feature 1..20: note = CRISPR gRNA sequence
  source 1..20: mol_type = other DNA
agggacaacaggtcatgttt

SEQ ID NO: 9256 - DNA, 20 bp, synthetic construct
  misc_feature 1..20: note = CRISPR gRNA sequence
  source 1..20: mol_type = other DNA
gggacaacaggtcatgttta

SEQ ID NO: 9257 - DNA, 20 bp, synthetic construct
  misc_feature 1..20: note = CRISPR gRNA sequence
  source 1..20: mol_type = other DNA
ggacaacaggtcatgtttag

SEQ ID NO: 9258 - DNA, 20 bp, synthetic construct
  misc_feature 1..20: note = CRISPR gRNA sequence
  source 1..20: mol_type = other DNA
aacaggtcatgtttaggggt

SEQ ID NO: 9259 - DNA, 20 bp, synthetic construct
  misc_feature 1..20: note = CRISPR gRNA sequence
  source 1..20: mol_type = other DNA
ggtcatgtttaggggtcagt

SEQ ID NO: 9260 - DNA, 20 bp, synthetic construct
  misc_feature 1..20: note = CRISPR gRNA sequence
  source 1..20: mol_type = other DNA
gtcatgtttaggggtcagtc

SEQ ID NO: 9261 - DNA, 20 bp, synthetic construct
  misc_feature 1..20: note = CRISPR gRNA sequence
  source 1..20: mol_type = other DNA
tgtttaggggtcagtcggga

SEQ ID NO: 9262 - DNA, 20 bp, synthetic construct
  misc_feature 1..20: note = CRISPR gRNA sequence
  source 1..20: mol_type = other DNA
gtttaggggtcagtcgggac

SEQ ID NO: 9263 - DNA, 20 bp, synthetic construct
  misc_feature 1..20: note = CRISPR gRNA sequence
  source 1..20: mol_type = other DNA
tttaggggtcagtcgggaca

SEQ ID NO: 9264 - DNA, 20 bp, synthetic construct
  misc_feature 1..20: note = CRISPR gRNA sequence
  source 1..20: mol_type = other DNA
taggggtcagtcgggacagg

SEQ ID NO: 9265 - DNA, 20 bp, synthetic construct
  misc_feature 1..20: note = CRISPR gRNA sequence
  source 1..20: mol_type = other DNA
aggggtcagtcgggacaggg

SEQ ID NO: 9266 - DNA, 20 bp, synthetic construct
  misc_feature 1..20: note = CRISPR gRNA sequence
  source 1..20: mol_type = other DNA
ggggtcagtcgggacaggga

SEQ ID NO: 9267 - DNA, 20 bp, synthetic construct
  misc_feature 1..20: note = CRISPR gRNA sequence
  source 1..20: mol_type = other DNA
gtcgggacagggagggtctc

SEQ ID NO: 9268 - DNA, 20 bp, synthetic construct
  misc_feature 1..20: note = CRISPR gRNA sequence
  source 1..20: mol_type = other DNA
tcgggacagggagggtctcc

SEQ ID NO: 9269 - DNA, 20 bp, synthetic construct
  misc_feature 1..20: note = CRISPR gRNA sequence
  source 1..20: mol_type = other DNA
cgggacagggagggtctcca

SEQ ID NO: 9270 - DNA, 20 bp, synthetic construct
  misc_feature 1..20: note = CRISPR gRNA sequence
  source 1..20: mol_type = other DNA
ggacagggagggtctccagg

SEQ ID NO: 9271 - DNA, 20 bp, synthetic construct
  misc_feature 1..20: note = CRISPR gRNA sequence
  source 1..20: mol_type = other DNA
cagggagggtctccagggag

SEQ ID NO: 9272 - DNA, 20 bp, synthetic construct
  misc_feature 1..20: note = CRISPR gRNA sequence
  source 1..20: mol_type = other DNA
gggagggtctccagggagtg

SEQ ID NO: 9273 - DNA, 20 bp, synthetic construct
  misc_feature 1..20: note = CRISPR gRNA sequence
  source 1..20: mol_type = other DNA
ggagggtctccagggagtgg

SEQ ID NO: 9274 - DNA, 20 bp, synthetic construct
  misc_feature 1..20: note = CRISPR gRNA sequence
  source 1..20: mol_type = other DNA
gtctccagggagtggaggca

SEQ ID NO: 9275 - DNA, 20 bp, synthetic construct
  misc_feature 1..20: note = CRISPR gRNA sequence
  source 1..20: mol_type = other DNA
agggagtggaggcatggttg

SEQ ID NO: 9276 - DNA, 20 bp, synthetic construct
  misc_feature 1..20: note = CRISPR gRNA sequence
  source 1..20: mol_type = other DNA
gggagtggaggcatggttgt

SEQ ID NO: 9277 - DNA, 20 bp, synthetic construct
  misc_feature 1..20: note = CRISPR gRNA sequence
  source 1..20: mol_type = other DNA
ggagtggaggcatggttgtg

SEQ ID NO: 9278 - DNA, 20 bp, synthetic construct
  misc_feature 1..20: note = CRISPR gRNA sequence
  source 1..20: mol_type = other DNA
gagtggaggcatggttgtgg

SEQ ID NO: 9279 - DNA, 20 bp, synthetic construct
  misc_feature 1..20: note = CRISPR gRNA sequence
  source 1..20: mol_type = other DNA
gaggcatggttgtgggggaa

SEQ ID NO: 9280 - DNA, 20 bp, synthetic construct
  misc_feature 1..20: note = CRISPR gRNA sequence
  source 1..20: mol_type = other DNA
catggttgtgggggaatgga

SEQ ID NO: 9281 - DNA, 20 bp, synthetic construct
  misc_feature 1..20: note = CRISPR gRNA sequence
  source 1..20: mol_type = other DNA
gttgtgggggaatggacagc

SEQ ID NO: 9282 - DNA, 20 bp, synthetic construct
  misc_feature 1..20: note = CRISPR gRNA sequence
  source 1..20: mol_type = other DNA
tgtgggggaatggacagcta

SEQ ID NO: 9283 - DNA, 20 bp, synthetic construct
  misc_feature 1..20: note = CRISPR gRNA sequence
  source 1..20: mol_type = other DNA
atccacatcccatccaaata

SEQ ID NO: 9284 - DNA, 20 bp, synthetic construct
  misc_feature 1..20: note = CRISPR gRNA sequence
  source 1..20: mol_type = other DNA
tcccatccaaatacagccat

SEQ ID NO: 9285 - DNA, 20 bp, synthetic construct
  misc_feature 1..20: note = CRISPR gRNA sequence
  source 1..20: mol_type = other DNA
caaatacagccatcagcctt

SEQ ID NO: 9286 - DNA, 20 bp, synthetic construct
  misc_feature 1..20: note = CRISPR gRNA sequence
  source 1..20: mol_type = other DNA
gccttcagctgcttgttacc

SEQ ID NO: 9287 - DNA, 20 bp, synthetic construct
  misc_feature 1..20: note = CRISPR gRNA sequence
  source 1..20: mol_type = other DNA
ttcagctgcttgttacccag

SEQ ID NO: 9288 - DNA, 20 bp, synthetic construct
  misc_feature 1..20: note = CRISPR gRNA sequence
  source 1..20: mol_type = other DNA
ctgcttgttacccagcagaa

SEQ ID NO: 9289 - DNA, 20 bp, synthetic construct
  misc_feature 1..20: note = CRISPR gRNA sequence
  source 1..20: mol_type = other DNA
ttgttacccagcagaaaagc

SEQ ID NO: 9290 - DNA, 20 bp, synthetic construct
  misc_feature 1..20: note = CRISPR gRNA sequence
  source 1..20: mol_type = other DNA
agcagaaaagccagacaatg

SEQ ID NO: 9291 - DNA, 20 bp, synthetic construct
  misc_feature 1..20: note = CRISPR gRNA sequence
  source 1..20: mol_type = other DNA
gaaaagccagacaatgtggt

SEQ ID NO: 9292 - DNA, 20 bp, synthetic construct
  misc_feature 1..20: note = CRISPR gRNA sequence
  source 1..20: mol_type = other DNA
caatgtggtcagatcttttg

SEQ ID NO: 9293 - DNA, 20 bp, synthetic construct
  misc_feature 1..20: note = CRISPR gRNA sequence
  source 1..20: mol_type = other DNA
tgaaaaccctgatttttaca

SEQ ID NO: 9294 - DNA, 20 bp, synthetic construct
  misc_feature 1..20: note = CRISPR gRNA sequence
  source 1..20: mol_type = other DNA
tttattatttatttattgtt

SEQ ID NO: 9295 - DNA, 20 bp, synthetic construct
  misc_feature 1..20: note = CRISPR gRNA sequence
  source 1..20: mol_type = other DNA
ttatttatttattgttgaga

SEQ ID NO: 9296 - DNA, 20 bp, synthetic construct
  misc_feature 1..20: note = CRISPR gRNA sequence
  source 1..20: mol_type = other DNA
atttatttattgttgagatg

SEQ ID NO: 9297 - DNA, 20 bp, synthetic construct
  misc_feature 1..20: note = CRISPR gRNA sequence
  source 1..20: mol_type = other DNA
tggagtctcactctgttgcc

SEQ ID NO: 9298 - DNA, 20 bp, synthetic construct
  misc_feature 1..20: note = CRISPR gRNA sequence
  source 1..20: mol_type = other DNA
ggagtctcactctgttgccc

SEQ ID NO: 9299 - DNA, 20 bp, synthetic construct
  misc_feature 1..20: note = CRISPR gRNA sequence
  source 1..20: mol_type = other DNA
tctcactctgttgcccaggc

SEQ ID NO: 9300 - DNA, 20 bp, synthetic construct
  misc_feature 1..20: note = CRISPR gRNA sequence
  source 1..20: mol_type = other DNA
tcactctgttgcccaggcta

SEQ ID NO: 9301 - DNA, 20 bp, synthetic construct
  misc_feature 1..20: note = CRISPR gRNA sequence
  source 1..20: mol_type = other DNA
ctgttgcccaggctagagtg

SEQ ID NO: 9302 - DNA, 20 bp, synthetic construct
  misc_feature 1..20: note = CRISPR gRNA sequence
  source 1..20: mol_type = other DNA
ttgcccaggctagagtgcag

SEQ ID NO: 9303 - DNA, 20 bp, synthetic construct
  misc_feature 1..20: note = CRISPR gRNA sequence
  source 1..20: mol_type = other DNA
agagtgcagtggtgcgatct

SEQ ID NO: 9304 - DNA, 20 bp, synthetic construct
  misc_feature 1..20: note = CRISPR gRNA sequence
  source 1..20: mol_type = other DNA
tcactgcaacctccgcccta

SEQ ID NO: 9305 - DNA, 20 bp, synthetic construct
  misc_feature 1..20: note = CRISPR gRNA sequence
  source 1..20: mol_type = other DNA
cactgcaacctccgccctac

SEQ ID NO: 9306 - DNA, 20 bp, synthetic construct
  misc_feature 1..20: note = CRISPR gRNA sequence
  source 1..20: mol_type = other DNA
aacctccgccctacaggttc

SEQ ID NO: 9307 - DNA, 20 bp, synthetic construct
  misc_feature 1..20: note = CRISPR gRNA sequence
  source 1..20: mol_type = other DNA
ttcaagtgattctcctgcct

SEQ ID NO: 9308 - DNA, 20 bp, synthetic construct
  misc_feature 1..20: note = CRISPR gRNA sequence
  source 1..20: mol_type = other DNA
gattctcctgcctcagcctc

SEQ ID NO: 9309 - DNA, 20 bp, synthetic construct
  misc_feature 1..20: note = CRISPR gRNA sequence
  source 1..20: mol_type = other DNA
ttctcctgcctcagcctccg

SEQ ID NO: 9310 - DNA, 20 bp, synthetic construct
  misc_feature 1..20: note = CRISPR gRNA sequence
  source 1..20: mol_type = other DNA
tcctgcctcagcctccggag

SEQ ID NO: 9311 - DNA, 20 bp, synthetic construct
  misc_feature 1..20: note = CRISPR gRNA sequence
  source 1..20: mol_type = other DNA
gcctcagcctccggagcagc

SEQ ID NO: 9312 - DNA, 20 bp, synthetic construct
  misc_feature 1..20: note = CRISPR gRNA sequence
  source 1..20: mol_type = other DNA
ctccggagcagctggaatta

SEQ ID NO: 9313 - DNA, 20 bp, synthetic construct
  misc_feature 1..20: note = CRISPR gRNA sequence
  source 1..20: mol_type = other DNA
tccggagcagctggaattac

SEQ ID NO: 9314 - DNA, 20 bp, synthetic construct
  misc_feature 1..20: note = CRISPR gRNA sequence
  source 1..20: mol_type = other DNA
caggtgtgcaccgtcacacc

SEQ ID NO: 9315 - DNA, 20 bp, synthetic construct
  misc_feature 1..20: note = CRISPR gRNA sequence
  source 1..20: mol_type = other DNA
ccagccaatttttgtaattt

SEQ ID NO: 9316 - DNA, 20 bp, synthetic construct
  misc_feature 1..20: note = CRISPR gRNA sequence
  source 1..20: mol_type = other DNA
gccaatttttgtaatttcag

SEQ ID NO: 9317 - DNA, 20 bp, synthetic construct
  misc_feature 1..20: note = CRISPR gRNA sequence
  source 1..20: mol_type = other DNA
caatttttgtaatttcagta

SEQ ID NO: 9318 - DNA, 20 bp, synthetic construct
  misc_feature 1..20: note = CRISPR gRNA sequence
  source 1..20: mol_type = other DNA
tttgtaatttcagtagagac

SEQ ID NO: 9319 - DNA, 20 bp, synthetic construct
  misc_feature 1..20: note = CRISPR gRNA sequence
  source 1..20: mol_type = other DNA
agagacaagtttaaccatgt

SEQ ID NO: 9320 - DNA, 20 bp, synthetic construct
  misc_feature 1..20: note = CRISPR gRNA sequence
  source 1..20: mol_type = other DNA
acaagtttaaccatgttggc

SEQ ID NO: 9321 - DNA, 20 bp, synthetic construct
  misc_feature 1..20: note = CRISPR gRNA sequence
  source 1..20: mol_type = other DNA
caagtttaaccatgttggcc

SEQ ID NO: 9322 - DNA, 20 bp, synthetic construct
  misc_feature 1..20: note = CRISPR gRNA sequence
  source 1..20: mol_type = other DNA
tttaaccatgttggccaggc

SEQ ID NO: 9323 - DNA, 20 bp, synthetic construct
  misc_feature 1..20: note = CRISPR gRNA sequence
  source 1..20: mol_type = other DNA
ggtctcgaactcctgatctc

SEQ ID NO: 9324 - DNA, 20 bp, synthetic construct
  misc_feature 1..20: note = CRISPR gRNA sequence
  source 1..20: mol_type = other DNA
ccacctgcctcgacctccca

SEQ ID NO: 9325 - DNA, 20 bp, synthetic construct
  misc_feature 1..20: note = CRISPR gRNA sequence
  source 1..20: mol_type = other DNA
gcctcgacctcccaaagtgc

SEQ ID NO: 9326 - DNA, 20 bp, synthetic construct
  misc_feature 1..20: note = CRISPR gRNA sequence
  source 1..20: mol_type = other DNA
cctcgacctcccaaagtgct

SEQ ID NO: 9327 - DNA, 20 bp, synthetic construct
  misc_feature 1..20: note = CRISPR gRNA sequence
  source 1..20: mol_type = other DNA
ctcccaaagtgctgggatta

SEQ ID NO: 9328 - DNA, 20 bp, synthetic construct
  misc_feature 1..20: note = CRISPR gRNA sequence
  source 1..20: mol_type = other DNA
tcccaaagtgctgggattac

SEQ ID NO: 9329 - DNA, 20 bp, synthetic construct
  misc_feature 1..20: note = CRISPR gRNA sequence
  source 1..20: mol_type = other DNA
agtgctgggattacaggtgt

SEQ ID NO: 9330 - DNA, 20 bp, synthetic construct
  misc_feature 1..20: note = CRISPR gRNA sequence
  source 1..20: mol_type = other DNA
caggtgtgagccactgcacc

SEQ ID NO: 9331 - DNA, 20 bp, synthetic construct
  misc_feature 1..20: note = CRISPR gRNA sequence
  source 1..20: mol_type = other DNA
cgattttcttttttaaacat

SEQ ID NO: 9332 - DNA, 20 bp, synthetic construct
  misc_feature 1..20: note = CRISPR gRNA sequence
  source 1..20: mol_type = other DNA
aacatgagtgaaatttttaa

SEQ ID NO: 9333 - DNA, 20 bp, synthetic construct
  misc_feature 1..20: note = CRISPR gRNA sequence
  source 1..20: mol_type = other DNA
gagtgaaatttttaaaagta

SEQ ID NO: 9334 - DNA, 20 bp, synthetic construct
  misc_feature 1..20: note = CRISPR gRNA sequence
  source 1..20: mol_type = other DNA
gaaatttttaaaagtacagt

SEQ ID NO: 9335 - DNA, 20 bp, synthetic construct
  misc_feature 1..20: note = CRISPR gRNA sequence
  source 1..20: mol_type = other DNA
tttaaaagtacagttggcca

SEQ ID NO: 9336 - DNA, 20 bp, synthetic construct
  misc_feature 1..20: note = CRISPR gRNA sequence
  source 1..20: mol_type = other DNA
aaagtacagttggccaaaga

SEQ ID NO: 9337 - DNA, 20 bp, synthetic construct
  misc_feature 1..20: note = CRISPR gRNA sequence
  source 1..20: mol_type = other DNA
ggccaaagaaagacatattt

SEQ ID NO: 9338 - DNA, 20 bp, synthetic construct
  misc_feature 1..20: note = CRISPR gRNA sequence
  source 1..20: mol_type = other DNA
aaagaaagacatatttgagt

SEQ ID NO: 9339 - DNA, 20 bp, synthetic construct
  misc_feature 1..20: note = CRISPR gRNA sequence
  source 1..20: mol_type = other DNA
agacatatttgagttagata

SEQ ID NO: 9340 - DNA, 20 bp, synthetic construct
  misc_feature 1..20: note = CRISPR gRNA sequence
  source 1..20: mol_type = other DNA
atttgagttagatacagcct

SEQ ID NO: 9341 - DNA, 20 bp, synthetic construct
  misc_feature 1..20: note = CRISPR gRNA sequence
  source 1..20: mol_type = other DNA
tttgagttagatacagcctc

SEQ ID NO: 9342 - DNA, 20 bp, synthetic construct
  misc_feature 1..20: note = CRISPR gRNA sequence
  source 1..20: mol_type = other DNA
ctatcttataacctccatct

SEQ ID NO: 9343 - DNA, 20 bp, synthetic construct
  misc_feature 1..20: note = CRISPR gRNA sequence
  source 1..20: mol_type = other DNA
tatcttataacctccatctt

SEQ ID NO: 9344 - DNA, 20 bp, synthetic construct
  misc_feature 1..20: note = CRISPR gRNA sequence
  source 1..20: mol_type = other DNA
aacctccatcttgggaaact

SEQ ID NO: 9345 - DNA, 20 bp, synthetic construct
  misc_feature 1..20: note = CRISPR gRNA sequence
  source 1..20: mol_type = other DNA
cttgggaaactcagcccatg

SEQ ID NO: 9346 - DNA, 20 bp, synthetic construct
  misc_feature 1..20: note = CRISPR gRNA sequence
  source 1..20: mol_type = other DNA
ttgggaaactcagcccatga

SEQ ID NO: 9347 - DNA, 20 bp, synthetic construct
  misc_feature 1..20: note = CRISPR gRNA sequence
  source 1..20: mol_type = other DNA
actcagcccatgaaggctgt

SEQ ID NO: 9348 - DNA, 20 bp, synthetic construct
  misc_feature 1..20: note = CRISPR gRNA sequence
  source 1..20: mol_type = other DNA
ctcagcccatgaaggctgta

SEQ ID NO: 9349 - DNA, 20 bp, synthetic construct
  misc_feature 1..20: note = CRISPR gRNA sequence
  source 1..20: mol_type = other DNA
ccatgaaggctgtaaggact

SEQ ID NO: 9350 - DNA, 20 bp, synthetic construct
  misc_feature 1..20: note = CRISPR gRNA sequence
  source 1..20: mol_type = other DNA
tgaaggctgtaaggactaag

SEQ ID NO: 9351 - DNA, 20 bp, synthetic construct
  misc_feature 1..20: note = CRISPR gRNA sequence
  source 1..20: mol_type = other DNA
gctgtaaggactaagtggcc

SEQ ID NO: 9352 - DNA, 20 bp, synthetic construct
  misc_feature 1..20: note = CRISPR gRNA sequence
  source 1..20: mol_type = other DNA
tgtaaggactaagtggccca

SEQ ID NO: 9353 - DNA, 20 bp, synthetic construct
  misc_feature 1..20: note = CRISPR gRNA sequence
  source 1..20: mol_type = other DNA
gtaaggactaagtggcccag

SEQ ID NO: 9354 - DNA, 20 bp, synthetic construct
  misc_feature 1..20: note = CRISPR gRNA sequence
  source 1..20: mol_type = other DNA
taaggactaagtggcccaga

SEQ ID NO: 9355 - DNA, 20 bp, synthetic construct
  misc_feature 1..20: note = CRISPR gRNA sequence
  source 1..20: mol_type = other DNA
aggactaagtggcccagagg

SEQ ID NO: 9356 - DNA, 20 bp, synthetic construct
  misc_feature 1..20: note = CRISPR gRNA sequence
  source 1..20: mol_type = other DNA
ggactaagtggcccagaggg

SEQ ID NO: 9357 - DNA, 20 bp, synthetic construct
  misc_feature 1..20: note = CRISPR gRNA sequence
  source 1..20: mol_type = other DNA
gactaagtggcccagaggga

SEQ ID NO: 9358 - DNA, 20 bp, synthetic construct
  misc_feature 1..20: note = CRISPR gRNA sequence
  source 1..20: mol_type = other DNA
actaagtggcccagagggag

SEQ ID NO: 9359 - DNA, 20 bp, synthetic construct
  misc_feature 1..20: note = CRISPR gRNA sequence
  source 1..20: mol_type = other DNA
ctaagtggcccagagggagg

SEQ ID NO: 9360 - DNA, 20 bp, synthetic construct
  misc_feature 1..20: note = CRISPR gRNA sequence
  source 1..20: mol_type = other DNA
taagtggcccagagggaggg

SEQ ID NO: 9361 - DNA, 20 bp, synthetic construct
  misc_feature 1..20: note = CRISPR gRNA sequence
  source 1..20: mol_type = other DNA
cccagagggaggggggtccc

SEQ ID NO: 9362 - DNA, 20 bp, synthetic construct
  misc_feature 1..20: note = CRISPR gRNA sequence
  source 1..20: mol_type = other DNA
ccagagggaggggggtcccc

SEQ ID NO: 9363 - DNA, 20 bp, synthetic construct
  misc_feature 1..20: note = CRISPR gRNA sequence
  source 1..20: mol_type = other DNA
cagagggaggggggtcccca

SEQ ID NO: 9364 - DNA, 20 bp, synthetic construct
  misc_feature 1..20: note = CRISPR gRNA sequence
  source 1..20: mol_type = other DNA
agagggaggggggtccccag

SEQ ID NO: 9365 - DNA, 20 bp, synthetic construct
  misc_feature 1..20: note = CRISPR gRNA sequence
  source 1..20: mol_type = other DNA
ggtaaccctcaccctaaatc

SEQ ID NO: 9366 - DNA, 20 bp, synthetic construct
  misc_feature 1..20: note = CRISPR gRNA sequence
  source 1..20: mol_type = other DNA
ggcacctgcttctccatctc

SEQ ID NO: 9367 - DNA, 20 bp, synthetic construct
  misc_feature 1..20: note = CRISPR gRNA sequence
  source 1..20: mol_type = other DNA
cacctgcttctccatctcca

SEQ ID NO: 9368 - DNA, 20 bp, synthetic construct
  misc_feature 1..20: note = CRISPR gRNA sequence
  source 1..20: mol_type = other DNA
cttctccatctccagagcac

SEQ ID NO: 9369 - DNA, 20 bp, synthetic construct
  misc_feature 1..20: note = CRISPR gRNA sequence
  source 1..20: mol_type = other DNA
gacgtcccccacccaatgcc

SEQ ID NO: 9370 - DNA, 20 bp, synthetic construct
  misc_feature 1..20: note = CRISPR gRNA sequence
  source 1..20: mol_type = other DNA
gtcccccacccaatgcccgg

SEQ ID NO: 9371 - DNA, 20 bp, synthetic construct
  misc_feature 1..20: note = CRISPR gRNA sequence
  source 1..20: mol_type = other DNA
cccacccaatgcccggcagc

SEQ ID NO: 9372 - DNA, 20 bp, synthetic construct
  misc_feature 1..20: note = CRISPR gRNA sequence
  source 1..20: mol_type = other DNA
cacccaatgcccggcagctg

SEQ ID NO: 9373 - DNA, 20 bp, synthetic construct
  misc_feature 1..20: note = CRISPR gRNA sequence
  source 1..20: mol_type = other DNA
cccaatgcccggcagctgga

SEQ ID NO: 9374 - DNA, 20 bp, synthetic construct
  misc_feature 1..20: note = CRISPR gRNA sequence
  source 1..20: mol_type = other DNA
ccaatgcccggcagctggag

SEQ ID NO: 9375 - DNA, 20 bp, synthetic construct
  misc_feature 1..20: note = CRISPR gRNA sequence
  source 1..20: mol_type = other DNA
cagctggagaggtctccaac

SEQ ID NO: 9376 - DNA, 20 bp, synthetic construct
  misc_feature 1..20: note = CRISPR gRNA sequence
  source 1..20: mol_type = other DNA
tctccaacaagcttccaaaa

SEQ ID NO: 9377 - DNA, 20 bp, synthetic construct
  misc_feature 1..20: note = CRISPR gRNA sequence
  source 1..20: mol_type = other DNA
aacaagcttccaaaatggcc

SEQ ID NO: 9378 - DNA, 20 bp, synthetic construct
  misc_feature 1..20: note = CRISPR gRNA sequence
  source 1..20: mol_type = other DNA
agcttccaaaatggcctggt

SEQ ID NO: 9379 - DNA, 20 bp, synthetic construct
  misc_feature 1..20: note = CRISPR gRNA sequence
  source 1..20: mol_type = other DNA
aaatggcctggtgagtgatg

SEQ ID NO: 9380 - DNA, 20 bp, synthetic construct
  misc_feature 1..20: note = CRISPR gRNA sequence
  source 1..20: mol_type = other DNA
aatggcctggtgagtgatgc

SEQ ID NO: 9381 - DNA, 20 bp, synthetic construct
  misc_feature 1..20: note = CRISPR gRNA sequence
  source 1..20: mol_type = other DNA
gatgcgggatctctctgccc

SEQ ID NO: 9382 - DNA, 20 bp, synthetic construct
  misc_feature 1..20: note = CRISPR gRNA sequence
  source 1..20: mol_type = other DNA
atgcgggatctctctgccct

SEQ ID NO: 9383 - DNA, 20 bp, synthetic construct
  misc_feature 1..20: note = CRISPR gRNA sequence
  source 1..20: mol_type = other DNA
cgggatctctctgccctggg

SEQ ID NO: 9384 - DNA, 20 bp, synthetic construct
  misc_feature 1..20: note = CRISPR gRNA sequence
  source 1..20: mol_type = other DNA
gatctctctgccctgggtgg

SEQ ID NO: 9385 - DNA, 20 bp, synthetic construct
  misc_feature 1..20: note = CRISPR gRNA sequence
  source 1..20: mol_type = other DNA
tctctctgccctgggtggtg

SEQ ID NO: 9386 - DNA, 20 bp, synthetic construct
  misc_feature 1..20: note = CRISPR gRNA sequence
  source 1..20: mol_type = other DNA
tctgccctgggtggtggaga

SEQ ID NO: 9387 - DNA, 20 bp, synthetic construct
  misc_feature 1..20: note = CRISPR gRNA sequence
  source 1..20: mol_type = other DNA
gccctgggtggtggagatgg

SEQ ID NO: 9388 - DNA, 20 bp, synthetic construct
  misc_feature 1..20: note = CRISPR gRNA sequence
  source 1..20: mol_type = other DNA
tggagatggaagcccatatc

SEQ ID NO: 9389 - DNA, 20 bp, synthetic construct
  misc_feature 1..20: note = CRISPR gRNA sequence
  source 1..20: mol_type = other DNA
ttattcaaccccttctttgt

SEQ ID NO: 9390 - DNA, 20 bp, synthetic construct
  misc_feature 1..20: note = CRISPR gRNA sequence
  source 1..20: mol_type = other DNA
aatatttattgcccttcaat

SEQ ID NO: 9391 - DNA, 20 bp, synthetic construct
  misc_feature 1..20: note = CRISPR gRNA sequence
  source 1..20: mol_type = other DNA
gcccttcaataagcctgcac

SEQ ID NO: 9392 - DNA, 20 bp, synthetic construct
  misc_feature 1..20: note = CRISPR gRNA sequence
  source 1..20: mol_type = other DNA
cccttcaataagcctgcact

SEQ ID NO: 9393 - DNA, 20 bp, synthetic construct
  misc_feature 1..20: note = CRISPR gRNA sequence
  source 1..20: mol_type = other DNA
gggtgttaacacttcattgt

SEQ ID NO: 9394 - DNA, 20 bp, synthetic construct
  misc_feature 1..20: note = CRISPR gRNA sequence
  source 1..20: mol_type = other DNA
ggtgttaacacttcattgtc

SEQ ID NO: 9395 - DNA, 20 bp, synthetic construct
  misc_feature 1..20: note = CRISPR gRNA sequence
  source 1..20: mol_type = other DNA
taacacttcattgtcaggct

SEQ ID NO: 9396 - DNA, 20 bp, synthetic construct
  misc_feature 1..20: note = CRISPR gRNA sequence
  source 1..20: mol_type = other DNA
acacttcattgtcaggctga

SEQ ID NO: 9397 - DNA, 20 bp, synthetic construct
  misc_feature 1..20: note = CRISPR gRNA sequence
  source 1..20: mol_type = other DNA
gtcaggctgagagaatgaat

SEQ ID NO: 9398 - DNA, 20 bp, synthetic construct
  misc_feature 1..20: note = CRISPR gRNA sequence
  source 1..20: mol_type = other DNA
tcaggctgagagaatgaatg

SEQ ID NO: 9399 - DNA, 20 bp, synthetic construct
  misc_feature 1..20: note = CRISPR gRNA sequence
  source 1..20: mol_type = other DNA
caggctgagagaatgaatga

SEQ ID NO: 9400 - DNA, 20 bp, synthetic construct
  misc_feature 1..20: note = CRISPR gRNA sequence
  source 1..20: mol_type = other DNA
aggctgagagaatgaatgag

SEQ ID NO: 9401 - DNA, 20 bp, synthetic construct
  misc_feature 1..20: note = CRISPR gRNA sequence
  source 1..20: mol_type = other DNA
tgagagaatgaatgaggggc

SEQ ID NO: 9402 - DNA, 20 bp, synthetic construct
  misc_feature 1..20: note = CRISPR gRNA sequence
  source 1..20: mol_type = other DNA
tgaggggcaagcgaatgatg

SEQ ID NO: 9403 - DNA, 20 bp, synthetic construct
  misc_feature 1..20: note = CRISPR gRNA sequence
  source 1..20: mol_type = other DNA
gggcaagcgaatgatgaagt

SEQ ID NO: 9404 - DNA, 20 bp, synthetic construct
  misc_feature 1..20: note = CRISPR gRNA sequence
  source 1..20: mol_type = other DNA
aagcgaatgatgaagtgagt

SEQ ID NO: 9405 - DNA, 20 bp, synthetic construct
  misc_feature 1..20: note = CRISPR gRNA sequence
  source 1..20: mol_type = other DNA
cgaatgatgaagtgagtgag

SEQ ID NO: 9406 - DNA, 20 bp, synthetic construct
  misc_feature 1..20: note = CRISPR gRNA sequence
  source 1..20: mol_type = other DNA
atgaagtgagtgagtggatg

SEQ ID NO: 9407 - DNA, 20 bp, synthetic construct
  misc_feature 1..20: note = CRISPR gRNA sequence
  source 1..20: mol_type = other DNA
agtgagtgagtggatgaagt

SEQ ID NO: 9408 - DNA, 20 bp, synthetic construct
  misc_feature 1..20: note = CRISPR gRNA sequence
  source 1..20: mol_type = other DNA
gagtgagtggatgaagtgag

SEQ ID NO: 9409 - DNA, 20 bp, synthetic construct
  misc_feature 1..20: note = CRISPR gRNA sequence
  source 1..20: mol_type = other DNA
ggatgaagtgagaagttgat

SEQ ID NO: 9410 - DNA, 20 bp, synthetic construct
  misc_feature 1..20: note = CRISPR gRNA sequence
  source 1..20: mol_type = other DNA
gatgaagtgagaagttgatg

SEQ ID NO: 9411 - DNA, 20 bp, synthetic construct
  misc_feature 1..20: note = CRISPR gRNA sequence
  source 1..20: mol_type = other DNA
aagtgagaagttgatgagga

SEQ ID NO: 9412 - DNA, 20 bp, synthetic construct
  misc_feature 1..20: note = CRISPR gRNA sequence
  source 1..20: mol_type = other DNA
agtgagaagttgatgaggat

SEQ ID NO: 9413 - DNA, 20 bp, synthetic construct
  misc_feature 1..20: note = CRISPR gRNA sequence
  source 1..20: mol_type = other DNA
tgagaagttgatgaggatgg

SEQ ID NO: 9414 - DNA, 20 bp, synthetic construct
  misc_feature 1..20: note = CRISPR gRNA sequence
  source 1..20: mol_type = other DNA
gttgatgaggatgggagcaa

SEQ ID NO: 9415 - DNA, 20 bp, synthetic construct
  misc_feature 1..20: note = CRISPR gRNA sequence
  source 1..20: mol_type = other DNA
atgaggatgggagcaatgga

SEQ ID NO: 9416 - DNA, 20 bp, synthetic construct
  misc_feature 1..20: note = CRISPR gRNA sequence
  source 1..20: mol_type = other DNA
aggatgggagcaatggaaag

SEQ ID NO: 9417 - DNA, 20 bp, synthetic construct
  misc_feature 1..20: note = CRISPR gRNA sequence
  source 1..20: mol_type = other DNA
ggatgggagcaatggaaagt

SEQ ID NO: 9418 - DNA, 20 bp, synthetic construct
  misc_feature 1..20: note = CRISPR gRNA sequence
  source 1..20: mol_type = other DNA
aatggaaagtgggaataaac

SEQ ID NO: 9419 - DNA, 20 bp, synthetic construct
  misc_feature 1..20: note = CRISPR gRNA sequence
  source 1..20: mol_type = other DNA
gtgggaataaaccagtgaat

SEQ ID NO: 9420 - DNA, 20 bp, synthetic construct
  misc_feature 1..20: note = CRISPR gRNA sequence
  source 1..20: mol_type = other DNA
gggaataaaccagtgaataa

SEQ ID NO: 9421 - DNA, 20 bp, synthetic construct
  misc_feature 1..20: note = CRISPR gRNA sequence
  source 1..20: mol_type = other DNA
aaatgcttactctcacatac

SEQ ID NO: 9422 - DNA, 20 bp, synthetic construct
  misc_feature 1..20: note = CRISPR gRNA sequence
  source 1..20: mol_type = other DNA
ttactctcacatactggtct

SEQ ID NO: 9423 - DNA, 20 bp, synthetic construct
  misc_feature 1..20: note = CRISPR gRNA sequence
  source 1..20: mol_type = other DNA
acatactggtctaagcatgt

SEQ ID NO: 9424 - DNA, 20 bp, synthetic construct
  misc_feature 1..20: note = CRISPR gRNA sequence
  source 1..20: mol_type = other DNA
catactggtctaagcatgtt

SEQ ID NO: 9425 - DNA, 20 bp, synthetic construct
  misc_feature 1..20: note = CRISPR gRNA sequence
  source 1..20: mol_type = other DNA
ccaatattatccccattttc

SEQ ID NO: 9426 - DNA, 20 bp, synthetic construct
  misc_feature 1..20: note = CRISPR gRNA sequence
  source 1..20: mol_type = other DNA
attatccccattttccagat

SEQ ID NO: 9427 - DNA, 20 bp, synthetic construct
  misc_feature 1..20: note = CRISPR gRNA sequence
  source 1..20: mol_type = other DNA
ttatccccattttccagatg

SEQ ID NO: 9428 - DNA, 20 bp, synthetic construct
  misc_feature 1..20: note = CRISPR gRNA sequence
  source 1..20: mol_type = other DNA
attttccagatgaggctact

SEQ ID NO: 9429 - DNA, 20 bp, synthetic construct
  misc_feature 1..20: note = CRISPR gRNA sequence
  source 1..20: mol_type = other DNA
ttttccagatgaggctactg

SEQ ID NO: 9430 - DNA, 20 bp, synthetic construct
  misc_feature 1..20: note = CRISPR gRNA sequence
  source 1..20: mol_type = other DNA
cagatgaggctactgaggca

SEQ ID NO: 9431 - DNA, 20 bp, synthetic construct
  misc_feature 1..20: note = CRISPR gRNA sequence
  source 1..20: mol_type = other DNA
atgaggctactgaggcatgg

SEQ ID NO: 9432 - DNA, 20 bp, synthetic construct
  misc_feature 1..20: note = CRISPR gRNA sequence
  source 1..20: mol_type = other DNA
tgaggctactgaggcatggt

SEQ ID NO: 9433 - DNA, 20 bp, synthetic construct
  misc_feature 1..20: note = CRISPR gRNA sequence
  source 1..20: mol_type = other DNA
ctgaggcatggtgggatgta

SEQ ID NO: 9434 - DNA, 20 bp, synthetic construct
  misc_feature 1..20: note = CRISPR gRNA sequence
  source 1..20: mol_type = other DNA
ggtgggatgtatagcatgct

SEQ ID NO: 9435 - DNA, 20 bp, synthetic construct
  misc_feature 1..20: note = CRISPR gRNA sequence
  source 1..20: mol_type = other DNA
tagcatgctcagaattgctc

SEQ ID NO: 9436 - DNA, 20 bp, synthetic construct
  misc_feature 1..20: note = CRISPR gRNA sequence
  source 1..20: mol_type = other DNA
atgctcagaattgctccagc

SEQ ID NO: 9437 - DNA, 20 bp, synthetic construct
  misc_feature 1..20: note = CRISPR gRNA sequence
  source 1..20: mol_type = other DNA
ctcagaattgctccagcaag

SEQ ID NO: 9438 - DNA, 20 bp, synthetic construct
  misc_feature 1..20: note = CRISPR gRNA sequence
  source 1..20: mol_type = other DNA
agaattgctccagcaagtgg

SEQ ID NO: 9439 - DNA, 20 bp, synthetic construct
  misc_feature 1..20: note = CRISPR gRNA sequence
  source 1..20: mol_type = other DNA
gctccagcaagtggtagaac

SEQ ID NO: 9440 - DNA, 20 bp, synthetic construct
  misc_feature 1..20: note = CRISPR gRNA sequence
  source 1..20: mol_type = other DNA
ctccagcaagtggtagaacc

SEQ ID NO: 9441 - DNA, 20 bp, synthetic construct
  misc_feature 1..20: note = CRISPR gRNA sequence
  source 1..20: mol_type = other DNA
gtagaaccgggatttgaacc

SEQ ID NO: 9442 - DNA, 20 bp, synthetic construct
  misc_feature 1..20: note = CRISPR gRNA sequence
  source 1..20: mol_type = other DNA
gggatttgaacccagacacg

SEQ ID NO: 9443 - DNA, 20 bp, synthetic construct
  misc_feature 1..20: note = CRISPR gRNA sequence
  source 1..20: mol_type = other DNA
ggatttgaacccagacacgt

SEQ ID NO: 9444 - DNA, 20 bp, synthetic construct
  misc_feature 1..20: note = CRISPR gRNA sequence
  source 1..20: mol_type = other DNA
tccctcccatgacctcccca

SEQ ID NO: 9445 - DNA, 20 bp, synthetic construct
  misc_feature 1..20: note = CRISPR gRNA sequence
  source 1..20: mol_type = other DNA
tcccatgacctccccatggt

SEQ ID NO: 9446 - DNA, 20 bp, synthetic construct
  misc_feature 1..20: note = CRISPR gRNA sequence
  source 1..20: mol_type = other DNA
atgacctccccatggtgagt

SEQ ID NO: 9447 - DNA, 20 bp, synthetic construct
  misc_feature 1..20: note = CRISPR gRNA sequence
  source 1..20: mol_type = other DNA
acctccccatggtgagtgag

SEQ ID NO: 9448 - DNA, 20 bp, synthetic construct
  misc_feature 1..20: note = CRISPR gRNA sequence
  source 1..20: mol_type = other DNA
atggtgagtgagtagtgatc

SEQ ID NO: 9449 - DNA, 20 bp, synthetic construct
  misc_feature 1..20: note = CRISPR gRNA sequence
  source 1..20: mol_type = other DNA
gagtgagtagtgatcaagcg

SEQ ID NO: 9450 - DNA, 20 bp, synthetic construct
  misc_feature 1..20: note = CRISPR gRNA sequence
  source 1..20: mol_type = other DNA
gtagtgatcaagcgaagaaa

SEQ ID NO: 9451 - DNA, 20 bp, synthetic construct
  misc_feature 1..20: note = CRISPR gRNA sequence
  source 1..20: mol_type = other DNA
gatcaagcgaagaaaaagct

SEQ ID NO: 9452 - DNA, 20 bp, synthetic construct
  misc_feature 1..20: note = CRISPR gRNA sequence
  source 1..20: mol_type = other DNA
aagcgaagaaaaagcttagt

SEQ ID NO: 9453 - DNA, 20 bp, synthetic construct
  misc_feature 1..20: note = CRISPR gRNA sequence
  source 1..20: mol_type = other DNA
aaaagcttagtgagtaaatg

SEQ ID NO: 9454 - DNA, 20 bp, synthetic construct
  misc_feature 1..20: note = CRISPR gRNA sequence
  source 1..20: mol_type = other DNA
aaagcttagtgagtaaatga

SEQ ID NO: 9455 - DNA, 20 bp, synthetic construct
  misc_feature 1..20: note = CRISPR gRNA sequence
  source 1..20: mol_type = other DNA
tagtgagtaaatgaaggaat

SEQ ID NO: 9456 - DNA, 20 bp, synthetic construct
  misc_feature 1..20: note = CRISPR gRNA sequence
  source 1..20: mol_type = other DNA
agtaaatgaaggaatgagaa

SEQ ID NO: 9457 - DNA, 20 bp, synthetic construct
  misc_feature 1..20: note = CRISPR gRNA sequence
  source 1..20: mol_type = other DNA
aatgaaggaatgagaaaaga

SEQ ID NO: 9458 - DNA, 20 bp, synthetic construct
  misc_feature 1..20: note = CRISPR gRNA sequence
  source 1..20: mol_type = other DNA
tgagaaaagatggccatgca

SEQ ID NO: 9459 - DNA, 20 bp, synthetic construct
  misc_feature 1..20: note = CRISPR gRNA sequence
  source 1..20: mol_type = other DNA
gtgccttatgcctgtaatcc

SEQ ID NO: 9460 - DNA, 20 bp, synthetic construct
  misc_feature 1..20: note = CRISPR gRNA sequence
  source 1..20: mol_type = other DNA
tgcctgtaatcccagcactt

SEQ ID NO: 9461 - DNA, 20 bp, synthetic construct
  misc_feature 1..20: note = CRISPR gRNA sequence
  source 1..20: mol_type = other DNA
gcctgtaatcccagcacttt

SEQ ID NO: 9462 - DNA, 20 bp, synthetic construct
  misc_feature 1..20: note = CRISPR gRNA sequence
  source 1..20: mol_type = other DNA
ctgtaatcccagcactttgg

SEQ ID NO: 9463 - DNA, 20 bp, synthetic construct
  misc_feature 1..20: note = CRISPR gRNA sequence
  source 1..20: mol_type = other DNA
tgtaatcccagcactttggg

SEQ ID NO: 9464 - DNA, 20 bp, synthetic construct
  misc_feature 1..20: note = CRISPR gRNA sequence
  source 1..20: mol_type = other DNA
tcccagcactttgggaggcc

SEQ ID NO: 9465 - DNA, 20 bp, synthetic construct
  misc_feature 1..20: note = CRISPR gRNA sequence
  source 1..20: mol_type = other DNA
cccagcactttgggaggcca

SEQ ID NO: 9466 - DNA, 20 bp, synthetic construct
  misc_feature 1..20: note = CRISPR gRNA sequence
  source 1..20: mol_type = other DNA
agcactttgggaggccaagg

SEQ ID NO: 9467 - DNA, 20 bp, synthetic construct
  misc_feature 1..20: note = CRISPR gRNA sequence
  source 1..20: mol_type = other DNA
gcactttgggaggccaaggc

SEQ ID NO: 9468 - DNA, 20 bp, synthetic construct
  misc_feature 1..20: note = CRISPR gRNA sequence
  source 1..20: mol_type = other DNA
ctttgggaggccaaggcagg

SEQ ID NO: 9469 - DNA, 20 bp, synthetic construct
  misc_feature 1..20: note = CRISPR gRNA sequence
  source 1..20: mol_type = other DNA
ccaaggcaggtggatcacct

SEQ ID NO: 9470 - DNA, 20 bp, synthetic construct
  misc_feature 1..20: note = CRISPR gRNA sequence
  source 1..20: mol_type = other DNA
caaggcaggtggatcacctg

SEQ ID NO: 9471 - DNA, 20 bp, synthetic construct
  misc_feature 1..20: note = CRISPR gRNA sequence
  source 1..20: mol_type = other DNA
gcaggtggatcacctgaggt

SEQ ID NO: 9472 - DNA, 20 bp, synthetic construct
  misc_feature 1..20: note = CRISPR gRNA sequence
  source 1..20: mol_type = other DNA
caggtggatcacctgaggtc

SEQ ID NO: 9473 - DNA, 20 bp, synthetic construct
  misc_feature 1..20: note = CRISPR gRNA sequence
  source 1..20: mol_type = other DNA
ggtggatcacctgaggtcag

SEQ ID NO: 9474 - DNA, 20 bp, synthetic construct
  misc_feature 1..20: note = CRISPR gRNA sequence
  source 1..20: mol_type = other DNA
tcacctgaggtcaggagttc

SEQ ID NO: 9475 - DNA, 20 bp, synthetic construct
  misc_feature 1..20: note = CRISPR gRNA sequence
  source 1..20: mol_type = other DNA
tgaggtcaggagttcgagac

SEQ ID NO: 9476 - DNA, 20 bp, synthetic construct
  misc_feature 1..20: note = CRISPR gRNA sequence
  source 1..20: mol_type = other DNA
tcaggagttcgagaccagcc

SEQ ID NO: 9477 - DNA, 20 bp, synthetic construct
  misc_feature 1..20: note = CRISPR gRNA sequence
  source 1..20: mol_type = other DNA
cgagaccagcctggccaaca

SEQ ID NO: 9478 - DNA, 20 bp, synthetic construct
  misc_feature 1..20: note = CRISPR gRNA sequence
  source 1..20: mol_type = other DNA
ccattaaaaaatacaaaaat

SEQ ID NO: 9479 - DNA, 20 bp, synthetic construct
  misc_feature 1..20: note = CRISPR gRNA sequence
  source 1..20: mol_type = other DNA
taaaaaatacaaaaattagc

SEQ ID NO: 9480 - DNA, 20 bp, synthetic construct
  misc_feature 1..20: note = CRISPR gRNA sequence
  source 1..20: mol_type = other DNA
atacaaaaattagccagacg

SEQ ID NO: 9481 - DNA, 20 bp, synthetic construct
  misc_feature 1..20: note = CRISPR gRNA sequence
  source 1..20: mol_type = other DNA
caaaaattagccagacgtgg

SEQ ID NO: 9482 - DNA, 20 bp, synthetic construct
  misc_feature 1..20: note = CRISPR gRNA sequence
  source 1..20: mol_type = other DNA
aaattagccagacgtggtag

SEQ ID NO: 9483 - DNA, 20 bp, synthetic construct
  misc_feature 1..20: note = CRISPR gRNA sequence
  source 1..20: mol_type = other DNA
aattagccagacgtggtagt

SEQ ID NO: 9484 - DNA, 20 bp, synthetic construct
  misc_feature 1..20: note = CRISPR gRNA sequence
  source 1..20: mol_type = other DNA
gtagtgggtgcctgtaatcc

SEQ ID NO: 9485 - DNA, 20 bp, synthetic construct
  misc_feature 1..20: note = CRISPR gRNA sequence
  source 1..20: mol_type = other DNA
tgcctgtaatcccagctact

SEQ ID NO: 9486 - DNA, 20 bp, synthetic construct
  misc_feature 1..20: note = CRISPR gRNA sequence
  source 1..20: mol_type = other DNA
ctgtaatcccagctacttgg

SEQ ID NO: 9487 - DNA, 20 bp, synthetic construct
  misc_feature 1..20: note = CRISPR gRNA sequence
  source 1..20: mol_type = other DNA
tgtaatcccagctacttggc

SEQ ID NO: 9488 - DNA, 20 bp, synthetic construct
  misc_feature 1..20: note = CRISPR gRNA sequence
  source 1..20: mol_type = other DNA
tcccagctacttggcaggcc

SEQ ID NO: 9489 - DNA, 20 bp, synthetic construct
  misc_feature 1..20: note = CRISPR gRNA sequence
  source 1..20: mol_type = other DNA
cccagctacttggcaggccg

SEQ ID NO: 9490 - DNA, 20 bp, synthetic construct
  misc_feature 1..20: note = CRISPR gRNA sequence
  source 1..20: mol_type = other DNA
agctacttggcaggccgagg

SEQ ID NO: 9491 - DNA, 20 bp, synthetic construct
  misc_feature 1..20: note = CRISPR gRNA sequence
  source 1..20: mol_type = other DNA
gctacttggcaggccgaggc

SEQ ID NO: 9492 - DNA, 20 bp, synthetic construct
  misc_feature 1..20: note = CRISPR gRNA sequence
  source 1..20: mol_type = other DNA
tacttggcaggccgaggcag

SEQ ID NO: 9493 - DNA, 20 bp, synthetic construct
  misc_feature 1..20: note = CRISPR gRNA sequence
  source 1..20: mol_type = other DNA
gcaggagaatcgcctaaacc

SEQ ID NO: 9494 - DNA, 20 bp, synthetic construct
  misc_feature 1..20: note = CRISPR gRNA sequence
  source 1..20: mol_type = other DNA
caggagaatcgcctaaaccc

SEQ ID NO: 9495 - DNA, 20 bp, synthetic construct
  misc_feature 1..20: note = CRISPR gRNA sequence
  source 1..20: mol_type = other DNA
ggagaatcgcctaaacccag

SEQ ID NO: 9496 - DNA, 20 bp, synthetic construct
  misc_feature 1..20: note = CRISPR gRNA sequence
  source 1..20: mol_type = other DNA
gagaatcgcctaaacccagg

SEQ ID NO: 9497 - DNA, 20 bp, synthetic construct
  misc_feature 1..20: note = CRISPR gRNA sequence
  source 1..20: mol_type = other DNA
aatcgcctaaacccaggagg

SEQ ID NO: 9498 - DNA, 20 bp, synthetic construct
  misc_feature 1..20: note = CRISPR gRNA sequence
  source 1..20: mol_type = other DNA
tcgcctaaacccaggaggtg

SEQ ID NO: 9499 - DNA, 20 bp, synthetic construct
  misc_feature 1..20: note = CRISPR gRNA sequence
  source 1..20: mol_type = other DNA
cgcctaaacccaggaggtgg

SEQ ID NO: 9500 - DNA, 20 bp, synthetic construct
  misc_feature 1..20: note = CRISPR gRNA sequence
  source 1..20: mol_type = other DNA
caggaggtggaggttgccgt

SEQ ID NO: 9501 - DNA, 20 bp, synthetic construct
  misc_feature 1..20: note = CRISPR gRNA sequence
  source 1..20: mol_type = other DNA
ggtggaggttgccgtgagct

SEQ ID NO: 9502 - DNA, 20 bp, synthetic construct
  misc_feature 1..20: note = CRISPR gRNA sequence
  source 1..20: mol_type = other DNA
gccgtgagctgagattgcgc

SEQ ID NO: 9503 - DNA, 20 bp, synthetic construct
  misc_feature 1..20: note = CRISPR gRNA sequence
  source 1..20: mol_type = other DNA
gagattgcgccagtgcactc

SEQ ID NO: 9504 - DNA, 20 bp, synthetic construct
  misc_feature 1..20: note = CRISPR gRNA sequence
  source 1..20: mol_type = other DNA
tgcgccagtgcactccagcc

SEQ ID NO: 9505 - DNA, 20 bp, synthetic construct
  misc_feature 1..20: note = CRISPR gRNA sequence
  source 1..20: mol_type = other DNA
gcgccagtgcactccagcct

SEQ ID NO: 9506 - DNA, 20 bp, synthetic construct
  misc_feature 1..20: note = CRISPR gRNA sequence
  source 1..20: mol_type = other DNA
cgccagtgcactccagcctg

SEQ ID NO: 9507 - DNA, 20 bp, synthetic construct
  misc_feature 1..20: note = CRISPR gRNA sequence
  source 1..20: mol_type = other DNA
gtgcactccagcctggggca

SEQ ID NO: 9508 - DNA, 20 bp, synthetic construct
  misc_feature 1..20: note = CRISPR gRNA sequence
  source 1..20: mol_type = other DNA
tgcactccagcctggggcac

SEQ ID NO: 9509 - DNA, 20 bp, synthetic construct
  misc_feature 1..20: note = CRISPR gRNA sequence
  source 1..20: mol_type = other DNA
gcactccagcctggggcaca

SEQ ID NO: 9510 - DNA, 20 bp, synthetic construct
  misc_feature 1..20: note = CRISPR gRNA sequence
  source 1..20: mol_type = other DNA
ctccagcctggggcacaggg

SEQ ID NO: 9511 - DNA, 20 bp, synthetic construct
  misc_feature 1..20: note = CRISPR gRNA sequence
  source 1..20: mol_type = other DNA
tccagcctggggcacagggc

SEQ ID NO: 9512 - DNA, 20 bp, synthetic construct
  misc_feature 1..20: note = CRISPR gRNA sequence
  source 1..20: mol_type = other DNA
gatccatctcaaaaaaaaaa

SEQ ID NO: 9513 - DNA, 20 bp, synthetic construct
  misc_feature 1..20: note = CRISPR gRNA sequence
  source 1..20: mol_type = other DNA
tccatctcaaaaaaaaaaaa

SEQ ID NO: 9514 - DNA, 20 bp, synthetic construct
  misc_feature 1..20: note = CRISPR gRNA sequence
  source 1..20: mol_type = other DNA
catctcaaaaaaaaaaaaga

SEQ ID NO: 9515 - DNA, 20 bp, synthetic construct
  misc_feature 1..20: note = CRISPR gRNA sequence
  source 1..20: mol_type = other DNA
caaaaaaaaaaaagagagaa

SEQ ID NO: 9516 - DNA, 20 bp, synthetic construct
  misc_feature 1..20: note = CRISPR gRNA sequence
  source 1..20: mol_type = other DNA
aaaaaaaaaaaagagagaaa

SEQ ID NO: 9517 - DNA, 20 bp, synthetic construct
  misc_feature 1..20: note = CRISPR gRNA sequence
  source 1..20: mol_type = other DNA
aaaagagagaaaaggtctaa

SEQ ID NO: 9518 - DNA, 20 bp, synthetic construct
  misc_feature 1..20: note = CRISPR gRNA sequence
  source 1..20: mol_type = other DNA
aaagagagaaaaggtctaaa

SEQ ID NO: 9519 - DNA, 20 bp, synthetic construct
  misc_feature 1..20: note = CRISPR gRNA sequence
  source 1..20: mol_type = other DNA
agagagaaaaggtctaaaag

SEQ ID NO: 9520 - DNA, 20 bp, synthetic construct
  misc_feature 1..20: note = CRISPR gRNA sequence
  source 1..20: mol_type = other DNA
gagaaaaggtctaaaaggag

SEQ ID NO: 9521 - DNA, 20 bp, synthetic construct
  misc_feature 1..20: note = CRISPR gRNA sequence
  source 1..20: mol_type = other DNA
aaaggagtggacacttaaac

SEQ ID NO: 9522 - DNA, 20 bp, synthetic construct
  misc_feature 1..20: note = CRISPR gRNA sequence
  source 1..20: mol_type = other DNA
aggagtggacacttaaacaa

SEQ ID NO: 9523 - DNA, 20 bp, synthetic construct
  misc_feature 1..20: note = CRISPR gRNA sequence
  source 1..20: mol_type = other DNA
gagtggacacttaaacaaga

SEQ ID NO: 9524 - DNA, 20 bp, synthetic construct
  misc_feature 1..20: note = CRISPR gRNA sequence
  source 1..20: mol_type = other DNA
acttaaacaagagagacgat

SEQ ID NO: 9525 - DNA, 20 bp, synthetic construct
  misc_feature 1..20: note = CRISPR gRNA sequence
  source 1..20: mol_type = other DNA
aacaagagagacgatgagtg

SEQ ID NO: 9526 - DNA, 20 bp, synthetic construct
  misc_feature 1..20: note = CRISPR gRNA sequence
  source 1..20: mol_type = other DNA
acaagagagacgatgagtga

SEQ ID NO: 9527 - DNA, 20 bp, synthetic construct
  misc_feature 1..20: note = CRISPR gRNA sequence
  source 1..20: mol_type = other DNA
agagacgatgagtgaaggaa

SEQ ID NO: 9528 - DNA, 20 bp, synthetic construct
  misc_feature 1..20: note = CRISPR gRNA sequence
  source 1..20: mol_type = other DNA
gagacgatgagtgaaggaat

SEQ ID NO: 9529 - DNA, 20 bp, synthetic construct
  misc_feature 1..20: note = CRISPR gRNA sequence
  source 1..20: mol_type = other DNA
gatgagtgaaggaatgggtg

SEQ ID NO: 9530 - DNA, 20 bp, synthetic construct
  misc_feature 1..20: note = CRISPR gRNA sequence
  source 1..20: mol_type = other DNA
gaaggaatgggtgtggaaat

SEQ ID NO: 9531 - DNA, 20 bp, synthetic construct
  misc_feature 1..20: note = CRISPR gRNA sequence
  source 1..20: mol_type = other DNA
aaatgagtgaactaatgaat

SEQ ID NO: 9532 - DNA, 20 bp, synthetic construct
  misc_feature 1..20: note = CRISPR gRNA sequence
  source 1..20: mol_type = other DNA
tgagtgaactaatgaatgag

SEQ ID NO: 9533 - DNA, 20 bp, synthetic construct
  misc_feature 1..20: note = CRISPR gRNA sequence
  source 1..20: mol_type = other DNA
gtgaactaatgaatgagtgg

SEQ ID NO: 9534 - DNA, 20 bp, synthetic construct
  misc_feature 1..20: note = CRISPR gRNA sequence
  source 1..20: mol_type = other DNA
tgaactaatgaatgagtggt

SEQ ID NO: 9535 - DNA, 20 bp, synthetic construct
  misc_feature 1..20: note = CRISPR gRNA sequence
  source 1..20: mol_type = other DNA
gagtggtgggtgactgaatg

SEQ ID NO: 9536 - DNA, 20 bp, synthetic construct
  misc_feature 1..20: note = CRISPR gRNA sequence
  source 1..20: mol_type = other DNA
actgaatgaagcaaatgatg

SEQ ID NO: 9537 - DNA, 20 bp, synthetic construct
  misc_feature 1..20: note = CRISPR gRNA sequence
  source 1..20: mol_type = other DNA
agcaaatgatgaagactgta

SEQ ID NO: 9538 - DNA, 20 bp, synthetic construct
  misc_feature 1..20: note = CRISPR gRNA sequence
  source 1..20: mol_type = other DNA
gcaaatgatgaagactgtat

SEQ ID NO: 9539 - DNA, 20 bp, synthetic construct
  misc_feature 1..20: note = CRISPR gRNA sequence
  source 1..20: mol_type = other DNA
caaatgatgaagactgtatg

SEQ ID NO: 9540 - DNA, 20 bp, synthetic construct
  misc_feature 1..20: note = CRISPR gRNA sequence
  source 1..20: mol_type = other DNA
aaatgatgaagactgtatgg

SEQ ID NO: 9541 - DNA, 20 bp, synthetic construct
  misc_feature 1..20: note = CRISPR gRNA sequence
  source 1..20: mol_type = other DNA
gatgaagactgtatgggggc

SEQ ID NO: 9542 - DNA, 20 bp, synthetic construct
  misc_feature 1..20: note = CRISPR gRNA sequence
  source 1..20: mol_type = other DNA
gactgtatgggggccagatg

SEQ ID NO: 9543 - DNA, 20 bp, synthetic construct
  misc_feature 1..20: note = CRISPR gRNA sequence
  source 1..20: mol_type = other DNA
tgtatgggggccagatgtgg

SEQ ID NO: 9544 - DNA, 20 bp, synthetic construct
  misc_feature 1..20: note = CRISPR gRNA sequence
  source 1..20: mol_type = other DNA
gtggctcacacctgtaatcc

SEQ ID NO: 9545 - DNA, 20 bp, synthetic construct
  misc_feature 1..20: note = CRISPR gRNA sequence
  source 1..20: mol_type = other DNA
cacctgtaatcccagcactt

SEQ ID NO: 9546 - DNA, 20 bp, synthetic construct
  misc_feature 1..20: note = CRISPR gRNA sequence
  source 1..20: mol_type = other DNA
acctgtaatcccagcacttt

SEQ ID NO: 9547 - DNA, 20 bp, synthetic construct
  misc_feature 1..20: note = CRISPR gRNA sequence
  source 1..20: mol_type = other DNA
ctgtaatcccagcactttgg

SEQ ID NO: 9548 - DNA, 20 bp, synthetic construct
  misc_feature 1..20: note = CRISPR gRNA sequence
  source 1..20: mol_type = other DNA
tgtaatcccagcactttggg

SEQ ID NO: 9549 - DNA, 20 bp, synthetic construct
  misc_feature 1..20: note = CRISPR gRNA sequence
  source 1..20: mol_type = other DNA
tcccagcactttgggaggcc

SEQ ID NO: 9550 - DNA, 20 bp, synthetic construct
  misc_feature 1..20: note = CRISPR gRNA sequence
  source 1..20: mol_type = other DNA
cccagcactttgggaggcca

SEQ ID NO: 9551 - DNA, 20 bp, synthetic construct
  misc_feature 1..20: note = CRISPR gRNA sequence
  source 1..20: mol_type = other DNA
agcactttgggaggccaagg

SEQ ID NO: 9552 - DNA, 20 bp, synthetic construct
  misc_feature 1..20: note = CRISPR gRNA sequence
  source 1..20: mol_type = other DNA
ccaaggcggaacgattgctt

SEQ ID NO: 9553 - DNA, 20 bp, synthetic construct
  misc_feature 1..20: note = CRISPR gRNA sequence
  source 1..20: mol_type = other DNA
gcggaacgattgcttgagcc

SEQ ID NO: 9554 - DNA, 20 bp, synthetic construct
  misc_feature 1..20: note = CRISPR gRNA sequence
  source 1..20: mol_type = other DNA
cggaacgattgcttgagccc

SEQ ID NO: 9555 - DNA, 20 bp, synthetic construct
  misc_feature 1..20: note = CRISPR gRNA sequence
  source 1..20: mol_type = other DNA
gaacgattgcttgagcccag

SEQ ID NO: 9556 - DNA, 20 bp, synthetic construct
  misc_feature 1..20: note = CRISPR gRNA sequence
  source 1..20: mol_type = other DNA
ttgcttgagcccaggagctc

SEQ ID NO: 9557 - DNA, 20 bp, synthetic construct
  misc_feature 1..20: note = CRISPR gRNA sequence
  source 1..20: mol_type = other DNA
tgagcccaggagctcaagac

SEQ ID NO: 9558 - DNA, 20 bp, synthetic construct
  misc_feature 1..20: note = CRISPR gRNA sequence
  source 1..20: mol_type = other DNA
ccaggagctcaagaccagcc

SEQ ID NO: 9559 - DNA, 20 bp, synthetic construct
  misc_feature 1..20: note = CRISPR gRNA sequence
  source 1..20: mol_type = other DNA
caggagctcaagaccagcct

SEQ ID NO: 9560 - DNA, 20 bp, synthetic construct
  misc_feature 1..20: note = CRISPR gRNA sequence
  source 1..20: mol_type = other DNA
caagaccagcctgggcaaaa

SEQ ID NO: 9561 - DNA, 20 bp, synthetic construct
  misc_feature 1..20: note = CRISPR gRNA sequence
  source 1..20: mol_type = other DNA
accagcctgggcaaaatagt

SEQ ID NO: 9562 - DNA, 20 bp, synthetic construct
  misc_feature 1..20: note = CRISPR gRNA sequence
  source 1..20: mol_type = other DNA
atctccacaaaaaaacaaaa

SEQ ID NO: 9563 - DNA, 20 bp, synthetic construct
  misc_feature 1..20: note = CRISPR gRNA sequence
  source 1..20: mol_type = other DNA
aaaaaacaaaaaagaaaaat

SEQ ID NO: 9564 - DNA, 20 bp, synthetic construct
  misc_feature 1..20: note = CRISPR gRNA sequence
  source 1..20: mol_type = other DNA
aacaaaaaagaaaaattagc

SEQ ID NO: 9565 - DNA, 20 bp, synthetic construct
  misc_feature 1..20: note = CRISPR gRNA sequence
  source 1..20: mol_type = other DNA
acaaaaaagaaaaattagcc

SEQ ID NO: 9566 - DNA, 20 bp, synthetic construct
  misc_feature 1..20: note = CRISPR gRNA sequence
  source 1..20: mol_type = other DNA
aaagaaaaattagccaggca

SEQ ID NO: 9567 - DNA, 20 bp, synthetic construct
  misc_feature 1..20: note = CRISPR gRNA sequence
  source 1..20: mol_type = other DNA
gaaaaattagccaggcatgg

SEQ ID NO: 9568 - DNA, 20 bp, synthetic construct
  misc_feature 1..20: note = CRISPR gRNA sequence
  source 1..20: mol_type = other DNA
aaattagccaggcatggcag

SEQ ID NO: 9569 - DNA, 20 bp, synthetic construct
  misc_feature 1..20: note = CRISPR gRNA sequence
  source 1..20: mol_type = other DNA
aattagccaggcatggcagt

SEQ ID NO: 9570 - DNA, 20 bp, synthetic construct
  misc_feature 1..20: note = CRISPR gRNA sequence
  source 1..20: mol_type = other DNA
ggcatggcagtgggcgcctg

SEQ ID NO: 9571 - DNA, 20 bp, synthetic construct
  misc_feature 1..20: note = CRISPR gRNA sequence
  source 1..20: mol_type = other DNA
gcagtgggcgcctgtagtcc

SEQ ID NO: 9572 - DNA, 20 bp, synthetic construct
  misc_feature 1..20: note = CRISPR gRNA sequence
  source 1..20: mol_type = other DNA
cgcctgtagtcccagctact

SEQ ID NO: 9573 - DNA, 20 bp, synthetic construct
  misc_feature 1..20: note = CRISPR gRNA sequence
  source 1..20: mol_type = other DNA
gcctgtagtcccagctactc

SEQ ID NO: 9574 - DNA, 20 bp, synthetic construct
  misc_feature 1..20: note = CRISPR gRNA sequence
  source 1..20: mol_type = other DNA
ctgtagtcccagctactcag

SEQ ID NO: 9575 - DNA, 20 bp, synthetic construct
  misc_feature 1..20: note = CRISPR gRNA sequence
  source 1..20: mol_type = other DNA
tgtagtcccagctactcagg

SEQ ID NO: 9576 - DNA, 20 bp, synthetic construct
  misc_feature 1..20: note = CRISPR gRNA sequence
  source 1..20: mol_type = other DNA
tcccagctactcaggaggct

SEQ ID NO: 9577 - DNA, 20 bp, synthetic construct
  misc_feature 1..20: note = CRISPR gRNA sequence
  source 1..20: mol_type = other DNA
cccagctactcaggaggctg

SEQ ID NO: 9578 - DNA, 20 bp, synthetic construct
  misc_feature 1..20: note = CRISPR gRNA sequence
  source 1..20: mol_type = other DNA
agctactcaggaggctgagg

SEQ ID NO: 9579 - DNA, 20 bp, synthetic construct
  misc_feature 1..20: note = CRISPR gRNA sequence
  source 1..20: mol_type = other DNA
gctactcaggaggctgaggt

SEQ ID NO: 9580 - DNA, 20 bp, synthetic construct
  misc_feature 1..20: note = CRISPR gRNA sequence
  source 1..20: mol_type = other DNA
tactcaggaggctgaggtgg

SEQ ID NO: 9581 - DNA, 20 bp, synthetic construct
  misc_feature 1..20: note = CRISPR gRNA sequence
  source 1..20: mol_type = other DNA
actcaggaggctgaggtggg

SEQ ID NO: 9582 - DNA, 20 bp, synthetic construct
  misc_feature 1..20: note = CRISPR gRNA sequence
  source 1..20: mol_type = other DNA
ctgaggtgggaggattgctt

SEQ ID NO: 9583 - DNA, 20 bp, synthetic construct
  misc_feature 1..20: note = CRISPR gRNA sequence
  source 1..20: mol_type = other DNA
ggaggattgcttgagcctgt

SEQ ID NO: 9584 - DNA, 20 bp, synthetic construct
  misc_feature 1..20: note = CRISPR gRNA sequence
  source 1..20: mol_type = other DNA
gaggattgcttgagcctgtg

SEQ ID NO: 9585 - DNA, 20 bp, synthetic construct
  misc_feature 1..20: note = CRISPR gRNA sequence
  source 1..20: mol_type = other DNA
tgcttgagcctgtgaggttg

SEQ ID NO: 9586 - DNA, 20 bp, synthetic construct
  misc_feature 1..20: note = CRISPR gRNA sequence
  source 1..20: mol_type = other DNA
agcctgtgaggttgaagctg

SEQ ID NO: 9587 - DNA, 20 bp, synthetic construct
  misc_feature 1..20: note = CRISPR gRNA sequence
  source 1..20: mol_type = other DNA
ctgtgaggttgaagctgtgg

SEQ ID NO: 9588 - DNA, 20 bp, synthetic construct
  misc_feature 1..20: note = CRISPR gRNA sequence
  source 1..20: mol_type = other DNA
atgattgtgccattgcacgc

SEQ ID NO: 9589 - DNA, 20 bp, synthetic construct
  misc_feature 1..20: note = CRISPR gRNA sequence
  source 1..20: mol_type = other DNA
tgtgccattgcacgccagcc

SEQ ID NO: 9590 - DNA, 20 bp, synthetic construct
  misc_feature 1..20: note = CRISPR gRNA sequence
  source 1..20: mol_type = other DNA
gtgccattgcacgccagcct

SEQ ID NO: 9591 - DNA, 20 bp, synthetic construct
  misc_feature 1..20: note = CRISPR gRNA sequence
  source 1..20: mol_type = other DNA
gcacgccagcctgggcgaca

SEQ ID NO: 9592 - DNA, 20 bp, synthetic construct
  misc_feature 1..20: note = CRISPR gRNA sequence
  source 1..20: mol_type = other DNA
gccagcctgggcgacatagt

SEQ ID NO: 9593 - DNA, 20 bp, synthetic construct
  misc_feature 1..20: note = CRISPR gRNA sequence
  source 1..20: mol_type = other DNA
aaaaaaatcaaaaaattatc

SEQ ID NO: 9594 - DNA, 20 bp, synthetic construct
  misc_feature 1..20: note = CRISPR gRNA sequence
  source 1..20: mol_type = other DNA
aaaaaatcaaaaaattatct

SEQ ID NO: 9595 - DNA, 20 bp, synthetic construct
  misc_feature 1..20: note = CRISPR gRNA sequence
  source 1..20: mol_type = other DNA
atcaaaaaattatctgggca

SEQ ID NO: 9596 - DNA, 20 bp, synthetic construct
  misc_feature 1..20: note = CRISPR gRNA sequence
  source 1..20: mol_type = other DNA
ggcatggtgtcacatgtctg

SEQ ID NO: 9597 - DNA, 20 bp, synthetic construct
  misc_feature 1..20: note = CRISPR gRNA sequence
  source 1..20: mol_type = other DNA
gtgtcacatgtctgtggtcc

SEQ ID NO: 9598 - DNA, 20 bp, synthetic construct
  misc_feature 1..20: note = CRISPR gRNA sequence
  source 1..20: mol_type = other DNA
tgtctgtggtcccagctact

SEQ ID NO: 9599 - DNA, 20 bp, synthetic construct
  misc_feature 1..20: note = CRISPR gRNA sequence
  source 1..20: mol_type = other DNA
gtctgtggtcccagctactt

SEQ ID NO: 9600 - DNA, 20 bp, synthetic construct
  misc_feature 1..20: note = CRISPR gRNA sequence
  source 1..20: mol_type = other DNA
ctgtggtcccagctacttgg

SEQ ID NO: 9601 - DNA, 20 bp, synthetic construct
  misc_feature 1..20: note = CRISPR gRNA sequence
  source 1..20: mol_type = other DNA
tgtggtcccagctacttggg

SEQ ID NO: 9602 - DNA, 20 bp, synthetic construct
  misc_feature 1..20: note = CRISPR gRNA sequence
  source 1..20: mol_type = other DNA
ggtcccagctacttgggagg

SEQ ID NO: 9603 - DNA, 20 bp, synthetic construct
  misc_feature 1..20: note = CRISPR gRNA sequence
  source 1..20: mol_type = other DNA
tcccagctacttgggaggtg

SEQ ID NO: 9604 - DNA, 20 bp, synthetic construct
  misc_feature 1..20: note = CRISPR gRNA sequence
  source 1..20: mol_type = other DNA
agctacttgggaggtggagt

SEQ ID NO: 9605 - DNA, 20 bp, synthetic construct
  misc_feature 1..20: note = CRISPR gRNA sequence
  source 1..20: mol_type = other DNA
gctacttgggaggtggagtc

SEQ ID NO: 9606 - DNA, 20 bp, synthetic construct
  misc_feature 1..20: note = CRISPR gRNA sequence
  source 1..20: mol_type = other DNA
tacttgggaggtggagtcag

SEQ ID NO: 9607 - DNA, 20 bp, synthetic construct
  misc_feature 1..20: note = CRISPR gRNA sequence
  source 1..20: mol_type = other DNA
acttgggaggtggagtcagg

SEQ ID NO: 9608 - DNA, 20 bp, synthetic construct
  misc_feature 1..20: note = CRISPR gRNA sequence
  source 1..20: mol_type = other DNA
tggagtcaggaggatcgcat

SEQ ID NO: 9609 - DNA, 20 bp, synthetic construct
  misc_feature 1..20: note = CRISPR gRNA sequence
  source 1..20: mol_type = other DNA
tcaggaggatcgcatgagcc

SEQ ID NO: 9610 - DNA, 20 bp, synthetic construct
  misc_feature 1..20: note = CRISPR gRNA sequence
  source 1..20: mol_type = other DNA
caggaggatcgcatgagccc

SEQ ID NO: 9611 - DNA, 20 bp, synthetic construct
  misc_feature 1..20: note = CRISPR gRNA sequence
  source 1..20: mol_type = other DNA
ggaggatcgcatgagcccag

SEQ ID NO: 9612 - DNA, 20 bp, synthetic construct
  misc_feature 1..20: note = CRISPR gRNA sequence
  source 1..20: mol_type = other DNA
gaggatcgcatgagcccagg

SEQ ID NO: 9613 - DNA, 20 bp, synthetic construct
  misc_feature 1..20: note = CRISPR gRNA sequence
  source 1..20: mol_type = other DNA
tcgcatgagcccaggaggtt

SEQ ID NO: 9614 - DNA, 20 bp, synthetic construct
  misc_feature 1..20: note = CRISPR gRNA sequence
  source 1..20: mol_type = other DNA
cgcatgagcccaggaggttg

SEQ ID NO: 9615 - DNA, 20 bp, synthetic construct
  misc_feature 1..20: note = CRISPR gRNA sequence
  source 1..20: mol_type = other DNA
agcccaggaggttgaggttg

SEQ ID NO: 9616 - DNA, 20 bp, synthetic construct
  misc_feature 1..20: note = CRISPR gRNA sequence
  source 1..20: mol_type = other DNA
caggaggttgaggttgcagc

SEQ ID NO: 9617 - DNA, 20 bp, synthetic construct
  misc_feature 1..20: note = CRISPR gRNA sequence
  source 1..20: mol_type = other DNA
gtgatcacaccactgcattc

SEQ ID NO: 9618 - DNA, 20 bp, synthetic construct
  misc_feature 1..20: note = CRISPR gRNA sequence
  source 1..20: mol_type = other DNA
cacaccactgcattccagcc

SEQ ID NO: 9619 - DNA, 20 bp, synthetic construct
  misc_feature 1..20: note = CRISPR gRNA sequence
  source 1..20: mol_type = other DNA
acaccactgcattccagcct

SEQ ID NO: 9620 - DNA, 20 bp, synthetic construct
  misc_feature 1..20: note = CRISPR gRNA sequence
  source 1..20: mol_type = other DNA
gcattccagcctgggcaaaa

SEQ ID NO: 9621 - DNA, 20 bp, synthetic construct
  misc_feature 1..20: note = CRISPR gRNA sequence
  source 1..20: mol_type = other DNA
tccagcctgggcaaaaaagc

SEQ ID NO: 9622 - DNA, 20 bp, synthetic construct
  misc_feature 1..20: note = CRISPR gRNA sequence
  source 1..20: mol_type = other DNA
aaacaaacaaaaaaactgtg

SEQ ID NO: 9623 - DNA, 20 bp, synthetic construct
  misc_feature 1..20: note = CRISPR gRNA sequence
  source 1..20: mol_type = other DNA
aacaaacaaaaaaactgtgt

SEQ ID NO: 9624 - DNA, 20 bp, synthetic construct
  misc_feature 1..20: note = CRISPR gRNA sequence
  source 1..20: mol_type = other DNA
acaaacaaaaaaactgtgtg

SEQ ID NO: 9625 - DNA, 20 bp, synthetic construct
  misc_feature 1..20: note = CRISPR gRNA sequence
  source 1..20: mol_type = other DNA
caaaaaaactgtgtggggaa

SEQ ID NO: 9626 - DNA, 20 bp, synthetic construct
  misc_feature 1..20: note = CRISPR gRNA sequence
  source 1..20: mol_type = other DNA
tggggaacagatgtaaatga

SEQ ID NO: 9627 - DNA, 20 bp, synthetic construct
  misc_feature 1..20: note = CRISPR gRNA sequence
  source 1..20: mol_type = other DNA
ggaacagatgtaaatgatgg

SEQ ID NO: 9628 - DNA, 20 bp, synthetic construct
  misc_feature 1..20: note = CRISPR gRNA sequence
  source 1..20: mol_type = other DNA
acagatgtaaatgatggtgg

SEQ ID NO: 9629 - DNA, 20 bp, synthetic construct
  misc_feature 1..20: note = CRISPR gRNA sequence
  source 1..20: mol_type = other DNA
gtaaatgatggtggcagtgc

SEQ ID NO: 9630 - DNA, 20 bp, synthetic construct
  misc_feature 1..20: note = CRISPR gRNA sequence
  source 1..20: mol_type = other DNA
tggtggcagtgctggccttg

SEQ ID NO: 9631 - DNA, 20 bp, synthetic construct
  misc_feature 1..20: note = CRISPR gRNA sequence
  source 1..20: mol_type = other DNA
tggcagtgctggccttgtgg

SEQ ID NO: 9632 - DNA, 20 bp, synthetic construct
  misc_feature 1..20: note = CRISPR gRNA sequence
  source 1..20: mol_type = other DNA
agtgctggccttgtggtggc

SEQ ID NO: 9633 - DNA, 20 bp, synthetic construct
  misc_feature 1..20: note = CRISPR gRNA sequence
  source 1..20: mol_type = other DNA
ggccttgtggtggctggccc

SEQ ID NO: 9634 - DNA, 20 bp, synthetic construct
  misc_feature 1..20: note = CRISPR gRNA sequence
  source 1..20: mol_type = other DNA
cccccaccctgacacgcccc

SEQ ID NO: 9635 - DNA, 20 bp, synthetic construct
  misc_feature 1..20: note = CRISPR gRNA sequence
  source 1..20: mol_type = other DNA
tgacacgcccctggcctttg

SEQ ID NO: 9636 - DNA, 20 bp, synthetic construct
  misc_feature 1..20: note = CRISPR gRNA sequence
  source 1..20: mol_type = other DNA
acacgcccctggcctttgca

SEQ ID NO: 9637 - DNA, 20 bp, synthetic construct
  misc_feature 1..20: note = CRISPR gRNA sequence
  source 1..20: mol_type = other DNA
gcccctggcctttgcagagc

SEQ ID NO: 9638 - DNA, 20 bp, synthetic construct
  misc_feature 1..20: note = CRISPR gRNA sequence
  source 1..20: mol_type = other DNA
cctggcctttgcagagccgg

SEQ ID NO: 9639 - DNA, 20 bp, synthetic construct
  misc_feature 1..20: note = CRISPR gRNA sequence
  source 1..20: mol_type = other DNA
tggcctttgcagagccggtg

SEQ ID NO: 9640 - DNA, 20 bp, synthetic construct
  misc_feature 1..20: note = CRISPR gRNA sequence
  source 1..20: mol_type = other DNA
cctttgcagagccggtggag

SEQ ID NO: 9641 - DNA, 20 bp, synthetic construct
  misc_feature 1..20: note = CRISPR gRNA sequence
  source 1..20: mol_type = other DNA
agcagttctaccgctcactg

SEQ ID NO: 9642 - DNA, 20 bp, synthetic construct
  misc_feature 1..20: note = CRISPR gRNA sequence
  source 1..20: mol_type = other DNA
gcagttctaccgctcactgc

SEQ ID NO: 9643 - DNA, 20 bp, synthetic construct
  misc_feature 1..20: note = CRISPR gRNA sequence
  source 1..20: mol_type = other DNA
cgctcactgcaggacacgta

SEQ ID NO: 9644 - DNA, 20 bp, synthetic construct
  misc_feature 1..20: note = CRISPR gRNA sequence
  source 1..20: mol_type = other DNA
tgcaggacacgtatggtgcc

SEQ ID NO: 9645 - DNA, 20 bp, synthetic construct
  misc_feature 1..20: note = CRISPR gRNA sequence
  source 1..20: mol_type = other DNA
cacgtatggtgccgagcccg

SEQ ID NO: 9646 - DNA, 20 bp, synthetic construct
  misc_feature 1..20: note = CRISPR gRNA sequence
  source 1..20: mol_type = other DNA
acgtatggtgccgagcccgc

SEQ ID NO: 9647 - DNA, 20 bp, synthetic construct
  misc_feature 1..20: note = CRISPR gRNA sequence
  source 1..20: mol_type = other DNA
tggtgccgagcccgcaggcc

SEQ ID NO: 9648 - DNA, 20 bp, synthetic construct
  misc_feature 1..20: note = CRISPR gRNA sequence
  source 1..20: mol_type = other DNA
gccgagcccgcaggcccgga

SEQ ID NO: 9649 - DNA, 20 bp, synthetic construct
  misc_feature 1..20: note = CRISPR gRNA sequence
  source 1..20: mol_type = other DNA
cgcaggcccggatggcatcc

SEQ ID NO: 9650 - DNA, 20 bp, synthetic construct
  misc_feature 1..20: note = CRISPR gRNA sequence
  source 1..20: mol_type = other DNA
aggcccggatggcatcctag

SEQ ID NO: 9651 - DNA, 20 bp, synthetic construct
  misc_feature 1..20: note = CRISPR gRNA sequence
  source 1..20: mol_type = other DNA
gcccggatggcatcctagtg

SEQ ID NO: 9652 - DNA, 20 bp, synthetic construct
  misc_feature 1..20: note = CRISPR gRNA sequence
  source 1..20: mol_type = other DNA
cccggatggcatcctagtgg

SEQ ID NO: 9653 - DNA, 20 bp, synthetic construct
  misc_feature 1..20: note = CRISPR gRNA sequence
  source 1..20: mol_type = other DNA
ggatggcatcctagtggagg

SEQ ID NO: 9654 - DNA, 20 bp, synthetic construct
  misc_feature 1..20: note = CRISPR gRNA sequence
  source 1..20: mol_type = other DNA
catcctagtggaggtggatc

SEQ ID NO: 9655 - DNA, 20 bp, synthetic construct
  misc_feature 1..20: note = CRISPR gRNA sequence
  source 1..20: mol_type = other DNA
tagtggaggtggatctggtg

SEQ ID NO: 9656 - DNA, 20 bp, synthetic construct
  misc_feature 1..20: note = CRISPR gRNA sequence
  source 1..20: mol_type = other DNA
agtggaggtggatctggtgc

SEQ ID NO: 9657 - DNA, 20 bp, synthetic construct
  misc_feature 1..20: note = CRISPR gRNA sequence
  source 1..20: mol_type = other DNA
gaggtggatctggtgcaggc

SEQ ID NO: 9658 - DNA, 20 bp, synthetic construct
  misc_feature 1..20: note = CRISPR gRNA sequence
  source 1..20: mol_type = other DNA
aggtggatctggtgcaggcc

SEQ ID NO: 9659 - DNA, 20 bp, synthetic construct
  misc_feature 1..20: note = CRISPR gRNA sequence
  source 1..20: mol_type = other DNA
ggatctggtgcaggccaggc

SEQ ID NO: 9660 - DNA, 20 bp, synthetic construct
  misc_feature 1..20: note = CRISPR gRNA sequence
  source 1..20: mol_type = other DNA
atctggtgcaggccaggctg

SEQ ID NO: 9661 - DNA, 20 bp, synthetic construct
  misc_feature 1..20: note = CRISPR gRNA sequence
  source 1..20: mol_type = other DNA
ctggtgcaggccaggctgga

SEQ ID NO: 9662 - DNA, 20 bp, synthetic construct
  misc_feature 1..20: note = CRISPR gRNA sequence
  source 1..20: mol_type = other DNA
tggtgcaggccaggctggag

SEQ ID NO: 9663 - DNA, 20 bp, synthetic construct
  misc_feature 1..20: note = CRISPR gRNA sequence
  source 1..20: mol_type = other DNA
gtgcaggccaggctggagag

SEQ ID NO: 9664 - DNA, 20 bp, synthetic construct
  misc_feature 1..20: note = CRISPR gRNA sequence
  source 1..20: mol_type = other DNA
caggccaggctggagaggag

SEQ ID NO: 9665 - DNA, 20 bp, synthetic construct
  misc_feature 1..20: note = CRISPR gRNA sequence
  source 1..20: mol_type = other DNA
gccaggctggagaggagcag

SEQ ID NO: 9666 - DNA, 20 bp, synthetic construct
  misc_feature 1..20: note = CRISPR gRNA sequence
  source 1..20: mol_type = other DNA
ggctggagaggagcagcagc

SEQ ID NO: 9667 - DNA, 20 bp, synthetic construct
  misc_feature 1..20: note = CRISPR gRNA sequence
  source 1..20: mol_type = other DNA
ctggagaggagcagcagcaa

SEQ ID NO: 9668 - DNA, 20 bp, synthetic construct
  misc_feature 1..20: note = CRISPR gRNA sequence
  source 1..20: mol_type = other DNA
gaggagcagcagcaagagcc

SEQ ID NO: 9669 - DNA, 20 bp, synthetic construct
  misc_feature 1..20: note = CRISPR gRNA sequence
  source 1..20: mol_type = other DNA
ggagcagcagcaagagcctg

SEQ ID NO: 9670 - DNA, 20 bp, synthetic construct
  misc_feature 1..20: note = CRISPR gRNA sequence
  source 1..20: mol_type = other DNA
gcagcagcaagagcctggag

SEQ ID NO: 9671 - DNA, 20 bp, synthetic construct
  misc_feature 1..20: note = CRISPR gRNA sequence
  source 1..20: mol_type = other DNA
cagcagcaagagcctggagc

SEQ ID NO: 9672 - DNA, 20 bp, synthetic construct
  misc_feature 1..20: note = CRISPR gRNA sequence
  source 1..20: mol_type = other DNA
caagagcctggagcgggaac

SEQ ID NO: 9673 - DNA, 20 bp, synthetic construct
  misc_feature 1..20: note = CRISPR gRNA sequence
  source 1..20: mol_type = other DNA
ggagcgggaactggccaccc

SEQ ID NO: 9674 - DNA, 20 bp, synthetic construct
  misc_feature 1..20: note = CRISPR gRNA sequence
  source 1..20: mol_type = other DNA
gggaactggccaccccggac

SEQ ID NO: 9675 - DNA, 20 bp, synthetic construct
  misc_feature 1..20: note = CRISPR gRNA sequence
  source 1..20: mol_type = other DNA
ggaactggccaccccggact

SEQ ID NO: 9676 - DNA, 20 bp, synthetic construct
  misc_feature 1..20: note = CRISPR gRNA sequence
  source 1..20: mol_type = other DNA
actggccaccccggactggg

SEQ ID NO: 9677 - DNA, 20 bp, synthetic construct
  misc_feature 1..20: note = CRISPR gRNA sequence
  source 1..20: mol_type = other DNA
ccaccccggactgggcagaa

SEQ ID NO: 9678 - DNA, 20 bp, synthetic construct
  misc_feature 1..20: note = CRISPR gRNA sequence
  source 1..20: mol_type = other DNA
ccccggactgggcagaacgg

SEQ ID NO: 9679 - DNA, 20 bp, synthetic construct
  misc_feature 1..20: note = CRISPR gRNA sequence
  source 1..20: mol_type = other DNA
ggactgggcagaacggcagc

SEQ ID NO: 9680 - DNA, 20 bp, synthetic construct
  misc_feature 1..20: note = CRISPR gRNA sequence
  source 1..20: mol_type = other DNA
ggcagaacggcagctggccc

SEQ ID NO: 9681 - DNA, 20 bp, synthetic construct
  misc_feature 1..20: note = CRISPR gRNA sequence
  source 1..20: mol_type = other DNA
gcagaacggcagctggccca

SEQ ID NO: 9682 - DNA, 20 bp, synthetic construct
  misc_feature 1..20: note = CRISPR gRNA sequence
  source 1..20: mol_type = other DNA
agaacggcagctggcccaag

SEQ ID NO: 9683 - DNA, 20 bp, synthetic construct
  misc_feature 1..20: note = CRISPR gRNA sequence
  source 1..20: mol_type = other DNA
gaacggcagctggcccaagg

SEQ ID NO: 9684 - DNA, 20 bp, synthetic construct
  misc_feature 1..20: note = CRISPR gRNA sequence
  source 1..20: mol_type = other DNA
gcagctggcccaaggaggcc

SEQ ID NO: 9685 - DNA, 20 bp, synthetic construct
  misc_feature 1..20: note = CRISPR gRNA sequence
  source 1..20: mol_type = other DNA
tggcccaaggaggcctggct

SEQ ID NO: 9686 - DNA, 20 bp, synthetic construct
  misc_feature 1..20: note = CRISPR gRNA sequence
  source 1..20: mol_type = other DNA
ggcccaaggaggcctggctg

SEQ ID NO: 9687 - DNA, 20 bp, synthetic construct
  misc_feature 1..20: note = CRISPR gRNA sequence
  source 1..20: mol_type = other DNA
aggcctggctgaggtgctgt

SEQ ID NO: 9688 - DNA, 20 bp, synthetic construct
  misc_feature 1..20: note = CRISPR gRNA sequence
  source 1..20: mol_type = other DNA
ctgaggtgctgttggctgcc

SEQ ID NO: 9689 - DNA, 20 bp, synthetic construct
  misc_feature 1..20: note = CRISPR gRNA sequence
  source 1..20: mol_type = other DNA
tgaggtgctgttggctgcca

SEQ ID NO: 9690 - DNA, 20 bp, synthetic construct
  misc_feature 1..20: note = CRISPR gRNA sequence
  source 1..20: mol_type = other DNA
aggtgctgttggctgccaag

SEQ ID NO: 9691 - DNA, 20 bp, synthetic construct
  misc_feature 1..20: note = CRISPR gRNA sequence
  source 1..20: mol_type = other DNA
tgttggctgccaaggagcac

SEQ ID NO: 9692 - DNA, 20 bp, synthetic construct
  misc_feature 1..20: note = CRISPR gRNA sequence
  source 1..20: mol_type = other DNA
tggctgccaaggagcaccgg

SEQ ID NO: 9693 - DNA, 20 bp, synthetic construct
  misc_feature 1..20: note = CRISPR gRNA sequence
  source 1..20: mol_type = other DNA
aggagcaccggcggccgcgt

SEQ ID NO: 9694 - DNA, 20 bp, synthetic construct
  misc_feature 1..20: note = CRISPR gRNA sequence
  source 1..20: mol_type = other DNA
ccggcggccgcgtgagacac

SEQ ID NO: 9695 - DNA, 20 bp, synthetic construct
  misc_feature 1..20: note = CRISPR gRNA sequence
  source 1..20: mol_type = other DNA
gacacgagtgattgctgtgc

SEQ ID NO: 9696 - DNA, 20 bp, synthetic construct
  misc_feature 1..20: note = CRISPR gRNA sequence
  source 1..20: mol_type = other DNA
acacgagtgattgctgtgct

SEQ ID NO: 9697 - DNA, 20 bp, synthetic construct
  misc_feature 1..20: note = CRISPR gRNA sequence
  source 1..20: mol_type = other DNA
agtgattgctgtgctgggca

SEQ ID NO: 9698 - DNA, 20 bp, synthetic construct
  misc_feature 1..20: note = CRISPR gRNA sequence
  source 1..20: mol_type = other DNA
attgctgtgctgggcaaagc

SEQ ID NO: 9699 - DNA, 20 bp, synthetic construct
  misc_feature 1..20: note = CRISPR gRNA sequence
  source 1..20: mol_type = other DNA
ctgtgctgggcaaagctggt

SEQ ID NO: 9700 - DNA, 20 bp, synthetic construct
  misc_feature 1..20: note = CRISPR gRNA sequence
  source 1..20: mol_type = other DNA
tgtgctgggcaaagctggtc

SEQ ID NO: 9701 - DNA, 20 bp, synthetic construct
  misc_feature 1..20: note = CRISPR gRNA sequence
  source 1..20: mol_type = other DNA
gtgctgggcaaagctggtca

SEQ ID NO: 9702 - DNA, 20 bp, synthetic construct
  misc_feature 1..20: note = CRISPR gRNA sequence
  source 1..20: mol_type = other DNA
tgggcaaagctggtcagggc

SEQ ID NO: 9703 - DNA, 20 bp, synthetic construct
  misc_feature 1..20: note = CRISPR gRNA sequence
  source 1..20: mol_type = other DNA
ggcaaagctggtcagggcaa

SEQ ID NO: 9704 - DNA, 20 bp, synthetic construct
  misc_feature 1..20: note = CRISPR gRNA sequence
  source 1..20: mol_type = other DNA
ctggtcagggcaagagctat

SEQ ID NO: 9705 - DNA, 20 bp, synthetic construct
  misc_feature 1..20: note = CRISPR gRNA sequence
  source 1..20: mol_type = other DNA
tggtcagggcaagagctatt

SEQ ID NO: 9706 - DNA, 20 bp, synthetic construct
  misc_feature 1..20: note = CRISPR gRNA sequence
  source 1..20: mol_type = other DNA
cagggcaagagctattgggc

SEQ ID NO: 9707 - DNA, 20 bp, synthetic construct
  misc_feature 1..20: note = CRISPR gRNA sequence
  source 1..20: mol_type = other DNA
agggcaagagctattgggct

SEQ ID NO: 9708 - DNA, 20 bp, synthetic construct
  misc_feature 1..20: note = CRISPR gRNA sequence
  source 1..20: mol_type = other DNA
gggcaagagctattgggctg

SEQ ID NO: 9709 - DNA, 20 bp, synthetic construct
  misc_feature 1..20: note = CRISPR gRNA sequence
  source 1..20: mol_type = other DNA
caagagctattgggctgggg

SEQ ID NO: 9710 - DNA, 20 bp, synthetic construct
  misc_feature 1..20: note = CRISPR gRNA sequence
  source 1..20: mol_type = other DNA
agctattgggctggggcagt

SEQ ID NO: 9711 - DNA, 20 bp, synthetic construct
  misc_feature 1..20: note = CRISPR gRNA sequence
  source 1..20: mol_type = other DNA
attgggctggggcagtgagc

SEQ ID NO: 9712 - DNA, 20 bp, synthetic construct
  misc_feature 1..20: note = CRISPR gRNA sequence
  source 1..20: mol_type = other DNA
ttgggctggggcagtgagcc

SEQ ID NO: 9713 - DNA, 20 bp, synthetic construct
  misc_feature 1..20: note = CRISPR gRNA sequence
  source 1..20: mol_type = other DNA
ctggggcagtgagccgggcc

SEQ ID NO: 9714 - DNA, 20 bp, synthetic construct
  misc_feature 1..20: note = CRISPR gRNA sequence
  source 1..20: mol_type = other DNA
tggggcagtgagccgggcct

SEQ ID NO: 9715 - DNA, 20 bp, synthetic construct
  misc_feature 1..20: note = CRISPR gRNA sequence
  source 1..20: mol_type = other DNA
gtgagccgggcctgggcttg

SEQ ID NO: 9716 - DNA, 20 bp, synthetic construct
  misc_feature 1..20: note = CRISPR gRNA sequence
  source 1..20: mol_type = other DNA
gccgggcctgggcttgtggc

SEQ ID NO: 9717 - DNA, 20 bp, synthetic construct
  misc_feature 1..20: note = CRISPR gRNA sequence
  source 1..20: mol_type = other DNA
gggcttgtggccggcttccc

SEQ ID NO: 9718 - DNA, 20 bp, synthetic construct
  misc_feature 1..20: note = CRISPR gRNA sequence
  source 1..20: mol_type = other DNA
ctgccattgcttgaaccgtc

SEQ ID NO: 9719 - DNA, 20 bp, synthetic construct
  misc_feature 1..20: note = CRISPR gRNA sequence
  source 1..20: mol_type = other DNA
tgccattgcttgaaccgtcc

SEQ ID NO: 9720 - DNA, 20 bp, synthetic construct
  misc_feature 1..20: note = CRISPR gRNA sequence
  source 1..20: mol_type = other DNA
gccattgcttgaaccgtccg

SEQ ID NO: 9721 - DNA, 20 bp, synthetic construct
  misc_feature 1..20: note = CRISPR gRNA sequence
  source 1..20: mol_type = other DNA
ccattgcttgaaccgtccgg

SEQ ID NO: 9722 - DNA, 20 bp, synthetic construct
  misc_feature 1..20: note = CRISPR gRNA sequence
  source 1..20: mol_type = other DNA
aaccgtccgggggatgccta

SEQ ID NO: 9723 - DNA, 20 bp, synthetic construct
  misc_feature 1..20: note = CRISPR gRNA sequence
  source 1..20: mol_type = other DNA
cgggggatgcctatggcctg

SEQ ID NO: 9724 - DNA, 20 bp, synthetic construct
  misc_feature 1..20: note = CRISPR gRNA sequence
  source 1..20: mol_type = other DNA
gggggatgcctatggcctgc

SEQ ID NO: 9725 - DNA, 20 bp, synthetic construct
  misc_feature 1..20: note = CRISPR gRNA sequence
  source 1..20: mol_type = other DNA
gcaggatctgctcttctccc

SEQ ID NO: 9726 - DNA, 20 bp, synthetic construct
  misc_feature 1..20: note = CRISPR gRNA sequence
  source 1..20: mol_type = other DNA
caggatctgctcttctccct

SEQ ID NO: 9727 - DNA, 20 bp, synthetic construct
  misc_feature 1..20: note = CRISPR gRNA sequence
  source 1..20: mol_type = other DNA
tgctcttctccctgggccca

SEQ ID NO: 9728 - DNA, 20 bp, synthetic construct
  misc_feature 1..20: note = CRISPR gRNA sequence
  source 1..20: mol_type = other DNA
cctgggcccacagccactcg

SEQ ID NO: 9729 - DNA, 20 bp, synthetic construct
  misc_feature 1..20: note = CRISPR gRNA sequence
  source 1..20: mol_type = other DNA
gggcccacagccactcgtgg

SEQ ID NO: 9730 - DNA, 20 bp, synthetic construct
  misc_feature 1..20: note = CRISPR gRNA sequence
  source 1..20: mol_type = other DNA
agccactcgtggcggccgat

SEQ ID NO: 9731 - DNA, 20 bp, synthetic construct
  misc_feature 1..20: note = CRISPR gRNA sequence
  source 1..20: mol_type = other DNA
gccactcgtggcggccgatg

SEQ ID NO: 9732 - DNA, 20 bp, synthetic construct
  misc_feature 1..20: note = CRISPR gRNA sequence
  source 1..20: mol_type = other DNA
gtggcggccgatgaggtttt

SEQ ID NO: 9733 - DNA, 20 bp, synthetic construct
  misc_feature 1..20: note = CRISPR gRNA sequence
  source 1..20: mol_type = other DNA
aggttttcagccacatcttg

SEQ ID NO: 9734 - DNA, 20 bp, synthetic construct
  misc_feature 1..20: note = CRISPR gRNA sequence
  source 1..20: mol_type = other DNA
gttttcagccacatcttgaa

SEQ ID NO: 9735 - DNA, 20 bp, synthetic construct
  misc_feature 1..20: note = CRISPR gRNA sequence
  source 1..20: mol_type = other DNA
tgaccgcgttctgctcatcc

SEQ ID NO: 9736 - DNA, 20 bp, synthetic construct
  misc_feature 1..20: note = CRISPR gRNA sequence
  source 1..20: mol_type = other DNA
cgcgttctgctcatcctaga

SEQ ID NO: 9737 - DNA, 20 bp, synthetic construct
  misc_feature 1..20: note = CRISPR gRNA sequence
  source 1..20: mol_type = other DNA
tgctcatcctagacggcttc

SEQ ID NO: 9738 - DNA, 20 bp, synthetic construct
  misc_feature 1..20: note = CRISPR gRNA sequence
  source 1..20: mol_type = other DNA
gctcatcctagacggcttcg

SEQ ID NO: 9739 - DNA, 20 bp, synthetic construct
  misc_feature 1..20: note = CRISPR gRNA sequence
  source 1..20: mol_type = other DNA
tcatcctagacggcttcgag

SEQ ID NO: 9740 - DNA, 20 bp, synthetic construct
  misc_feature 1..20: note = CRISPR gRNA sequence
  source 1..20: mol_type = other DNA
cctagacggcttcgaggagc

SEQ ID NO: 9741 - DNA, 20 bp, synthetic construct
  misc_feature 1..20: note = CRISPR gRNA sequence
  source 1..20: mol_type = other DNA
agacggcttcgaggagctgg

SEQ ID NO: 9742 - DNA, 20 bp, synthetic construct
  misc_feature 1..20: note = CRISPR gRNA sequence
  source 1..20: mol_type = other DNA
cttcgaggagctggaagcgc

SEQ ID NO: 9743 - DNA, 20 bp, synthetic construct
  misc_feature 1..20: note = CRISPR gRNA sequence
  source 1..20: mol_type = other DNA
gaggagctggaagcgcaaga

SEQ ID NO: 9744 - DNA, 20 bp, synthetic construct
  misc_feature 1..20: note = CRISPR gRNA sequence
  source 1..20: mol_type = other DNA
gcgcaagatggcttcctgca

SEQ ID NO: 9745 - DNA, 20 bp, synthetic construct
  misc_feature 1..20: note = CRISPR gRNA sequence
  source 1..20: mol_type = other DNA
ggcttcctgcacagcacgtg

SEQ ID NO: 9746 - DNA, 20 bp, synthetic construct
  misc_feature 1..20: note = CRISPR gRNA sequence
  source 1..20: mol_type = other DNA
cctgcacagcacgtgcggac

SEQ ID NO: 9747 - DNA, 20 bp, synthetic construct
  misc_feature 1..20: note = CRISPR gRNA sequence
  source 1..20: mol_type = other DNA
cagcacgtgcggaccggcac

SEQ ID NO: 9748 - DNA, 20 bp, synthetic construct
  misc_feature 1..20: note = CRISPR gRNA sequence
  source 1..20: mol_type = other DNA
cacgtgcggaccggcaccgg

SEQ ID NO: 9749 - DNA, 20 bp, synthetic construct
  misc_feature 1..20: note = CRISPR gRNA sequence
  source 1..20: mol_type = other DNA
cgtgcggaccggcaccggcg

SEQ ID NO: 9750 - DNA, 20 bp, synthetic construct
  misc_feature 1..20: note = CRISPR gRNA sequence
  source 1..20: mol_type = other DNA
cggcggagccctgctccctc

SEQ ID NO: 9751 - DNA, 20 bp, synthetic construct
  misc_feature 1..20: note = CRISPR gRNA sequence
  source 1..20: mol_type = other DNA
ggcggagccctgctccctcc

SEQ ID NO: 9752 - DNA, 20 bp, synthetic construct
  misc_feature 1..20: note = CRISPR gRNA sequence
  source 1..20: mol_type = other DNA
gcggagccctgctccctccg

SEQ ID NO: 9753 - DNA, 20 bp, synthetic construct
  misc_feature 1..20: note = CRISPR gRNA sequence
  source 1..20: mol_type = other DNA
cggagccctgctccctccgg

SEQ ID NO: 9754 - DNA, 20 bp, synthetic construct
  misc_feature 1..20: note = CRISPR gRNA sequence
  source 1..20: mol_type = other DNA
ctgctccctccgggggctgc

SEQ ID NO: 9755 - DNA, 20 bp, synthetic construct
  misc_feature 1..20: note = CRISPR gRNA sequence
  source 1..20: mol_type = other DNA
tccctccgggggctgctggc

SEQ ID NO: 9756 - DNA, 20 bp, synthetic construct
  misc_feature 1..20: note = CRISPR gRNA sequence
  source 1..20: mol_type = other DNA
ggctgctggccggccttttc

SEQ ID NO: 9757 - DNA, 20 bp, synthetic construct
  misc_feature 1..20: note = CRISPR gRNA sequence
  source 1..20: mol_type = other DNA
tgctggccggccttttccag

SEQ ID NO: 9758 - DNA, 20 bp, synthetic construct
  misc_feature 1..20: note = CRISPR gRNA sequence
  source 1..20: mol_type = other DNA
tggccggccttttccagaag

SEQ ID NO: 9759 - DNA, 20 bp, synthetic construct
  misc_feature 1..20: note = CRISPR gRNA sequence
  source 1..20: mol_type = other DNA
tttccagaagaagctgctcc

SEQ ID NO: 9760 - DNA, 20 bp, synthetic construct
  misc_feature 1..20: note = CRISPR gRNA sequence
  source 1..20: mol_type = other DNA
ttccagaagaagctgctccg

SEQ ID NO: 9761 - DNA, 20 bp, synthetic construct
  misc_feature 1..20: note = CRISPR gRNA sequence
  source 1..20: mol_type = other DNA
aggttgcaccctcctcctca

SEQ ID NO: 9762 - DNA, 20 bp, synthetic construct
  misc_feature 1..20: note = CRISPR gRNA sequence
  source 1..20: mol_type = other DNA
gcaccctcctcctcacagcc

SEQ ID NO: 9763 - DNA, 20 bp, synthetic construct
  misc_feature 1..20: note = CRISPR gRNA sequence
  source 1..20: mol_type = other DNA
tcctcctcacagcccggccc

SEQ ID NO: 9764 - DNA, 20 bp, synthetic construct
  misc_feature 1..20: note = CRISPR gRNA sequence
  source 1..20: mol_type = other DNA
cctcctcacagcccggcccc

SEQ ID NO: 9765 - DNA, 20 bp, synthetic construct
  misc_feature 1..20: note = CRISPR gRNA sequence
  source 1..20: mol_type = other DNA
ctcctcacagcccggccccg

SEQ ID NO: 9766 - DNA, 20 bp, synthetic construct
  misc_feature 1..20: note = CRISPR gRNA sequence
  source 1..20: mol_type = other DNA
agcccggccccggggccgcc

SEQ ID NO: 9767 - DNA, 20 bp, synthetic construct
  misc_feature 1..20: note = CRISPR gRNA sequence
  source 1..20: mol_type = other DNA
ggccccggggccgcctggtc

SEQ ID NO: 9768 - DNA, 20 bp, synthetic construct
  misc_feature 1..20: note = CRISPR gRNA sequence
  source 1..20: mol_type = other DNA
ccccggggccgcctggtcca

SEQ ID NO: 9769 - DNA, 20 bp, synthetic construct
  misc_feature 1..20: note = CRISPR gRNA sequence
  source 1..20: mol_type = other DNA
ggccgcctggtccagagcct

SEQ ID NO: 9770 - DNA, 20 bp, synthetic construct
  misc_feature 1..20: note = CRISPR gRNA sequence
  source 1..20: mol_type = other DNA
gcctggtccagagcctgagc

SEQ ID NO: 9771 - DNA, 20 bp, synthetic construct
  misc_feature 1..20: note = CRISPR gRNA sequence
  source 1..20: mol_type = other DNA
cctggtccagagcctgagca

SEQ ID NO: 9772 - DNA, 20 bp, synthetic construct
  misc_feature 1..20: note = CRISPR gRNA sequence
  source 1..20: mol_type = other DNA
gcaaggccgacgccctattt

SEQ ID NO: 9773 - DNA, 20 bp, synthetic construct
  misc_feature 1..20: note = CRISPR gRNA sequence
  source 1..20: mol_type = other DNA
gacgccctatttgagctgtc

SEQ ID NO: 9774 - DNA, 20 bp, synthetic construct
  misc_feature 1..20: note = CRISPR gRNA sequence
  source 1..20: mol_type = other DNA
tgagctgtccggcttctcca

SEQ ID NO: 9775 - DNA, 20 bp, synthetic construct
  misc_feature 1..20: note = CRISPR gRNA sequence
  source 1..20: mol_type = other DNA
agctgtccggcttctccatg

SEQ ID NO: 9776 - DNA, 20 bp, synthetic construct
  misc_feature 1..20: note = CRISPR gRNA sequence
  source 1..20: mol_type = other DNA
tgtccggcttctccatggag

SEQ ID NO: 9777 - DNA, 20 bp, synthetic construct
  misc_feature 1..20: note = CRISPR gRNA sequence
  source 1..20: mol_type = other DNA
gtccggcttctccatggagc

SEQ ID NO: 9778 - DNA, 20 bp, synthetic construct
  misc_feature 1..20: note = CRISPR gRNA sequence
  source 1..20: mol_type = other DNA
gcttctccatggagcaggcc

SEQ ID NO: 9779 - DNA, 20 bp, synthetic construct
  misc_feature 1..20: note = CRISPR gRNA sequence
  source 1..20: mol_type = other DNA
cttctccatggagcaggccc

SEQ ID NO: 9780 - DNA, 20 bp, synthetic construct
  misc_feature 1..20: note = CRISPR gRNA sequence
  source 1..20: mol_type = other DNA
catacgtgatgcgctacttt

SEQ ID NO: 9781 - DNA, 20 bp, synthetic construct
  misc_feature 1..20: note = CRISPR gRNA sequence
  source 1..20: mol_type = other DNA
tacgtgatgcgctactttga

SEQ ID NO: 9782 - DNA, 20 bp, synthetic construct
  misc_feature 1..20: note = CRISPR gRNA sequence
  source 1..20: mol_type = other DNA
gatgcgctactttgagagct

SEQ ID NO: 9783 - DNA, 20 bp, synthetic construct
  misc_feature 1..20: note = CRISPR gRNA sequence
  source 1..20: mol_type = other DNA
atgcgctactttgagagctc

SEQ ID NO: 9784 - DNA, 20 bp, synthetic construct
  misc_feature 1..20: note = CRISPR gRNA sequence
  source 1..20: mol_type = other DNA
tgcgctactttgagagctca

SEQ ID NO: 9785 - DNA, 20 bp, synthetic construct
  misc_feature 1..20: note = CRISPR gRNA sequence
  source 1..20: mol_type = other DNA
ctttgagagctcagggatga

SEQ ID NO: 9786 - DNA, 20 bp, synthetic construct
  misc_feature 1..20: note = CRISPR gRNA sequence
  source 1..20: mol_type = other DNA
ttgagagctcagggatgaca

SEQ ID NO: 9787 - DNA, 20 bp, synthetic construct
  misc_feature 1..20: note = CRISPR gRNA sequence
  source 1..20: mol_type = other DNA
ctcagggatgacagagcacc

SEQ ID NO: 9788 - DNA, 20 bp, synthetic construct
  misc_feature 1..20: note = CRISPR gRNA sequence
  source 1..20: mol_type = other DNA
gggatgacagagcaccaaga

SEQ ID NO: 9789 - DNA, 20 bp, synthetic construct
  misc_feature 1..20: note = CRISPR gRNA sequence
  source 1..20: mol_type = other DNA
gatgacagagcaccaagaca

SEQ ID NO: 9790 - DNA, 20 bp, synthetic construct
  misc_feature 1..20: note = CRISPR gRNA sequence
  source 1..20: mol_type = other DNA
acagagccctgacgctcctc

SEQ ID NO: 9791 - DNA, 20 bp, synthetic construct
  misc_feature 1..20: note = CRISPR gRNA sequence
  source 1..20: mol_type = other DNA
cagagccctgacgctcctcc

SEQ ID NO: 9792 - DNA, 20 bp, synthetic construct
  misc_feature 1..20: note = CRISPR gRNA sequence
  source 1..20: mol_type = other DNA
ccctgacgctcctccgggac

SEQ ID NO: 9793 - DNA, 20 bp, synthetic construct
  misc_feature 1..20: note = CRISPR gRNA sequence
  source 1..20: mol_type = other DNA
cgggaccggccacttcttct

SEQ ID NO: 9794 - DNA, 20 bp, synthetic construct
  misc_feature 1..20: note = CRISPR gRNA sequence
  source 1..20: mol_type = other DNA
cggccacttcttctcagtca

SEQ ID NO: 9795 - DNA, 20 bp, synthetic construct
  misc_feature 1..20: note = CRISPR gRNA sequence
  source 1..20: mol_type = other DNA
cttcttctcagtcacagcca

SEQ ID NO: 9796 - DNA, 20 bp, synthetic construct
  misc_feature 1..20: note = CRISPR gRNA sequence
  source 1..20: mol_type = other DNA
gccacagccctactttgtgc

SEQ ID NO: 9797 - DNA, 20 bp, synthetic construct
  misc_feature 1..20: note = CRISPR gRNA sequence
  source 1..20: mol_type = other DNA
ccacagccctactttgtgcc

SEQ ID NO: 9798 - DNA, 20 bp, synthetic construct
  misc_feature 1..20: note = CRISPR gRNA sequence
  source 1..20: mol_type = other DNA
cagccctactttgtgccggg

SEQ ID NO: 9799 - DNA, 20 bp, synthetic construct
  misc_feature 1..20: note = CRISPR gRNA sequence
  source 1..20: mol_type = other DNA
ctttgtgccgggcagtgtgc

SEQ ID NO: 9800 - DNA, 20 bp, synthetic construct
  misc_feature 1..20: note = CRISPR gRNA sequence
  source 1..20: mol_type = other DNA
ccgggcagtgtgccagctct

SEQ ID NO: 9801 - DNA, 20 bp, synthetic construct
  misc_feature 1..20: note = CRISPR gRNA sequence
  source 1..20: mol_type = other DNA
gggcagtgtgccagctctca

SEQ ID NO: 9802 - DNA, 20 bp, synthetic construct
  misc_feature 1..20: note = CRISPR gRNA sequence
  source 1..20: mol_type = other DNA
ggcagtgtgccagctctcag

SEQ ID NO: 9803 - DNA, 20 bp, synthetic construct
  misc_feature 1..20: note = CRISPR gRNA sequence
  source 1..20: mol_type = other DNA
ccagctctcagaggccctgc

SEQ ID NO: 9804 - DNA, 20 bp, synthetic construct
  misc_feature 1..20: note = CRISPR gRNA sequence
  source 1..20: mol_type = other DNA
agctctcagaggccctgctg

SEQ ID NO: 9805 - DNA, 20 bp, synthetic construct
  misc_feature 1..20: note = CRISPR gRNA sequence
  source 1..20: mol_type = other DNA
tcagaggccctgctggagct

SEQ ID NO: 9806 - DNA, 20 bp, synthetic construct
  misc_feature 1..20: note = CRISPR gRNA sequence
  source 1..20: mol_type = other DNA
cagaggccctgctggagctt

SEQ ID NO: 9807 - DNA, 20 bp, synthetic construct
  misc_feature 1..20: note = CRISPR gRNA sequence
  source 1..20: mol_type = other DNA
agaggccctgctggagcttg

SEQ ID NO: 9808 - DNA, 20 bp, synthetic construct
  misc_feature 1..20: note = CRISPR gRNA sequence
  source 1..20: mol_type = other DNA
aggccctgctggagcttggg

SEQ ID NO: 9809 - DNA, 20 bp, synthetic construct
  misc_feature 1..20: note = CRISPR gRNA sequence
  source 1..20: mol_type = other DNA
ggccctgctggagcttgggg

SEQ ID NO: 9810 - DNA, 20 bp, synthetic construct
  misc_feature 1..20: note = CRISPR gRNA sequence
  source 1..20: mol_type = other DNA
tggagcttggggaggacgcc

SEQ ID NO: 9811 - DNA, 20 bp, synthetic construct
  misc_feature 1..20: note = CRISPR gRNA sequence
  source 1..20: mol_type = other DNA
caagctgccctccacgctca

SEQ ID NO: 9812 - DNA, 20 bp, synthetic construct
  misc_feature 1..20: note = CRISPR gRNA sequence
  source 1..20: mol_type = other DNA
aagctgccctccacgctcac

SEQ ID NO: 9813 - DNA, 20 bp, synthetic construct
  misc_feature 1..20: note = CRISPR gRNA sequence
  source 1..20: mol_type = other DNA
acgctcacgggactctatgt

SEQ ID NO: 9814 - DNA, 20 bp, synthetic construct
  misc_feature 1..20: note = CRISPR gRNA sequence
  source 1..20: mol_type = other DNA
gggactctatgtcggcctgc

SEQ ID NO: 9815 - DNA, 20 bp, synthetic construct
  misc_feature 1..20: note = CRISPR gRNA sequence
  source 1..20: mol_type = other DNA
ggactctatgtcggcctgct

SEQ ID NO: 9816 - DNA, 20 bp, synthetic construct
  misc_feature 1..20: note = CRISPR gRNA sequence
  source 1..20: mol_type = other DNA
tgtcggcctgctgggccgtg

SEQ ID NO: 9817 - DNA, 20 bp, synthetic construct
  misc_feature 1..20: note = CRISPR gRNA sequence
  source 1..20: mol_type = other DNA
ctgggccgtgcagccctcga

SEQ ID NO: 9818 - DNA, 20 bp, synthetic construct
  misc_feature 1..20: note = CRISPR gRNA sequence
  source 1..20: mol_type = other DNA
gcagccctcgacagcccccc

SEQ ID NO: 9819 - DNA, 20 bp, synthetic construct
  misc_feature 1..20: note = CRISPR gRNA sequence
  source 1..20: mol_type = other DNA
cagccctcgacagccccccc

SEQ ID NO: 9820 - DNA, 20 bp, synthetic construct
  misc_feature 1..20: note = CRISPR gRNA sequence
  source 1..20: mol_type = other DNA
agccctcgacagcccccccg

SEQ ID NO: 9821 - DNA, 20 bp, synthetic construct
  misc_feature 1..20: note = CRISPR gRNA sequence
  source 1..20: mol_type = other DNA
cgacagcccccccggggccc

SEQ ID NO: 9822 - DNA, 20 bp, synthetic construct
  misc_feature 1..20: note = CRISPR gRNA sequence
  source 1..20: mol_type = other DNA
cagcccccccggggccctgg

SEQ ID NO: 9823 - DNA, 20 bp, synthetic construct
  misc_feature 1..20: note = CRISPR gRNA sequence
  source 1..20: mol_type = other DNA
gcccccccggggccctggca

SEQ ID NO: 9824 - DNA, 20 bp, synthetic construct
  misc_feature 1..20: note = CRISPR gRNA sequence
  source 1..20: mol_type = other DNA
ccccggggccctggcagagc

SEQ ID NO: 9825 - DNA, 20 bp, synthetic construct
  misc_feature 1..20: note = CRISPR gRNA sequence
  source 1..20: mol_type = other DNA
gggccctggcagagctggcc

SEQ ID NO: 9826 - DNA, 20 bp, synthetic construct
  misc_feature 1..20: note = CRISPR gRNA sequence
  source 1..20: mol_type = other DNA
cctggcagagctggccaagc

SEQ ID NO: 9827 - DNA, 20 bp, synthetic construct
  misc_feature 1..20: note = CRISPR gRNA sequence
  source 1..20: mol_type = other DNA
cagagctggccaagctggcc

SEQ ID NO: 9828 - DNA, 20 bp, synthetic construct
  misc_feature 1..20: note = CRISPR gRNA sequence
  source 1..20: mol_type = other DNA
agagctggccaagctggcct

SEQ ID NO: 9829 - DNA, 20 bp, synthetic construct
  misc_feature 1..20: note = CRISPR gRNA sequence
  source 1..20: mol_type = other DNA
agctggccaagctggcctgg

SEQ ID NO: 9830 - DNA, 20 bp, synthetic construct
  misc_feature 1..20: note = CRISPR gRNA sequence
  source 1..20: mol_type = other DNA
ggccaagctggcctgggagc

SEQ ID NO: 9831 - DNA, 20 bp, synthetic construct
  misc_feature 1..20: note = CRISPR gRNA sequence
  source 1..20: mol_type = other DNA
gccaagctggcctgggagct

SEQ ID NO: 9832 - DNA, 20 bp, synthetic construct
  misc_feature 1..20: note = CRISPR gRNA sequence
  source 1..20: mol_type = other DNA
ctggcctgggagctgggccg

SEQ ID NO: 9833 - DNA, 20 bp, synthetic construct
  misc_feature 1..20: note = CRISPR gRNA sequence
  source 1..20: mol_type = other DNA
gagctgggccgcagacatca

SEQ ID NO: 9834 - DNA, 20 bp, synthetic construct
  misc_feature 1..20: note = CRISPR gRNA sequence
  source 1..20: mol_type = other DNA
gcagacatcaaagtacccta

SEQ ID NO: 9835 - DNA, 20 bp, synthetic construct
  misc_feature 1..20: note = CRISPR gRNA sequence
  source 1..20: mol_type = other DNA
cagacatcaaagtaccctac

SEQ ID NO: 9836 - DNA, 20 bp, synthetic construct
  misc_feature 1..20: note = CRISPR gRNA sequence
  source 1..20: mol_type = other DNA
gacatcaaagtaccctacag

SEQ ID NO: 9837 - DNA, 20 bp, synthetic construct
  misc_feature 1..20: note = CRISPR gRNA sequence
  source 1..20: mol_type = other DNA
acatcaaagtaccctacagg

SEQ ID NO: 9838 - DNA, 20 bp, synthetic construct
  misc_feature 1..20: note = CRISPR gRNA sequence
  source 1..20: mol_type = other DNA
aaagtaccctacaggaggac

SEQ ID NO: 9839 - DNA, 20 bp, synthetic construct
  misc_feature 1..20: note = CRISPR gRNA sequence
  source 1..20: mol_type = other DNA
ggaggaccagttcccatccg

SEQ ID NO: 9840 - DNA, 20 bp, synthetic construct
  misc_feature 1..20: note = CRISPR gRNA sequence
  source 1..20: mol_type = other DNA
cagttcccatccgcagacgt

SEQ ID NO: 9841 - DNA, 20 bp, synthetic construct
  misc_feature 1..20: note = CRISPR gRNA sequence
  source 1..20: mol_type = other DNA
agttcccatccgcagacgtg

SEQ ID NO: 9842 - DNA, 20 bp, synthetic construct
  misc_feature 1..20: note = CRISPR gRNA sequence
  source 1..20: mol_type = other DNA
catccgcagacgtgaggacc

SEQ ID NO: 9843 - DNA, 20 bp, synthetic construct
  misc_feature 1..20: note = CRISPR gRNA sequence
  source 1..20: mol_type = other DNA
atccgcagacgtgaggacct

SEQ ID NO: 9844 - DNA, 20 bp, synthetic construct
  misc_feature 1..20: note = CRISPR gRNA sequence
  source 1..20: mol_type = other DNA
agacgtgaggacctgggcga

SEQ ID NO: 9845 - DNA, 20 bp, synthetic construct
  misc_feature 1..20: note = CRISPR gRNA sequence
  source 1..20: mol_type = other DNA
gaggacctgggcgatggcca

SEQ ID NO: 9846 - DNA, 20 bp, synthetic construct
  misc_feature 1..20: note = CRISPR gRNA sequence
  source 1..20: mol_type = other DNA
aggacctgggcgatggccaa

SEQ ID NO: 9847 - DNA, 20 bp, synthetic construct
  misc_feature 1..20: note = CRISPR gRNA sequence
  source 1..20: mol_type = other DNA
ctgggcgatggccaaaggct

SEQ ID NO: 9848 - DNA, 20 bp, synthetic construct
  misc_feature 1..20: note = CRISPR gRNA sequence
  source 1..20: mol_type = other DNA
gcttagtccaacacccaccg

SEQ ID NO: 9849 - DNA, 20 bp, synthetic construct
  misc_feature 1..20: note = CRISPR gRNA sequence
  source 1..20: mol_type = other DNA
cttagtccaacacccaccgc

SEQ ID NO: 9850 - DNA, 20 bp, synthetic construct
  misc_feature 1..20: note = CRISPR gRNA sequence
  source 1..20: mol_type = other DNA
ccaacacccaccgcgggccg

SEQ ID NO: 9851 - DNA, 20 bp, synthetic construct
  misc_feature 1..20: note = CRISPR gRNA sequence
  source 1..20: mol_type = other DNA
aacacccaccgcgggccgca

SEQ ID NO: 9852 - DNA, 20 bp, synthetic construct
  misc_feature 1..20: note = CRISPR gRNA sequence
  source 1..20: mol_type = other DNA
caccgcgggccgcagagtcc

SEQ ID NO: 9853 - DNA, 20 bp, synthetic construct
  misc_feature 1..20: note = CRISPR gRNA sequence
  source 1..20: mol_type = other DNA
gcgggccgcagagtccgagc

SEQ ID NO: 9854 - DNA, 20 bp, synthetic construct
  misc_feature 1..20: note = CRISPR gRNA sequence
  source 1..20: mol_type = other DNA
gagtccgagctggccttccc

SEQ ID NO: 9855 - DNA, 20 bp, synthetic construct
  misc_feature 1..20: note = CRISPR gRNA sequence
  source 1..20: mol_type = other DNA
cttcctcctgcaatgcttcc

SEQ ID NO: 9856 - DNA, 20 bp, synthetic construct
  misc_feature 1..20: note = CRISPR gRNA sequence
  source 1..20: mol_type = other DNA
ttcctcctgcaatgcttcct

SEQ ID NO: 9857 - DNA, 20 bp, synthetic construct
  misc_feature 1..20: note = CRISPR gRNA sequence
  source 1..20: mol_type = other DNA
tcctcctgcaatgcttcctg

SEQ ID NO: 9858 - DNA, 20 bp, synthetic construct
  misc_feature 1..20: note = CRISPR gRNA sequence
  source 1..20: mol_type = other DNA
cctcctgcaatgcttcctgg

SEQ ID NO: 9859 - DNA, 20 bp, synthetic construct
  misc_feature 1..20: note = CRISPR gRNA sequence
  source 1..20: mol_type = other DNA
aatgcttcctgggggccctg

SEQ ID NO: 9860 - DNA, 20 bp, synthetic construct
  misc_feature 1..20: note = CRISPR gRNA sequence
  source 1..20: mol_type = other DNA
cttcctgggggccctgtggc

SEQ ID NO: 9861 - DNA, 20 bp, synthetic construct
  misc_feature 1..20: note = CRISPR gRNA sequence
  source 1..20: mol_type = other DNA
ggggccctgtggctggctct

SEQ ID NO: 9862 - DNA, 20 bp, synthetic construct
  misc_feature 1..20: note = CRISPR gRNA sequence
  source 1..20: mol_type = other DNA
gccctgtggctggctctgag

SEQ ID NO: 9863 - DNA, 20 bp, synthetic construct
  misc_feature 1..20: note = CRISPR gRNA sequence
  source 1..20: mol_type = other DNA
tggctctgagtggcgaaatc

SEQ ID NO: 9864 - DNA, 20 bp, synthetic construct
  misc_feature 1..20: note = CRISPR gRNA sequence
  source 1..20: mol_type = other DNA
ggctctgagtggcgaaatca

SEQ ID NO: 9865 - DNA, 20 bp, synthetic construct
  misc_feature 1..20: note = CRISPR gRNA sequence
  source 1..20: mol_type = other DNA
tgagtggcgaaatcaaggac

SEQ ID NO: 9866 - DNA, 20 bp, synthetic construct
  misc_feature 1..20: note = CRISPR gRNA sequence
  source 1..20: mol_type = other DNA
gagtggcgaaatcaaggaca

SEQ ID NO: 9867 - DNA, 20 bp, synthetic construct
  misc_feature 1..20: note = CRISPR gRNA sequence
  source 1..20: mol_type = other DNA
gtggcgaaatcaaggacaag

SEQ ID NO: 9868 - DNA, 20 bp, synthetic construct
  misc_feature 1..20: note = CRISPR gRNA sequence
  source 1..20: mol_type = other DNA
tcaaggacaaggagctcccg

SEQ ID NO: 9869 - DNA, 20 bp, synthetic construct
  misc_feature 1..20: note = CRISPR gRNA sequence
  source 1..20: mol_type = other DNA
caaggagctcccgcagtacc

SEQ ID NO: 9870 - DNA, 20 bp, synthetic construct
  misc_feature 1..20: note = CRISPR gRNA sequence
  source 1..20: mol_type = other DNA
cagtacctagcattgacccc

SEQ ID NO: 9871 - DNA, 20 bp, synthetic construct
  misc_feature 1..20: note = CRISPR gRNA sequence
  source 1..20: mol_type = other DNA
agtacctagcattgacccca

SEQ ID NO: 9872 - DNA, 20 bp, synthetic construct
  misc_feature 1..20: note = CRISPR gRNA sequence
  source 1..20: mol_type = other DNA
acctagcattgaccccaagg

SEQ ID NO: 9873 - DNA, 20 bp, synthetic construct
  misc_feature 1..20: note = CRISPR gRNA sequence
  source 1..20: mol_type = other DNA
tagcattgaccccaaggaag

SEQ ID NO: 9874 - DNA, 20 bp, synthetic construct
  misc_feature 1..20: note = CRISPR gRNA sequence
  source 1..20: mol_type = other DNA
gcattgaccccaaggaagaa

SEQ ID NO: 9875 - DNA, 20 bp, synthetic construct
  misc_feature 1..20: note = CRISPR gRNA sequence
  source 1..20: mol_type = other DNA
cattgaccccaaggaagaag

SEQ ID NO: 9876 - DNA, 20 bp, synthetic construct
  misc_feature 1..20: note = CRISPR gRNA sequence
  source 1..20: mol_type = other DNA
agaagaggccctatgacaac

SEQ ID NO: 9877 - DNA, 20 bp, synthetic construct
  misc_feature 1..20: note = CRISPR gRNA sequence
  source 1..20: mol_type = other DNA
gaggccctatgacaactggc

SEQ ID NO: 9878 - DNA, 20 bp, synthetic construct
  misc_feature 1..20: note = CRISPR gRNA sequence
  source 1..20: mol_type = other DNA
ggccctatgacaactggctg

SEQ ID NO: 9879 - DNA, 20 bp, synthetic construct
  misc_feature 1..20: note = CRISPR gRNA sequence
  source 1..20: mol_type = other DNA
gccctatgacaactggctgg

SEQ ID NO: 9880 - DNA, 20 bp, synthetic construct
  misc_feature 1..20: note = CRISPR gRNA sequence
  source 1..20: mol_type = other DNA
ccctatgacaactggctgga

SEQ ID NO: 9881 - DNA, 20 bp, synthetic construct
  misc_feature 1..20: note = CRISPR gRNA sequence
  source 1..20: mol_type = other DNA
ggagggcgtgccacgctttc

SEQ ID NO: 9882 - DNA, 20 bp, synthetic construct
  misc_feature 1..20: note = CRISPR gRNA sequence
  source 1..20: mol_type = other DNA
ggcgtgccacgctttctggc

SEQ ID NO: 9883 - DNA, 20 bp, synthetic construct
  misc_feature 1..20: note = CRISPR gRNA sequence
  source 1..20: mol_type = other DNA
gcgtgccacgctttctggct

SEQ ID NO: 9884 - DNA, 20 bp, synthetic construct
  misc_feature 1..20: note = CRISPR gRNA sequence
  source 1..20: mol_type = other DNA
ttctggctgggctgatcttc

SEQ ID NO: 9885 - DNA, 20 bp, synthetic construct
  misc_feature 1..20: note = CRISPR gRNA sequence
  source 1..20: mol_type = other DNA
ccagcctcccgcccgctgcc

SEQ ID NO: 9886 - DNA, 20 bp, synthetic construct
  misc_feature 1..20: note = CRISPR gRNA sequence
  source 1..20: mol_type = other DNA
cagcctcccgcccgctgcct

SEQ ID NO: 9887 - DNA, 20 bp, synthetic construct
  misc_feature 1..20: note = CRISPR gRNA sequence
  source 1..20: mol_type = other DNA
gcctcccgcccgctgcctgg

SEQ ID NO: 9888 - DNA, 20 bp, synthetic construct
  misc_feature 1..20: note = CRISPR gRNA sequence
  source 1..20: mol_type = other DNA
cgctgcctgggagccctact

SEQ ID NO: 9889 - DNA, 20 bp, synthetic construct
  misc_feature 1..20: note = CRISPR gRNA sequence
  source 1..20: mol_type = other DNA
gctgcctgggagccctactc

SEQ ID NO: 9890 - DNA, 20 bp, synthetic construct
  misc_feature 1..20: note = CRISPR gRNA sequence
  source 1..20: mol_type = other DNA
gggagccctactcgggccat

SEQ ID NO: 9891 - DNA, 20 bp, synthetic construct
  misc_feature 1..20: note = CRISPR gRNA sequence
  source 1..20: mol_type = other DNA
agccctactcgggccatcgg

SEQ ID NO: 9892 - DNA, 20 bp, synthetic construct
  misc_feature 1..20: note = CRISPR gRNA sequence
  source 1..20: mol_type = other DNA
cgggccatcggcggctgcct

SEQ ID NO: 9893 - DNA, 20 bp, synthetic construct
  misc_feature 1..20: note = CRISPR gRNA sequence
  source 1..20: mol_type = other DNA
gccatcggcggctgcctcgg

SEQ ID NO: 9894 - DNA, 20 bp, synthetic construct
  misc_feature 1..20: note = CRISPR gRNA sequence
  source 1..20: mol_type = other DNA
tcggcggctgcctcggtgga

SEQ ID NO: 9895 - DNA, 20 bp, synthetic construct
  misc_feature 1..20: note = CRISPR gRNA sequence
  source 1..20: mol_type = other DNA
cggcggctgcctcggtggac

SEQ ID NO: 9896 - DNA, 20 bp, synthetic construct
  misc_feature 1..20: note = CRISPR gRNA sequence
  source 1..20: mol_type = other DNA
cggctgcctcggtggacagg

SEQ ID NO: 9897 - DNA, 20 bp, synthetic construct
  misc_feature 1..20: note = CRISPR gRNA sequence
  source 1..20: mol_type = other DNA
ctgcctcggtggacaggaag

SEQ ID NO: 9898 - DNA, 20 bp, synthetic construct
  misc_feature 1..20: note = CRISPR gRNA sequence
  source 1..20: mol_type = other DNA
cctcggtggacaggaagcag

SEQ ID NO: 9899 - DNA, 20 bp, synthetic construct
  misc_feature 1..20: note = CRISPR gRNA sequence
  source 1..20: mol_type = other DNA
ctcggtggacaggaagcaga

SEQ ID NO: 9900 - DNA, 20 bp, synthetic construct
  misc_feature 1..20: note = CRISPR gRNA sequence
  source 1..20: mol_type = other DNA
aggaagcagaaggtgcttgc

SEQ ID NO: 9901 - DNA, 20 bp, synthetic construct
  misc_feature 1..20: note = CRISPR gRNA sequence
  source 1..20: mol_type = other DNA
ggaagcagaaggtgcttgcg

SEQ ID NO: 9902 - DNA, 20 bp, synthetic construct
  misc_feature 1..20: note = CRISPR gRNA sequence
  source 1..20: mol_type = other DNA
aggtgcttgcgaggtacctg

SEQ ID NO: 9903 - DNA, 20 bp, synthetic construct
  misc_feature 1..20: note = CRISPR gRNA sequence
  source 1..20: mol_type = other DNA
tgcttgcgaggtacctgaag

SEQ ID NO: 9904 - DNA, 20 bp, synthetic construct
  misc_feature 1..20: note = CRISPR gRNA sequence
  source 1..20: mol_type = other DNA
cgaggtacctgaagcggctg

SEQ ID NO: 9905 - DNA, 20 bp, synthetic construct
  misc_feature 1..20: note = CRISPR gRNA sequence
  source 1..20: mol_type = other DNA
gtacctgaagcggctgcagc

SEQ ID NO: 9906 - DNA, 20 bp, synthetic construct
  misc_feature 1..20: note = CRISPR gRNA sequence
  source 1..20: mol_type = other DNA
tacctgaagcggctgcagcc

SEQ ID NO: 9907 - DNA, 20 bp, synthetic construct
  misc_feature 1..20: note = CRISPR gRNA sequence
  source 1..20: mol_type = other DNA
acctgaagcggctgcagccg

SEQ ID NO: 9908 - DNA, 20 bp, synthetic construct
  misc_feature 1..20: note = CRISPR gRNA sequence
  source 1..20: mol_type = other DNA
ggctgcagccggggacactg

SEQ ID NO: 9909 - DNA, 20 bp, synthetic construct
  misc_feature 1..20: note = CRISPR gRNA sequence
  source 1..20: mol_type = other DNA
gctgcagccggggacactgc

SEQ ID NO: 9910 - DNA, 20 bp, synthetic construct
  misc_feature 1..20: note = CRISPR gRNA sequence
  source 1..20: mol_type = other DNA
agccggggacactgcgggcg

SEQ ID NO: 9911 - DNA, 20 bp, synthetic construct
  misc_feature 1..20: note = CRISPR gRNA sequence
  source 1..20: mol_type = other DNA
cggggacactgcgggcgcgg

SEQ ID NO: 9912 - DNA, 20 bp, synthetic construct
  misc_feature 1..20: note = CRISPR gRNA sequence
  source 1..20: mol_type = other DNA
actgcgggcgcggcagctgc

SEQ ID NO: 9913 - DNA, 20 bp, synthetic construct
  misc_feature 1..20: note = CRISPR gRNA sequence
  source 1..20: mol_type = other DNA
tgcgggcgcggcagctgctg

SEQ ID NO: 9914 - DNA, 20 bp, synthetic construct
  misc_feature 1..20: note = CRISPR gRNA sequence
  source 1..20: mol_type = other DNA
agctgctgcactgcgcccac

SEQ ID NO: 9915 - DNA, 20 bp, synthetic construct
  misc_feature 1..20: note = CRISPR gRNA sequence
  source 1..20: mol_type = other DNA
gctgctgcactgcgcccacg

SEQ ID NO: 9916 - DNA, 20 bp, synthetic construct
  misc_feature 1..20: note = CRISPR gRNA sequence
  source 1..20: mol_type = other DNA
tgcactgcgcccacgaggcc

SEQ ID NO: 9917 - DNA, 20 bp, synthetic construct
  misc_feature 1..20: note = CRISPR gRNA sequence
  source 1..20: mol_type = other DNA
gcactgcgcccacgaggccg

SEQ ID NO: 9918 - DNA, 20 bp, synthetic construct
  misc_feature 1..20: note = CRISPR gRNA sequence
  source 1..20: mol_type = other DNA
actgcgcccacgaggccgag

SEQ ID NO: 9919 - DNA, 20 bp, synthetic construct
  misc_feature 1..20: note = CRISPR gRNA sequence
  source 1..20: mol_type = other DNA
ctgcgcccacgaggccgagg

SEQ ID NO: 9920 - DNA, 20 bp, synthetic construct
  misc_feature 1..20: note = CRISPR gRNA sequence
  source 1..20: mol_type = other DNA
gcccacgaggccgaggaggc

SEQ ID NO: 9921 - DNA, 20 bp, synthetic construct
  misc_feature 1..20: note = CRISPR gRNA sequence
  source 1..20: mol_type = other DNA
aggccgaggaggctggaatt

SEQ ID NO: 9922 - DNA, 20 bp, synthetic construct
  misc_feature 1..20: note = CRISPR gRNA sequence
  source 1..20: mol_type = other DNA
ccgaggaggctggaatttgg

SEQ ID NO: 9923 - DNA, 20 bp, synthetic construct
  misc_feature 1..20: note = CRISPR gRNA sequence
  source 1..20: mol_type = other DNA
ggctggaatttggcagcacg

SEQ ID NO: 9924 - DNA, 20 bp, synthetic construct
  misc_feature 1..20: note = CRISPR gRNA sequence
  source 1..20: mol_type = other DNA
gaatttggcagcacgtggta

SEQ ID NO: 9925 - DNA, 20 bp, synthetic construct
  misc_feature 1..20: note = CRISPR gRNA sequence
  source 1..20: mol_type = other DNA
aatttggcagcacgtggtac

SEQ ID NO: 9926 - DNA, 20 bp, synthetic construct
  misc_feature 1..20: note = CRISPR gRNA sequence
  source 1..20: mol_type = other DNA
tttggcagcacgtggtacag

SEQ ID NO: 9927 - DNA, 20 bp, synthetic construct
  misc_feature 1..20: note = CRISPR gRNA sequence
  source 1..20: mol_type = other DNA
cacgtggtacaggagctccc

SEQ ID NO: 9928 - DNA, 20 bp, synthetic construct
  misc_feature 1..20: note = CRISPR gRNA sequence
  source 1..20: mol_type = other DNA
ccccggccgcctctcttttc

SEQ ID NO: 9929 - DNA, 20 bp, synthetic construct
  misc_feature 1..20: note = CRISPR gRNA sequence
  source 1..20: mol_type = other DNA
cccggccgcctctcttttct

SEQ ID NO: 9930 - DNA, 20 bp, synthetic construct
  misc_feature 1..20: note = CRISPR gRNA sequence
  source 1..20: mol_type = other DNA
gcctcctgatgcacatgtac

SEQ ID NO: 9931 - DNA, 20 bp, synthetic construct
  misc_feature 1..20: note = CRISPR gRNA sequence
  source 1..20: mol_type = other DNA
cctcctgatgcacatgtact

SEQ ID NO: 9932 - DNA, 20 bp, synthetic construct
  misc_feature 1..20: note = CRISPR gRNA sequence
  source 1..20: mol_type = other DNA
ctgatgcacatgtactgggc

SEQ ID NO: 9933 - DNA, 20 bp, synthetic construct
  misc_feature 1..20: note = CRISPR gRNA sequence
  source 1..20: mol_type = other DNA
tgatgcacatgtactgggca

SEQ ID NO: 9934 - DNA, 20 bp, synthetic construct
  misc_feature 1..20: note = CRISPR gRNA sequence
  source 1..20: mol_type = other DNA
acatgtactgggcaaggcct

SEQ ID NO: 9935 - DNA, 20 bp, synthetic construct
  misc_feature 1..20: note = CRISPR gRNA sequence
  source 1..20: mol_type = other DNA
atgtactgggcaaggccttg

SEQ ID NO: 9936 - DNA, 20 bp, synthetic construct
  misc_feature 1..20: note = CRISPR gRNA sequence
  source 1..20: mol_type = other DNA
tgtactgggcaaggccttgg

SEQ ID NO: 9937 - DNA, 20 bp, synthetic construct
  misc_feature 1..20: note = CRISPR gRNA sequence
  source 1..20: mol_type = other DNA
actgggcaaggccttggagg

SEQ ID NO: 9938 - DNA, 20 bp, synthetic construct
  misc_feature 1..20: note = CRISPR gRNA sequence
  source 1..20: mol_type = other DNA
gggcaaggccttggaggcgg

SEQ ID NO: 9939 - DNA, 20 bp, synthetic construct
  misc_feature 1..20: note = CRISPR gRNA sequence
  source 1..20: mol_type = other DNA
ggcaaggccttggaggcggc

SEQ ID NO: 9940 - DNA, 20 bp, synthetic construct
  misc_feature 1..20: note = CRISPR gRNA sequence
  source 1..20: mol_type = other DNA
ggccttggaggcggcgggcc

SEQ ID NO: 9941 - DNA, 20 bp, synthetic construct
  misc_feature 1..20: note = CRISPR gRNA sequence
  source 1..20: mol_type = other DNA
ggcgggccaagacttctccc

SEQ ID NO: 9942 - DNA, 20 bp, synthetic construct
  misc_feature 1..20: note = CRISPR gRNA sequence
  source 1..20: mol_type = other DNA
gacttctccctggacctccg

SEQ ID NO: 9943 - DNA, 20 bp, synthetic construct
  misc_feature 1..20: note = CRISPR gRNA sequence
  source 1..20: mol_type = other DNA
tccctggacctccgcagcac

SEQ ID NO: 9944 - DNA, 20 bp, synthetic construct
  misc_feature 1..20: note = CRISPR gRNA sequence
  source 1..20: mol_type = other DNA
agcactggcatttgcccctc

SEQ ID NO: 9945 - DNA, 20 bp, synthetic construct
  misc_feature 1..20: note = CRISPR gRNA sequence
  source 1..20: mol_type = other DNA
tggcatttgcccctctggat

SEQ ID NO: 9946 - DNA, 20 bp, synthetic construct
  misc_feature 1..20: note = CRISPR gRNA sequence
  source 1..20: mol_type = other DNA
ggcatttgcccctctggatt

SEQ ID NO: 9947 - DNA, 20 bp, synthetic construct
  misc_feature 1..20: note = CRISPR gRNA sequence
  source 1..20: mol_type = other DNA
gcatttgcccctctggattg

SEQ ID NO: 9948 - DNA, 20 bp, synthetic construct
  misc_feature 1..20: note = CRISPR gRNA sequence
  source 1..20: mol_type = other DNA
atttgcccctctggattggg

SEQ ID NO: 9949 - DNA, 20 bp, synthetic construct
  misc_feature 1..20: note = CRISPR gRNA sequence
  source 1..20: mol_type = other DNA
ctctggattggggagcctcg

SEQ ID NO: 9950 - DNA, 20 bp, synthetic construct
  misc_feature 1..20: note = CRISPR gRNA sequence
  source 1..20: mol_type = other DNA
tctggattggggagcctcgt

SEQ ID NO: 9951 - DNA, 20 bp, synthetic construct
  misc_feature 1..20: note = CRISPR gRNA sequence
  source 1..20: mol_type = other DNA
ttggggagcctcgtgggact

SEQ ID NO: 9952 - DNA, 20 bp, synthetic construct
  misc_feature 1..20: note = CRISPR gRNA sequence
  source 1..20: mol_type = other DNA
ctcagctgtgtcacccgttt

SEQ ID NO: 9953 - DNA, 20 bp, synthetic construct
  misc_feature 1..20: note = CRISPR gRNA sequence
  source 1..20: mol_type = other DNA
tcagctgtgtcacccgtttc

SEQ ID NO: 9954 - DNA, 20 bp, synthetic construct
  misc_feature 1..20: note = CRISPR gRNA sequence
  source 1..20: mol_type = other DNA
gctgtgtcacccgtttcagg

SEQ ID NO: 9955 - DNA, 20 bp, synthetic construct
  misc_feature 1..20: note = CRISPR gRNA sequence
  source 1..20: mol_type = other DNA
ctgtgtcacccgtttcaggt

SEQ ID NO: 9956 - DNA, 20 bp, synthetic construct
  misc_feature 1..20: note = CRISPR gRNA sequence
  source 1..20: mol_type = other DNA
tgtgtcacccgtttcaggtg

SEQ ID NO: 9957 - DNA, 20 bp, synthetic construct
  misc_feature 1..20: note = CRISPR gRNA sequence
  source 1..20: mol_type = other DNA
tcacccgtttcaggtggggt

SEQ ID NO: 9958 - DNA, 20 bp, synthetic construct
  misc_feature 1..20: note = CRISPR gRNA sequence
  source 1..20: mol_type = other DNA
cacccgtttcaggtggggtg

SEQ ID NO: 9959 - DNA, 20 bp, synthetic construct
  misc_feature 1..20: note = CRISPR gRNA sequence
  source 1..20: mol_type = other DNA
acccgtttcaggtggggtga

SEQ ID NO: 9960 - DNA, 20 bp, synthetic construct
  misc_feature 1..20: note = CRISPR gRNA sequence
  source 1..20: mol_type = other DNA
cccgtttcaggtggggtgag

SEQ ID NO: 9961 - DNA, 20 bp, synthetic construct
  misc_feature 1..20: note = CRISPR gRNA sequence
  source 1..20: mol_type = other DNA
ttcaggtggggtgaggggct

SEQ ID NO: 9962 - DNA, 20 bp, synthetic construct
  misc_feature 1..20: note = CRISPR gRNA sequence
  source 1..20: mol_type = other DNA
tcaggtggggtgaggggctt

SEQ ID NO: 9963 - DNA, 20 bp, synthetic construct
  misc_feature 1..20: note = CRISPR gRNA sequence
  source 1..20: mol_type = other DNA
caggtggggtgaggggcttg

SEQ ID NO: 9964 - DNA, 20 bp, synthetic construct
  misc_feature 1..20: note = CRISPR gRNA sequence
  source 1..20: mol_type = other DNA
gtggggtgaggggcttgggg

SEQ ID NO: 9965 - DNA, 20 bp, synthetic construct
  misc_feature 1..20: note = CRISPR gRNA sequence
  source 1..20: mol_type = other DNA
ggggtgaggggcttggggaa

SEQ ID NO: 9966 - DNA, 20 bp, synthetic construct
  misc_feature 1..20: note = CRISPR gRNA sequence
  source 1..20: mol_type = other DNA
gggaagagacatccttgtgt

SEQ ID NO: 9967 - DNA, 20 bp, synthetic construct
  misc_feature 1..20: note = CRISPR gRNA sequence
  source 1..20: mol_type = other DNA
ggaagagacatccttgtgtt

SEQ ID NO: 9968 - DNA, 20 bp, synthetic construct
  misc_feature 1..20: note = CRISPR gRNA sequence
  source 1..20: mol_type = other DNA
cttgtgttgggcattaactg

SEQ ID NO: 9969 - DNA, 20 bp, synthetic construct
  misc_feature 1..20: note = CRISPR gRNA sequence
  source 1..20: mol_type = other DNA
ttgggcattaactgcggtct

SEQ ID NO: 9970 - DNA, 20 bp, synthetic construct
  misc_feature 1..20: note = CRISPR gRNA sequence
  source 1..20: mol_type = other DNA
ttaactgcggtcttggtgcc

SEQ ID NO: 9971 - DNA, 20 bp, synthetic construct
  misc_feature 1..20: note = CRISPR gRNA sequence
  source 1..20: mol_type = other DNA
tgcggtcttggtgccaagcc

SEQ ID NO: 9972 - DNA, 20 bp, synthetic construct
  misc_feature 1..20: note = CRISPR gRNA sequence
  source 1..20: mol_type = other DNA
gtgccaagcccagtgctctg

SEQ ID NO: 9973 - DNA, 20 bp, synthetic construct
  misc_feature 1..20: note = CRISPR gRNA sequence
  source 1..20: mol_type = other DNA
tgccaagcccagtgctctgt

SEQ ID NO: 9974 - DNA, 20 bp, synthetic construct
  misc_feature 1..20: note = CRISPR gRNA sequence
  source 1..20: mol_type = other DNA
gccaagcccagtgctctgtg

SEQ ID NO: 9975 - DNA, 20 bp, synthetic construct
  misc_feature 1..20: note = CRISPR gRNA sequence
  source 1..20: mol_type = other DNA
gtgctctgtggggtctcttt

SEQ ID NO: 9976 - DNA, 20 bp, synthetic construct
  misc_feature 1..20: note = CRISPR gRNA sequence
  source 1..20: mol_type = other DNA
gtggggtctcttttagtatg

SEQ ID NO: 9977 - DNA, 20 bp, synthetic construct
  misc_feature 1..20: note = CRISPR gRNA sequence
  source 1..20: mol_type = other DNA
ggggtctcttttagtatgca

SEQ ID NO: 9978 - DNA, 20 bp, synthetic construct
  misc_feature 1..20: note = CRISPR gRNA sequence
  source 1..20: mol_type = other DNA
gtctcttttagtatgcagag

SEQ ID NO: 9979 - DNA, 20 bp, synthetic construct
  misc_feature 1..20: note = CRISPR gRNA sequence
  source 1..20: mol_type = other DNA
cttttagtatgcagagcagc

SEQ ID NO: 9980 - DNA, 20 bp, synthetic construct
  misc_feature 1..20: note = CRISPR gRNA sequence
  source 1..20: mol_type = other DNA
ttttagtatgcagagcagcc

SEQ ID NO: 9981 - DNA, 20 bp, synthetic construct
  misc_feature 1..20: note = CRISPR gRNA sequence
  source 1..20: mol_type = other DNA
tagtatgcagagcagccggg

SEQ ID NO: 9982 - DNA, 20 bp, synthetic construct
  misc_feature 1..20: note = CRISPR gRNA sequence
  source 1..20: mol_type = other DNA
agtatgcagagcagccgggt

SEQ ID NO: 9983 - DNA, 20 bp, synthetic construct
  misc_feature 1..20: note = CRISPR gRNA sequence
  source 1..20: mol_type = other DNA
gtatgcagagcagccgggtg

SEQ ID NO: 9984 - DNA, 20 bp, synthetic construct
  misc_feature 1..20: note = CRISPR gRNA sequence
  source 1..20: mol_type = other DNA
tgcagagcagccgggtgggg

SEQ ID NO: 9985 - DNA, 20 bp, synthetic construct
  misc_feature 1..20: note = CRISPR gRNA sequence
  source 1..20: mol_type = other DNA
agcagccgggtggggcagaa

SEQ ID NO: 9986 - DNA, 20 bp, synthetic construct
  misc_feature 1..20: note = CRISPR gRNA sequence
  source 1..20: mol_type = other DNA
aatggattctctccattttt

SEQ ID NO: 9987 - DNA, 20 bp, synthetic construct
  misc_feature 1..20: note = CRISPR gRNA sequence
  source 1..20: mol_type = other DNA
attctctccatttttaagat

SEQ ID NO: 9988 - DNA, 20 bp, synthetic construct
  misc_feature 1..20: note = CRISPR gRNA sequence
  source 1..20: mol_type = other DNA
ttctctccatttttaagatg

SEQ ID NO: 9989 - DNA, 20 bp, synthetic construct
  misc_feature 1..20: note = CRISPR gRNA sequence
  source 1..20: mol_type = other DNA
atttttaagatgaggatgtt

SEQ ID NO: 9990 - DNA, 20 bp, synthetic construct
  misc_feature 1..20: note = CRISPR gRNA sequence
  source 1..20: mol_type = other DNA
tttttaagatgaggatgttg

SEQ ID NO: 9991 - DNA, 20 bp, synthetic construct
  misc_feature 1..20: note = CRISPR gRNA sequence
  source 1..20: mol_type = other DNA
aagatgaggatgttgaggct

SEQ ID NO: 9992 - DNA, 20 bp, synthetic construct
  misc_feature 1..20: note = CRISPR gRNA sequence
  source 1..20: mol_type = other DNA
gatgaggatgttgaggctca

SEQ ID NO: 9993 - DNA, 20 bp, synthetic construct
  misc_feature 1..20: note = CRISPR gRNA sequence
  source 1..20: mol_type = other DNA
tgaggatgttgaggctcaga

SEQ ID NO: 9994 - DNA, 20 bp, synthetic construct
  misc_feature 1..20: note = CRISPR gRNA sequence
  source 1..20: mol_type = other DNA
gaggatgttgaggctcagag

SEQ ID NO: 9995 - DNA, 20 bp, synthetic construct
  misc_feature 1..20: note = CRISPR gRNA sequence
  source 1..20: mol_type = other DNA
aggatgttgaggctcagaga

SEQ ID NO: 9996 - DNA, 20 bp, synthetic construct
  misc_feature 1..20: note = CRISPR gRNA sequence
  source 1..20: mol_type = other DNA
ggatgttgaggctcagagag

SEQ ID NO: 9997 - DNA, 20 bp, synthetic construct
  misc_feature 1..20: note = CRISPR gRNA sequence
  source 1..20: mol_type = other DNA
tgttgaggctcagagagggg

SEQ ID NO: 9998 - DNA, 20 bp, synthetic construct
  misc_feature 1..20: note = CRISPR gRNA sequence
  source 1..20: mol_type = other DNA
aggggcagccacttgccaca

SEQ ID NO: 9999 - DNA, 20 bp, synthetic construct
  misc_feature 1..20: note = CRISPR gRNA sequence
  source 1..20: mol_type = other DNA
gcagccacttgccacacagc

SEQ ID NO: 10000 - DNA, 20 bp, synthetic construct
  misc_feature 1..20: note = CRISPR gRNA sequence
  source 1..20: mol_type = other DNA
ccacttgccacacagcaagt

SEQ ID NO: 10001 - DNA, 20 bp, synthetic construct
  misc_feature 1..20: note = CRISPR gRNA sequence
  source 1..20: mol_type = other DNA
acttgccacacagcaagtga

SEQ ID NO: 10002 - DNA, 20 bp, synthetic construct
  misc_feature 1..20: note = CRISPR gRNA sequence
  source 1..20: mol_type = other DNA
cttgccacacagcaagtgag

SEQ ID NO: 10003 - DNA, 20 bp, synthetic construct
  misc_feature 1..20: note = CRISPR gRNA sequence
  source 1..20: mol_type = other DNA
acacagcaagtgagaggcaa

SEQ ID NO: 10004 - DNA, 20 bp, synthetic construct
  misc_feature 1..20: note = CRISPR gRNA sequence
  source 1..20: mol_type = other DNA
gagaggcaatggcattctcc

SEQ ID NO: 10005 - DNA, 20 bp, synthetic construct
  misc_feature 1..20: note = CRISPR gRNA sequence
  source 1..20: mol_type = other DNA
attctcccagtcaatatttg

SEQ ID NO: 10006 - DNA, 20 bp, synthetic construct
  misc_feature 1..20: note = CRISPR gRNA sequence
  source 1..20: mol_type = other DNA
ttctcccagtcaatatttga

SEQ ID NO: 10007 - DNA, 20 bp, synthetic construct
  misc_feature 1..20: note = CRISPR gRNA sequence
  source 1..20: mol_type = other DNA
tttgaaggcccgccatgtgc

SEQ ID NO: 10008 - DNA, 20 bp, synthetic construct
  misc_feature 1..20: note = CRISPR gRNA sequence
  source 1..20: mol_type = other DNA
gcccgccatgtgccagtcac

SEQ ID NO: 10009 - DNA, 20 bp, synthetic construct
  misc_feature 1..20: note = CRISPR gRNA sequence
  source 1..20: mol_type = other DNA
cccgccatgtgccagtcact

SEQ ID NO: 10010 - DNA, 20 bp, synthetic construct
  misc_feature 1..20: note = CRISPR gRNA sequence
  source 1..20: mol_type = other DNA
ccgccatgtgccagtcactg

SEQ ID NO: 10011 - DNA, 20 bp, synthetic construct
  misc_feature 1..20: note = CRISPR gRNA sequence
  source 1..20: mol_type = other DNA
gccagtcactggggtatgtc

SEQ ID NO: 10012 - DNA, 20 bp, synthetic construct
  misc_feature 1..20: note = CRISPR gRNA sequence
  source 1..20: mol_type = other DNA
ctggggtatgtctagaatct

SEQ ID NO: 10013 - DNA, 20 bp, synthetic construct
  misc_feature 1..20: note = CRISPR gRNA sequence
  source 1..20: mol_type = other DNA
tctagaatctgagactgacc

SEQ ID NO: 10014 - DNA, 20 bp, synthetic construct
  misc_feature 1..20: note = CRISPR gRNA sequence
  source 1..20: mol_type = other DNA
ctagaatctgagactgacct

SEQ ID NO: 10015 - DNA, 20 bp, synthetic construct
  misc_feature 1..20: note = CRISPR gRNA sequence
  source 1..20: mol_type = other DNA
ttttattctttccaccccct

SEQ ID NO: 10016 - DNA, 20 bp, synthetic construct
  misc_feature 1..20: note = CRISPR gRNA sequence
  source 1..20: mol_type = other DNA
cgccaccgttttcttatgct

SEQ ID NO: 10017 - DNA, 20 bp, synthetic construct
  misc_feature 1..20: note = CRISPR gRNA sequence
  source 1..20: mol_type = other DNA
ccaccgttttcttatgctaa

SEQ ID NO: 10018 - DNA, 20 bp, synthetic construct
  misc_feature 1..20: note = CRISPR gRNA sequence
  source 1..20: mol_type = other DNA
gttttcttatgctaagagta

SEQ ID NO: 10019 - DNA, 20 bp, synthetic construct
  misc_feature 1..20: note = CRISPR gRNA sequence
  source 1..20: mol_type = other DNA
ttatgctaagagtaaagcca

SEQ ID NO: 10020 - DNA, 20 bp, synthetic construct
  misc_feature 1..20: note = CRISPR gRNA sequence
  source 1..20: mol_type = other DNA
gtaaagccatggcctcccct

SEQ ID NO: 10021 - DNA, 20 bp, synthetic construct
  misc_feature 1..20: note = CRISPR gRNA sequence
  source 1..20: mol_type = other DNA
cttccactccattttgtatt

SEQ ID NO: 10022 - DNA, 20 bp, synthetic construct
  misc_feature 1..20: note = CRISPR gRNA sequence
  source 1..20: mol_type = other DNA
tccattttgtattcagcaac

SEQ ID NO: 10023 - DNA, 20 bp, synthetic construct
  misc_feature 1..20: note = CRISPR gRNA sequence
  source 1..20: mol_type = other DNA
agcaaccagaccaatcttct

SEQ ID NO: 10024 - DNA, 20 bp, synthetic construct
  misc_feature 1..20: note = CRISPR gRNA sequence
  source 1..20: mol_type = other DNA
catccctgcttacaatcctt

SEQ ID NO: 10025 - DNA, 20 bp, synthetic construct
  misc_feature 1..20: note = CRISPR gRNA sequence
  source 1..20: mol_type = other DNA
atccctgcttacaatccttc

SEQ ID NO: 10026 - DNA, 20 bp, synthetic construct
  misc_feature 1..20: note = CRISPR gRNA sequence
  source 1..20: mol_type = other DNA
tccctgcttacaatccttca

SEQ ID NO: 10027 - DNA, 20 bp, synthetic construct
  misc_feature 1..20: note = CRISPR gRNA sequence
  source 1..20: mol_type = other DNA
cagggacactccaccactgt

SEQ ID NO: 10028 - DNA, 20 bp, synthetic construct
  misc_feature 1..20: note = CRISPR gRNA sequence
  source 1..20: mol_type = other DNA
agggacactccaccactgtc

SEQ ID NO: 10029 - DNA, 20 bp, synthetic construct
  misc_feature 1..20: note = CRISPR gRNA sequence
  source 1..20: mol_type = other DNA
actccaccactgtcaggatg

SEQ ID NO: 10030 - DNA, 20 bp, synthetic construct
  misc_feature 1..20: note = CRISPR gRNA sequence
  source 1..20: mol_type = other DNA
ctccaccactgtcaggatga

SEQ ID NO: 10031 - DNA, 20 bp, synthetic construct
  misc_feature 1..20: note = CRISPR gRNA sequence
  source 1..20: mol_type = other DNA
gaaggctaaattccttaatt

SEQ ID NO: 10032 - DNA, 20 bp, synthetic construct
  misc_feature 1..20: note = CRISPR gRNA sequence
  source 1..20: mol_type = other DNA
ttccttaatttggtttcatt

SEQ ID NO: 10033 - DNA, 20 bp, synthetic construct
  misc_feature 1..20: note = CRISPR gRNA sequence
  source 1..20: mol_type = other DNA
ttaatttggtttcattaagt

SEQ ID NO: 10034 - DNA, 20 bp, synthetic construct
  misc_feature 1..20: note = CRISPR gRNA sequence
  source 1..20: mol_type = other DNA
agtcggtctgcaatctgctt

SEQ ID NO: 10035 - DNA, 20 bp, synthetic construct
  misc_feature 1..20: note = CRISPR gRNA sequence
  source 1..20: mol_type = other DNA
tgcaatctgcttgagcattt

SEQ ID NO: 10036 - DNA, 20 bp, synthetic construct
  misc_feature 1..20: note = CRISPR gRNA sequence
  source 1..20: mol_type = other DNA
gagcatttcagcttaatcgc

SEQ ID NO: 10037 - DNA, 20 bp, synthetic construct
  misc_feature 1..20: note = CRISPR gRNA sequence
  source 1..20: mol_type = other DNA
gcatttcagcttaatcgcca

SEQ ID NO: 10038 - DNA, 20 bp, synthetic construct
  misc_feature 1..20: note = CRISPR gRNA sequence
  source 1..20: mol_type = other DNA
catttcagcttaatcgccag

SEQ ID NO: 10039 - DNA, 20 bp, synthetic construct
  misc_feature 1..20: note = CRISPR gRNA sequence
  source 1..20: mol_type = other DNA
cccctaaacatactttaccc

SEQ ID NO: 10040 - DNA, 20 bp, synthetic construct
  misc_feature 1..20: note = CRISPR gRNA sequence
  source 1..20: mol_type = other DNA
acatactttacccaagctgt

SEQ ID NO: 10041 - DNA, 20 bp, synthetic construct
  misc_feature 1..20: note = CRISPR gRNA sequence
  source 1..20: mol_type = other DNA
catactttacccaagctgta

SEQ ID NO: 10042 - DNA, 20 bp, synthetic construct
  misc_feature 1..20: note = CRISPR gRNA sequence
  source 1..20: mol_type = other DNA
acataattgtgccaataatt

SEQ ID NO: 10043 - DNA, 20 bp, synthetic construct
  misc_feature 1..20: note = CRISPR gRNA sequence
  source 1..20: mol_type = other DNA
taattgtgccaataatttag

SEQ ID NO: 10044 - DNA, 20 bp, synthetic construct
  misc_feature 1..20: note = CRISPR gRNA sequence
  source 1..20: mol_type = other DNA
tgtgccaataatttagcagt

SEQ ID NO: 10045 - DNA, 20 bp, synthetic construct
  misc_feature 1..20: note = CRISPR gRNA sequence
  source 1..20: mol_type = other DNA
taatttagcagtgagcttcc

SEQ ID NO: 10046 - DNA, 20 bp, synthetic construct
  misc_feature 1..20: note = CRISPR gRNA sequence
  source 1..20: mol_type = other DNA
tttagcagtgagcttcctgg

SEQ ID NO: 10047 - DNA, 20 bp, synthetic construct
  misc_feature 1..20: note = CRISPR gRNA sequence
  source 1..20: mol_type = other DNA
agtgagcttcctggtagccg

SEQ ID NO: 10048 - DNA, 20 bp, synthetic construct
  misc_feature 1..20: note = CRISPR gRNA sequence
  source 1..20: mol_type = other DNA
ttcctggtagccgaagcaaa

SEQ ID NO: 10049 - DNA, 20 bp, synthetic construct
  misc_feature 1..20: note = CRISPR gRNA sequence
  source 1..20: mol_type = other DNA
tcctggtagccgaagcaaaa

SEQ ID NO: 10050 - DNA, 20 bp, synthetic construct
  misc_feature 1..20: note = CRISPR gRNA sequence
  source 1..20: mol_type = other DNA
cctggtagccgaagcaaaaa

SEQ ID NO: 10051 - DNA, 20 bp, synthetic construct
  misc_feature 1..20: note = CRISPR gRNA sequence
  source 1..20: mol_type = other DNA
gtagccgaagcaaaaaggga

SEQ ID NO: 10052 - DNA, 20 bp, synthetic construct
  misc_feature 1..20: note = CRISPR gRNA sequence
  source 1..20: mol_type = other DNA
gggaaagaaaaccactgtgt

SEQ ID NO: 10053 - DNA, 20 bp, synthetic construct
  misc_feature 1..20: note = CRISPR gRNA sequence
  source 1..20: mol_type = other DNA
aaaaccactgtgtgagttgt

SEQ ID NO: 10054 - DNA, 20 bp, synthetic construct
  misc_feature 1..20: note = CRISPR gRNA sequence
  source 1..20: mol_type = other DNA
ccactgtgtgagttgtgaga

SEQ ID NO: 10055 - DNA, 20 bp, synthetic construct
  misc_feature 1..20: note = CRISPR gRNA sequence
  source 1..20: mol_type = other DNA
ctgtgtgagttgtgagaaag

SEQ ID NO: 10056 - DNA, 20 bp, synthetic construct
  misc_feature 1..20: note = CRISPR gRNA sequence
  source 1..20: mol_type = other DNA
tgtgtgagttgtgagaaagt

SEQ ID NO: 10057 - DNA, 20 bp, synthetic construct
  misc_feature 1..20: note = CRISPR gRNA sequence
  source 1..20: mol_type = other DNA
tgagaaagtaggaatcaata

SEQ ID NO: 10058 - DNA, 20 bp, synthetic construct
  misc_feature 1..20: note = CRISPR gRNA sequence
  source 1..20: mol_type = other DNA
gagaaagtaggaatcaataa

SEQ ID NO: 10059 - DNA, 20 bp, synthetic construct
  misc_feature 1..20: note = CRISPR gRNA sequence
  source 1..20: mol_type = other DNA
aagtaggaatcaataaaggc

SEQ ID NO: 10060 - DNA, 20 bp, synthetic construct
  misc_feature 1..20: note = CRISPR gRNA sequence
  source 1..20: mol_type = other DNA
gtaggaatcaataaaggctg

SEQ ID NO: 10061 - DNA, 20 bp, synthetic construct
  misc_feature 1..20: note = CRISPR gRNA sequence
  source 1..20: mol_type = other DNA
ggaatcaataaaggctggag

SEQ ID NO: 10062 - DNA, 20 bp, synthetic construct
  misc_feature 1..20: note = CRISPR gRNA sequence
  source 1..20: mol_type = other DNA
aataaaggctggagtggtca

SEQ ID NO: 10063 - DNA, 20 bp, synthetic construct
  misc_feature 1..20: note = CRISPR gRNA sequence
  source 1..20: mol_type = other DNA
aaaggctggagtggtcatgg

SEQ ID NO: 10064 - DNA, 20 bp, synthetic construct
  misc_feature 1..20: note = CRISPR gRNA sequence
  source 1..20: mol_type = other DNA
aaggctggagtggtcatgga

SEQ ID NO: 10065 - DNA, 20 bp, synthetic construct
  misc_feature 1..20: note = CRISPR gRNA sequence
  source 1..20: mol_type = other DNA
agtggtcatggaaggctttc

SEQ ID NO: 10066 - DNA, 20 bp, synthetic construct
  misc_feature 1..20: note = CRISPR gRNA sequence
  source 1..20: mol_type = other DNA
gtggtcatggaaggctttct

SEQ ID NO: 10067 - DNA, 20 bp, synthetic construct
  misc_feature 1..20: note = CRISPR gRNA sequence
  source 1..20: mol_type = other DNA
tcatggaaggctttctggga

SEQ ID NO: 10068 - DNA, 20 bp, synthetic construct
  misc_feature 1..20: note = CRISPR gRNA sequence
  source 1..20: mol_type = other DNA
catggaaggctttctgggaa

SEQ ID NO: 10069 - DNA, 20 bp, synthetic construct
  misc_feature 1..20: note = CRISPR gRNA sequence
  source 1..20: mol_type = other DNA
ggaaggctttctgggaaagg

SEQ ID NO: 10070 - DNA, 20 bp, synthetic construct
  misc_feature 1..20: note = CRISPR gRNA sequence
  source 1..20: mol_type = other DNA
aaggctttctgggaaaggta

SEQ ID NO: 10071 - DNA, 20 bp, synthetic construct
  misc_feature 1..20: note = CRISPR gRNA sequence
  source 1..20: mol_type = other DNA
aggctttctgggaaaggtag

SEQ ID NO: 10072 - DNA, 20 bp, synthetic construct
  misc_feature 1..20: note = CRISPR gRNA sequence
  source 1..20: mol_type = other DNA
ttctgggaaaggtagaggtt

SEQ ID NO: 10073 - DNA, 20 bp, synthetic construct
  misc_feature 1..20: note = CRISPR gRNA sequence
  source 1..20: mol_type = other DNA
ggaaaggtagaggttgagct

SEQ ID NO: 10074 - DNA, 20 bp, synthetic construct
  misc_feature 1..20: note = CRISPR gRNA sequence
  source 1..20: mol_type = other DNA
gaaaggtagaggttgagcta

SEQ ID NO: 10075 - DNA, 20 bp, synthetic construct
  misc_feature 1..20: note = CRISPR gRNA sequence
  source 1..20: mol_type = other DNA
ggtagaggttgagctaagga

SEQ ID NO: 10076 - DNA, 20 bp, synthetic construct
  misc_feature 1..20: note = CRISPR gRNA sequence
  source 1..20: mol_type = other DNA
gaggttgagctaaggaaaga

SEQ ID NO: 10077 - DNA, 20 bp, synthetic construct
  misc_feature 1..20: note = CRISPR gRNA sequence
  source 1..20: mol_type = other DNA
aaggaaagaaagtattttaa

SEQ ID NO: 10078 - DNA, 20 bp, synthetic construct
  misc_feature 1..20: note = CRISPR gRNA sequence
  source 1..20: mol_type = other DNA
aggaaagaaagtattttaat

SEQ ID NO: 10079 - DNA, 20 bp, synthetic construct
  misc_feature 1..20: note = CRISPR gRNA sequence
  source 1..20: mol_type = other DNA
aaagaaagtattttaatagg

SEQ ID NO: 10080 - DNA, 20 bp, synthetic construct
  misc_feature 1..20: note = CRISPR gRNA sequence
  source 1..20: mol_type = other DNA
aagaaagtattttaataggt

SEQ ID NO: 10081 - DNA, 20 bp, synthetic construct
  misc_feature 1..20: note = CRISPR gRNA sequence
  source 1..20: mol_type = other DNA
gaaagtattttaataggtag

SEQ ID NO: 10082 - DNA, 20 bp, synthetic construct
  misc_feature 1..20: note = CRISPR gRNA sequence
  source 1..20: mol_type = other DNA
aaagtattttaataggtagg

SEQ ID NO: 10083 - DNA, 20 bp, synthetic construct
  misc_feature 1..20: note = CRISPR gRNA sequence
  source 1..20: mol_type = other DNA
ataggtaggaggacccttca

SEQ ID NO: 10084 - DNA, 20 bp, synthetic construct
  misc_feature 1..20: note = CRISPR gRNA sequence
  source 1..20: mol_type = other DNA
aggtaggaggacccttcatg

SEQ ID NO: 10085 - DNA, 20 bp, synthetic construct
  misc_feature 1..20: note = CRISPR gRNA sequence
  source 1..20: mol_type = other DNA
catggagctgcccttccatt

SEQ ID NO: 10086 - DNA, 20 bp, synthetic construct
  misc_feature 1..20: note = CRISPR gRNA sequence
  source 1..20: mol_type = other DNA
atggagctgcccttccatta

SEQ ID NO: 10087 - DNA, 20 bp, synthetic construct
  misc_feature 1..20: note = CRISPR gRNA sequence
  source 1..20: mol_type = other DNA
gctgcccttccattaaggtc

SEQ ID NO: 10088 - DNA, 20 bp, synthetic construct
  misc_feature 1..20: note = CRISPR gRNA sequence
  source 1..20: mol_type = other DNA
ccttccattaaggtctagcc

SEQ ID NO: 10089 - DNA, 20 bp, synthetic construct
  misc_feature 1..20: note = CRISPR gRNA sequence
  source 1..20: mol_type = other DNA
tctagcctggtcaccgtgcc

SEQ ID NO: 10090 - DNA, 20 bp, synthetic construct
  misc_feature 1..20: note = CRISPR gRNA sequence
  source 1..20: mol_type = other DNA
ctagcctggtcaccgtgcct

SEQ ID NO: 10091 - DNA, 20 bp, synthetic construct
  misc_feature 1..20: note = CRISPR gRNA sequence
  source 1..20: mol_type = other DNA
tggtcaccgtgcctgggtct

SEQ ID NO: 10092 - DNA, 20 bp, synthetic construct
  misc_feature 1..20: note = CRISPR gRNA sequence
  source 1..20: mol_type = other DNA
ggtcaccgtgcctgggtctg

SEQ ID NO: 10093 - DNA, 20 bp, synthetic construct
  misc_feature 1..20: note = CRISPR gRNA sequence
  source 1..20: mol_type = other DNA
ggtctgaggccctccctcca

SEQ ID NO: 10094 - DNA, 20 bp, synthetic construct
  misc_feature 1..20: note = CRISPR gRNA sequence
  source 1..20: mol_type = other DNA
gtctgaggccctccctccac

SEQ ID NO: 10095 - DNA, 20 bp, synthetic construct
  misc_feature 1..20: note = CRISPR gRNA sequence
  source 1..20: mol_type = other DNA
tctgaggccctccctccaca

SEQ ID NO: 10096 - DNA, 20 bp, synthetic construct
  misc_feature 1..20: note = CRISPR gRNA sequence
  source 1..20: mol_type = other DNA
tccctccacagggctgcctt

SEQ ID NO: 10097 - DNA, 20 bp, synthetic construct
  misc_feature 1..20: note = CRISPR gRNA sequence
  source 1..20: mol_type = other DNA
cagggctgccttgagcgaca

SEQ ID NO: 10098 - DNA, 20 bp, synthetic construct
  misc_feature 1..20: note = CRISPR gRNA sequence
  source 1..20: mol_type = other DNA
ggctgccttgagcgacacgg

SEQ ID NO: 10099 - DNA, 20 bp, synthetic construct
  misc_feature 1..20: note = CRISPR gRNA sequence
  source 1..20: mol_type = other DNA
tgagcgacacggtggcgctg

SEQ ID NO: 10100 - DNA, 20 bp, synthetic construct
  misc_feature 1..20: note = CRISPR gRNA sequence
  source 1..20: mol_type = other DNA
gagcgacacggtggcgctgt

SEQ ID NO: 10101 - DNA, 20 bp, synthetic construct
  misc_feature 1..20: note = CRISPR gRNA sequence
  source 1..20: mol_type = other DNA
gcgacacggtggcgctgtgg

SEQ ID NO: 10102 - DNA, 20 bp, synthetic construct
  misc_feature 1..20: note = CRISPR gRNA sequence
  source 1..20: mol_type = other DNA
tggcgctgtgggagtccctg

SEQ ID NO: 10103 - DNA, 20 bp, synthetic construct
  misc_feature 1..20: note = CRISPR gRNA sequence
  source 1..20: mol_type = other DNA
cgctgtgggagtccctgcag

SEQ ID NO: 10104 - DNA, 20 bp, synthetic construct
  misc_feature 1..20: note = CRISPR gRNA sequence
  source 1..20: mol_type = other DNA
tgggagtccctgcagcagca

SEQ ID NO: 10105 - DNA, 20 bp, synthetic construct
  misc_feature 1..20: note = CRISPR gRNA sequence
  source 1..20: mol_type = other DNA
gggagtccctgcagcagcat

SEQ ID NO: 10106 - DNA, 20 bp, synthetic construct
  misc_feature 1..20: note = CRISPR gRNA sequence
  source 1..20: mol_type = other DNA
ggagtccctgcagcagcatg

SEQ ID NO: 10107 - DNA, 20 bp, synthetic construct
  misc_feature 1..20: note = CRISPR gRNA sequence
  source 1..20: mol_type = other DNA
agtccctgcagcagcatggg

SEQ ID NO: 10108 - DNA, 20 bp, synthetic construct
  misc_feature 1..20: note = CRISPR gRNA sequence
  source 1..20: mol_type = other DNA
tgcagcagcatggggagacc

SEQ ID NO: 10109 - DNA, 20 bp, synthetic construct
  misc_feature 1..20: note = CRISPR gRNA sequence
  source 1..20: mol_type = other DNA
atggggagaccaagctactt

SEQ ID NO: 10110 - DNA, 20 bp, synthetic construct
  misc_feature 1..20: note = CRISPR gRNA sequence
  source 1..20: mol_type = other DNA
tggggagaccaagctacttc

SEQ ID NO: 10111 - DNA, 20 bp, synthetic construct
  misc_feature 1..20: note = CRISPR gRNA sequence
  source 1..20: mol_type = other DNA
ggagaccaagctacttcagg

SEQ ID NO: 10112 - DNA, 20 bp, synthetic construct
  misc_feature 1..20: note = CRISPR gRNA sequence
  source 1..20: mol_type = other DNA
gaccaagctacttcaggcag

SEQ ID NO: 10113 - DNA, 20 bp, synthetic construct
  misc_feature 1..20: note = CRISPR gRNA sequence
  source 1..20: mol_type = other DNA
ccaagctacttcaggcagca

SEQ ID NO: 10114 - DNA, 20 bp, synthetic construct
  misc_feature 1..20: note = CRISPR gRNA sequence
  source 1..20: mol_type = other DNA
caagctacttcaggcagcag

SEQ ID NO: 10115 - DNA, 20 bp, synthetic construct
  misc_feature 1..20: note = CRISPR gRNA sequence
  source 1..20: mol_type = other DNA
agctacttcaggcagcagag

SEQ ID NO: 10116 - DNA, 20 bp, synthetic construct
  misc_feature 1..20: note = CRISPR gRNA sequence
  source 1..20: mol_type = other DNA
tacttcaggcagcagaggag

SEQ ID NO: 10117 - DNA, 20 bp, synthetic construct
  misc_feature 1..20: note = CRISPR gRNA sequence
  source 1..20: mol_type = other DNA
cagaggagaagttcaccatc

SEQ ID NO: 10118 - DNA, 20 bp, synthetic construct
  misc_feature 1..20: note = CRISPR gRNA sequence
  source 1..20: mol_type = other DNA
gttcaccatcgagcctttca

SEQ ID NO: 10119 - DNA, 20 bp, synthetic construct
  misc_feature 1..20: note = CRISPR gRNA sequence
  source 1..20: mol_type = other DNA
ccatcgagcctttcaaagcc

SEQ ID NO: 10120 - DNA, 20 bp, synthetic construct
  misc_feature 1..20: note = CRISPR gRNA sequence
  source 1..20: mol_type = other DNA
ctttcaaagccaagtccctg

SEQ ID NO: 10121 - DNA, 20 bp, synthetic construct
  misc_feature 1..20: note = CRISPR gRNA sequence
  source 1..20: mol_type = other DNA
tttcaaagccaagtccctga

SEQ ID NO: 10122 - DNA, 20 bp, synthetic construct
  misc_feature 1..20: note = CRISPR gRNA sequence
  source 1..20: mol_type = other DNA
agccaagtccctgaaggatg

SEQ ID NO: 10123 - DNA, 20 bp, synthetic construct
  misc_feature 1..20: note = CRISPR gRNA sequence
  source 1..20: mol_type = other DNA
caagtccctgaaggatgtgg

SEQ ID NO: 10124 - DNA, 20 bp, synthetic construct
  misc_feature 1..20: note = CRISPR gRNA sequence
  source 1..20: mol_type = other DNA
cctgaaggatgtggaagacc

SEQ ID NO: 10125 - DNA, 20 bp, synthetic construct
  misc_feature 1..20: note = CRISPR gRNA sequence
  source 1..20: mol_type = other DNA
ctgaaggatgtggaagacct

SEQ ID NO: 10126 - DNA, 20 bp, synthetic construct
  misc_feature 1..20: note = CRISPR gRNA sequence
  source 1..20: mol_type = other DNA
aggatgtggaagacctggga

SEQ ID NO: 10127 - DNA, 20 bp, synthetic construct
  misc_feature 1..20: note = CRISPR gRNA sequence
  source 1..20: mol_type = other DNA
aagacctgggaaagcttgtg

SEQ ID NO: 10128 - DNA, 20 bp, synthetic construct
  misc_feature 1..20: note = CRISPR gRNA sequence
  source 1..20: mol_type = other DNA
tgggaaagcttgtgcagact

SEQ ID NO: 10129 - DNA, 20 bp, synthetic construct
  misc_feature 1..20: note = CRISPR gRNA sequence
  source 1..20: mol_type = other DNA
ggaaagcttgtgcagactca

SEQ ID NO: 10130 - DNA, 20 bp, synthetic construct
  misc_feature 1..20: note = CRISPR gRNA sequence
  source 1..20: mol_type = other DNA
gaaagcttgtgcagactcag

SEQ ID NO: 10131 - DNA, 20 bp, synthetic construct
  misc_feature 1..20: note = CRISPR gRNA sequence
  source 1..20: mol_type = other DNA
gcttgtgcagactcagaggt

SEQ ID NO: 10132 - DNA, 20 bp, synthetic construct
  misc_feature 1..20: note = CRISPR gRNA sequence
  source 1..20: mol_type = other DNA
ttgtgcagactcagaggtga

SEQ ID NO: 10133 - DNA, 20 bp, synthetic construct
  misc_feature 1..20: note = CRISPR gRNA sequence
  source 1..20: mol_type = other DNA
tgtgcagactcagaggtgag

SEQ ID NO: 10134 - DNA, 20 bp, synthetic construct
  misc_feature 1..20: note = CRISPR gRNA sequence
  source 1..20: mol_type = other DNA
tgcagactcagaggtgagag

SEQ ID NO: 10135 - DNA, 20 bp, synthetic construct
  misc_feature 1..20: note = CRISPR gRNA sequence
  source 1..20: mol_type = other DNA
cagactcagaggtgagagga

SEQ ID NO: 10136 - DNA, 20 bp, synthetic construct
  misc_feature 1..20: note = CRISPR gRNA sequence
  source 1..20: mol_type = other DNA
agactcagaggtgagaggag

SEQ ID NO: 10137 - DNA, 20 bp, synthetic construct
  misc_feature 1..20: note = CRISPR gRNA sequence
  source 1..20: mol_type = other DNA
ctcagaggtgagaggagagg

SEQ ID NO: 10138 - DNA, 20 bp, synthetic construct
  misc_feature 1..20: note = CRISPR gRNA sequence
  source 1..20: mol_type = other DNA
gaggtgagaggagaggcgga

SEQ ID NO: 10139 - DNA, 20 bp, synthetic construct
  misc_feature 1..20: note = CRISPR gRNA sequence
  source 1..20: mol_type = other DNA
aggtgagaggagaggcggat

SEQ ID NO: 10140 - DNA, 20 bp, synthetic construct
  misc_feature 1..20: note = CRISPR gRNA sequence
  source 1..20: mol_type = other DNA
gtgagaggagaggcggatgg

SEQ ID NO: 10141 - DNA, 20 bp, synthetic construct
  misc_feature 1..20: note = CRISPR gRNA sequence
  source 1..20: mol_type = other DNA
tgagaggagaggcggatggg

SEQ ID NO: 10142 - DNA, 20 bp, synthetic construct
  misc_feature 1..20: note = CRISPR gRNA sequence
  source 1..20: mol_type = other DNA
gaggagaggcggatgggagg

SEQ ID NO: 10143 - DNA, 20 bp, synthetic construct
  misc_feature 1..20: note = CRISPR gRNA sequence
  source 1..20: mol_type = other DNA
gggaggtggttcacgccatg

SEQ ID NO: 10144 - DNA, 20 bp, synthetic construct
  misc_feature 1..20: note = CRISPR gRNA sequence
  source 1..20: mol_type = other DNA
ggaggtggttcacgccatgc

SEQ ID NO: 10145 - DNA, 20 bp, synthetic construct
  misc_feature 1..20: note = CRISPR gRNA sequence
  source 1..20: mol_type = other DNA
tggttcacgccatgcaggtt

SEQ ID NO: 10146 - DNA, 20 bp, synthetic construct
  misc_feature 1..20: note = CRISPR gRNA sequence
  source 1..20: mol_type = other DNA
ggttcacgccatgcaggttg

SEQ ID NO: 10147 - DNA, 20 bp, synthetic construct
  misc_feature 1..20: note = CRISPR gRNA sequence
  source 1..20: mol_type = other DNA
ccatgcaggttgaggacatg

SEQ ID NO: 10148 - DNA, 20 bp, synthetic construct
  misc_feature 1..20: note = CRISPR gRNA sequence
  source 1..20: mol_type = other DNA
catgcaggttgaggacatgt

SEQ ID NO: 10149 - DNA, 20 bp, synthetic construct
  misc_feature 1..20: note = CRISPR gRNA sequence
  source 1..20: mol_type = other DNA
gacatgtaggacccattctc

SEQ ID NO: 10150 - DNA, 20 bp, synthetic construct
  misc_feature 1..20: note = CRISPR gRNA sequence
  source 1..20: mol_type = other DNA
acccattctcaagtttgtca

SEQ ID NO: 10151 - DNA, 20 bp, synthetic construct
  misc_feature 1..20: note = CRISPR gRNA sequence
  source 1..20: mol_type = other DNA
cccattctcaagtttgtcat

SEQ ID NO: 10152 - DNA, 20 bp, synthetic construct
  misc_feature 1..20: note = CRISPR gRNA sequence
  source 1..20: mol_type = other DNA
aagtttgtcatgggcatttc

SEQ ID NO: 10153 - DNA, 20 bp, synthetic construct
  misc_feature 1..20: note = CRISPR gRNA sequence
  source 1..20: mol_type = other DNA
ttccagtgccccctgtcctc

SEQ ID NO: 10154 - DNA, 20 bp, synthetic construct
  misc_feature 1..20: note = CRISPR gRNA sequence
  source 1..20: mol_type = other DNA
tccagtgccccctgtcctct

SEQ ID NO: 10155 - DNA, 20 bp, synthetic construct
  misc_feature 1..20: note = CRISPR gRNA sequence
  source 1..20: mol_type = other DNA
gacaccccatgccctctttc

SEQ ID NO: 10156 - DNA, 20 bp, synthetic construct
  misc_feature 1..20: note = CRISPR gRNA sequence
  source 1..20: mol_type = other DNA
acaccccatgccctctttct

SEQ ID NO: 10157 - DNA, 20 bp, synthetic construct
  misc_feature 1..20: note = CRISPR gRNA sequence
  source 1..20: mol_type = other DNA
catgccctctttctgggcaa

SEQ ID NO: 10158 - DNA, 20 bp, synthetic construct
  misc_feature 1..20: note = CRISPR gRNA sequence
  source 1..20: mol_type = other DNA
ctttctgggcaatggctaac

SEQ ID NO: 10159 - DNA, 20 bp, synthetic construct
  misc_feature 1..20: note = CRISPR gRNA sequence
  source 1..20: mol_type = other DNA
ttctgggcaatggctaacca

SEQ ID NO: 10160 - DNA, 20 bp, synthetic construct
  misc_feature 1..20: note = CRISPR gRNA sequence
  source 1..20: mol_type = other DNA
ctctcactgcactcgctgcc

SEQ ID NO: 10161 - DNA, 20 bp, synthetic construct
  misc_feature 1..20: note = CRISPR gRNA sequence
  source 1..20: mol_type = other DNA
tctcactgcactcgctgccc

SEQ ID NO: 10162 - DNA, 20 bp, synthetic construct
  misc_feature 1..20: note = CRISPR gRNA sequence
  source 1..20: mol_type = other DNA
cactgcactcgctgcccagg

SEQ ID NO: 10163 - DNA, 20 bp, synthetic construct
  misc_feature 1..20: note = CRISPR gRNA sequence
  source 1..20: mol_type = other DNA
ctgcactcgctgcccaggcg

SEQ ID NO: 10164 - DNA, 20 bp, synthetic construct
  misc_feature 1..20: note = CRISPR gRNA sequence
  source 1..20: mol_type = other DNA
cgctgcccaggcggagcctc

SEQ ID NO: 10165 - DNA, 20 bp, synthetic construct
  misc_feature 1..20: note = CRISPR gRNA sequence
  source 1..20: mol_type = other DNA
aaacctgccatcatgtgccc

SEQ ID NO: 10166 - DNA, 20 bp, synthetic construct
  misc_feature 1..20: note = CRISPR gRNA sequence
  source 1..20: mol_type = other DNA
gccatcatgtgcccaagtct

SEQ ID NO: 10167 - DNA, 20 bp, synthetic construct
  misc_feature 1..20: note = CRISPR gRNA sequence
  source 1..20: mol_type = other DNA
atgtgcccaagtcttagcta

SEQ ID NO: 10168 - DNA, 20 bp, synthetic construct
  misc_feature 1..20: note = CRISPR gRNA sequence
  source 1..20: mol_type = other DNA
ccaagtcttagctaaagcca

SEQ ID NO: 10169 - DNA, 20 bp, synthetic construct
  misc_feature 1..20: note = CRISPR gRNA sequence
  source 1..20: mol_type = other DNA
aagtcttagctaaagccatg

SEQ ID NO: 10170 - DNA, 20 bp, synthetic construct
  misc_feature 1..20: note = CRISPR gRNA sequence
  source 1..20: mol_type = other DNA
atggagaacctctccccttc

SEQ ID NO: 10171 - DNA, 20 bp, synthetic construct
  misc_feature 1..20: note = CRISPR gRNA sequence
  source 1..20: mol_type = other DNA
tggagaacctctccccttct

SEQ ID NO: 10172 - DNA, 20 bp, synthetic construct
  misc_feature 1..20: note = CRISPR gRNA sequence
  source 1..20: mol_type = other DNA
gagaacctctccccttctag

SEQ ID NO: 10173 - DNA, 20 bp, synthetic construct
  misc_feature 1..20: note = CRISPR gRNA sequence
  source 1..20: mol_type = other DNA
ctccccttctaggagttaac

SEQ ID NO: 10174 - DNA, 20 bp, synthetic construct
  misc_feature 1..20: note = CRISPR gRNA sequence
  source 1..20: mol_type = other DNA
tccccttctaggagttaaca

SEQ ID NO: 10175 - DNA, 20 bp, synthetic construct
  misc_feature 1..20: note = CRISPR gRNA sequence
  source 1..20: mol_type = other DNA
acaaggatgccttgtgcacc

SEQ ID NO: 10176 - DNA, 20 bp, synthetic construct
  misc_feature 1..20: note = CRISPR gRNA sequence
  source 1..20: mol_type = other DNA
atgccttgtgcacctagtaa

SEQ ID NO: 10177 - DNA, 20 bp, synthetic construct
  misc_feature 1..20: note = CRISPR gRNA sequence
  source 1..20: mol_type = other DNA
ccttgtgcacctagtaacag

SEQ ID NO: 10178 - DNA, 20 bp, synthetic construct
  misc_feature 1..20: note = CRISPR gRNA sequence
  source 1..20: mol_type = other DNA
gacacctactgccacccttt

SEQ ID NO: 10179 - DNA, 20 bp, synthetic construct
  misc_feature 1..20: note = CRISPR gRNA sequence
  source 1..20: mol_type = other DNA
acacctactgccaccctttg

SEQ ID NO: 10180 - DNA, 20 bp, synthetic construct
  misc_feature 1..20: note = CRISPR gRNA sequence
  source 1..20: mol_type = other DNA
ctgccaccctttgaggcatt

SEQ ID NO: 10181 - DNA, 20 bp, synthetic construct
  misc_feature 1..20: note = CRISPR gRNA sequence
  source 1..20: mol_type = other DNA
tgccaccctttgaggcattt

SEQ ID NO: 10182 - DNA, 20 bp, synthetic construct
  misc_feature 1..20: note = CRISPR gRNA sequence
  source 1..20: mol_type = other DNA
caactgttgtcccaaattta

SEQ ID NO: 10183 - DNA, 20 bp, synthetic construct
  misc_feature 1..20: note = CRISPR gRNA sequence
  source 1..20: mol_type = other DNA
tgttgtcccaaatttataga

SEQ ID NO: 10184 - DNA, 20 bp, synthetic construct
  misc_feature 1..20: note = CRISPR gRNA sequence
  source 1..20: mol_type = other DNA
tgtcccaaatttatagacgg

SEQ ID NO: 10185 - DNA, 20 bp, synthetic construct
  misc_feature 1..20: note = CRISPR gRNA sequence
  source 1..20: mol_type = other DNA
tcccaaatttatagacggca

SEQ ID NO: 10186 - DNA, 20 bp, synthetic construct
  misc_feature 1..20: note = CRISPR gRNA sequence
  source 1..20: mol_type = other DNA
aatttatagacggcagagct

SEQ ID NO: 10187 - DNA, 20 bp, synthetic construct
  misc_feature 1..20: note = CRISPR gRNA sequence
  source 1..20: mol_type = other DNA
atttatagacggcagagcta

SEQ ID NO: 10188 - DNA, 20 bp, synthetic construct
  misc_feature 1..20: note = CRISPR gRNA sequence
  source 1..20: mol_type = other DNA
tagacggcagagctaaggtc

SEQ ID NO: 10189 - DNA, 20 bp, synthetic construct
  misc_feature 1..20: note = CRISPR gRNA sequence
  source 1..20: mol_type = other DNA
acggcagagctaaggtccag

SEQ ID NO: 10190 - DNA, 20 bp, synthetic construct
  misc_feature 1..20: note = CRISPR gRNA sequence
  source 1..20: mol_type = other DNA
cggcagagctaaggtccaga

SEQ ID NO: 10191 - DNA, 20 bp, synthetic construct
  misc_feature 1..20: note = CRISPR gRNA sequence
  source 1..20: mol_type = other DNA
cagagctaaggtccagaagg

SEQ ID NO: 10192 - DNA, 20 bp, synthetic construct
  misc_feature 1..20: note = CRISPR gRNA sequence
  source 1..20: mol_type = other DNA
aggcagacaaaacttgatta

SEQ ID NO: 10193 - DNA, 20 bp, synthetic construct
  misc_feature 1..20: note = CRISPR gRNA sequence
  source 1..20: mol_type = other DNA
acaaaacttgattacagaac

SEQ ID NO: 10194 - DNA, 20 bp, synthetic construct
  misc_feature 1..20: note = CRISPR gRNA sequence
  source 1..20: mol_type = other DNA
tccttcatcacacattgttt

SEQ ID NO: 10195 - DNA, 20 bp, synthetic construct
  misc_feature 1..20: note = CRISPR gRNA sequence
  source 1..20: mol_type = other DNA
acattgtttgagcgcctctt

SEQ ID NO: 10196 - DNA, 20 bp, synthetic construct
  misc_feature 1..20: note = CRISPR gRNA sequence
  source 1..20: mol_type = other DNA
agcgcctcttaagtgctgtc

SEQ ID NO: 10197 - DNA, 20 bp, synthetic construct
  misc_feature 1..20: note = CRISPR gRNA sequence
  source 1..20: mol_type = other DNA
gcgcctcttaagtgctgtct

SEQ ID NO: 10198 - DNA, 20 bp, synthetic construct
  misc_feature 1..20: note = CRISPR gRNA sequence
  source 1..20: mol_type = other DNA
ctcttaagtgctgtctggga

SEQ ID NO: 10199 - DNA, 20 bp, synthetic construct
  misc_feature 1..20: note = CRISPR gRNA sequence
  source 1..20: mol_type = other DNA
tcttaagtgctgtctgggat

SEQ ID NO: 10200 - DNA, 20 bp, synthetic construct
  misc_feature 1..20: note = CRISPR gRNA sequence
  source 1..20: mol_type = other DNA
gtgctgtctgggataggtac

SEQ ID NO: 10201 - DNA, 20 bp, synthetic construct
  misc_feature 1..20: note = CRISPR gRNA sequence
  source 1..20: mol_type = other DNA
tgtctgggataggtactggt

SEQ ID NO: 10202 - DNA, 20 bp, synthetic construct
  misc_feature 1..20: note = CRISPR gRNA sequence
  source 1..20: mol_type = other DNA
tactggtaagtgcctaatct

SEQ ID NO: 10203 - DNA, 20 bp, synthetic construct
  misc_feature 1..20: note = CRISPR gRNA sequence
  source 1..20: mol_type = other DNA
actggtaagtgcctaatctg

SEQ ID NO: 10204 - DNA, 20 bp, synthetic construct
  misc_feature 1..20: note = CRISPR gRNA sequence
  source 1..20: mol_type = other DNA
tctgaggctcatttccatga

SEQ ID NO: 10205 - DNA, 20 bp, synthetic construct
  misc_feature 1..20: note = CRISPR gRNA sequence
  source 1..20: mol_type = other DNA
gctcatttccatgaaagata

SEQ ID NO: 10206 - DNA, 20 bp, synthetic construct
  misc_feature 1..20: note = CRISPR gRNA sequence
  source 1..20: mol_type = other DNA
tccatgaaagatacagtcct

SEQ ID NO: 10207 - DNA, 20 bp, synthetic construct
  misc_feature 1..20: note = CRISPR gRNA sequence
  source 1..20: mol_type = other DNA
tttatttttattatttctta

SEQ ID NO: 10208 - DNA, 20 bp, synthetic construct
  misc_feature 1..20: note = CRISPR gRNA sequence
  source 1..20: mol_type = other DNA
tttttattatttcttaaaga

SEQ ID NO: 10209 - DNA, 20 bp, synthetic construct
  misc_feature 1..20: note = CRISPR gRNA sequence
  source 1..20: mol_type = other DNA
ttttattatttcttaaagac

SEQ ID NO: 10210 - DNA, 20 bp, synthetic construct
  misc_feature 1..20: note = CRISPR gRNA sequence
  source 1..20: mol_type = other DNA
tttattatttcttaaagaca

SEQ ID NO: 10211 - DNA, 20 bp, synthetic construct
  misc_feature 1..20: note = CRISPR gRNA sequence
  source 1..20: mol_type = other DNA
cagggtctcgctgtgtctac

SEQ ID NO: 10212 - DNA, 20 bp, synthetic construct
  misc_feature 1..20: note = CRISPR gRNA sequence
  source 1..20: mol_type = other DNA
agggtctcgctgtgtctacc

SEQ ID NO: 10213 - DNA, 20 bp, synthetic construct
  misc_feature 1..20: note = CRISPR gRNA sequence
  source 1..20: mol_type = other DNA
tctcgctgtgtctaccaggc

SEQ ID NO: 10214 - DNA, 20 bp, synthetic construct
  misc_feature 1..20: note = CRISPR gRNA sequence
  source 1..20: mol_type = other DNA
gtgtctaccaggctagaata

SEQ ID NO: 10215 - DNA, 20 bp, synthetic construct
  misc_feature 1..20: note = CRISPR gRNA sequence
  source 1..20: mol_type = other DNA
tctaccaggctagaatacag

SEQ ID NO: 10216 - DNA, 20 bp, synthetic construct
  misc_feature 1..20: note = CRISPR gRNA sequence
  source 1..20: mol_type = other DNA
agaatacagtagtgcgatca

SEQ ID NO: 10217 - DNA, 20 bp, synthetic construct
  misc_feature 1..20: note = CRISPR gRNA sequence
  source 1..20: mol_type = other DNA
agtgcgatcatagcttactg

SEQ ID NO: 10218 - DNA, 20 bp, synthetic construct
  misc_feature 1..20: note = CRISPR gRNA sequence
  source 1..20: mol_type = other DNA
atcatagcttactgtagctt

SEQ ID NO: 10219 - DNA, 20 bp, synthetic construct
  misc_feature 1..20: note = CRISPR gRNA sequence
  source 1..20: mol_type = other DNA
actgtagcttcggaactcct

SEQ ID NO: 10220 - DNA, 20 bp, synthetic construct
  misc_feature 1..20: note = CRISPR gRNA sequence
  source 1..20: mol_type = other DNA
gcttcggaactcctgagctc

SEQ ID NO: 10221 - DNA, 20 bp, synthetic construct
  misc_feature 1..20: note = CRISPR gRNA sequence
  source 1..20: mol_type = other DNA
ctcaagcgatcctcctgcct

SEQ ID NO: 10222 - DNA, 20 bp, synthetic construct
  misc_feature 1..20: note = CRISPR gRNA sequence
  source 1..20: mol_type = other DNA
tcctcctgcctcagcctccc

SEQ ID NO: 10223 - DNA, 20 bp, synthetic construct
  misc_feature 1..20: note = CRISPR gRNA sequence
  source 1..20: mol_type = other DNA
tcctgcctcagcctcccaag

SEQ ID NO: 10224 - DNA, 20 bp, synthetic construct
  misc_feature 1..20: note = CRISPR gRNA sequence
  source 1..20: mol_type = other DNA
gcctcagcctcccaagtagc

SEQ ID NO: 10225 - DNA, 20 bp, synthetic construct
  misc_feature 1..20: note = CRISPR gRNA sequence
  source 1..20: mol_type = other DNA
cctcagcctcccaagtagct

SEQ ID NO: 10226 - DNA, 20 bp, synthetic construct
  misc_feature 1..20: note = CRISPR gRNA sequence
  source 1..20: mol_type = other DNA
ctcccaagtagctgggatta

SEQ ID NO: 10227 - DNA, 20 bp, synthetic construct
  misc_feature 1..20: note = CRISPR gRNA sequence
  source 1..20: mol_type = other DNA
tcccaagtagctgggattat

SEQ ID NO: 10228 - DNA, 20 bp, synthetic construct
  misc_feature 1..20: note = CRISPR gRNA sequence
  source 1..20: mol_type = other DNA
ataggtgcacgtcatcacac

SEQ ID NO: 10229 - DNA, 20 bp, synthetic construct
  misc_feature 1..20: note = CRISPR gRNA sequence
  source 1..20: mol_type = other DNA
atcacaccggatgatttttt

SEQ ID NO: 10230 - DNA, 20 bp, synthetic construct
  misc_feature 1..20: note = CRISPR gRNA sequence
  source 1..20: mol_type = other DNA
gatgattttttaagtttttg

SEQ ID NO: 10231 - DNA, 20 bp, synthetic construct
  misc_feature 1..20: note = CRISPR gRNA sequence
  source 1..20: mol_type = other DNA
tttttaagtttttgtagaca

SEQ ID NO: 10232 - DNA, 20 bp, synthetic construct
  misc_feature 1..20: note = CRISPR gRNA sequence
  source 1..20: mol_type = other DNA
ttttaagtttttgtagacac

SEQ ID NO: 10233 - DNA, 20 bp, synthetic construct
  misc_feature 1..20: note = CRISPR gRNA sequence
  source 1..20: mol_type = other DNA
tttaagtttttgtagacaca

SEQ ID NO: 10234 - DNA, 20 bp, synthetic construct
  misc_feature 1..20: note = CRISPR gRNA sequence
  source 1..20: mol_type = other DNA
agggatcttgctatgttgcc

SEQ ID NO: 10235 - DNA, 20 bp, synthetic construct
  misc_feature 1..20: note = CRISPR gRNA sequence
  source 1..20: mol_type = other DNA
gggatcttgctatgttgccc

SEQ ID NO: 10236 - DNA, 20 bp, synthetic construct
  misc_feature 1..20: note = CRISPR gRNA sequence
  source 1..20: mol_type = other DNA
tcttgctatgttgcccaggc

SEQ ID NO: 10237 - DNA, 20 bp, synthetic construct
  misc_feature 1..20: note = CRISPR gRNA sequence
  source 1..20: mol_type = other DNA
ccaggctggtcttgaactcc

SEQ ID NO: 10238 - DNA, 20 bp, synthetic construct
  misc_feature 1..20: note = CRISPR gRNA sequence
  source 1..20: mol_type = other DNA
ggtcttgaactcctggcctc

SEQ ID NO: 10239 - DNA, 20 bp, synthetic construct
  misc_feature 1..20: note = CRISPR gRNA sequence
  source 1..20: mol_type = other DNA
ctcaagcaatcctcctgcct

SEQ ID NO: 10240 - DNA, 20 bp, synthetic construct
  misc_feature 1..20: note = CRISPR gRNA sequence
  source 1..20: mol_type = other DNA
cctcctgcctcagcctccca

SEQ ID NO: 10241 - DNA, 20 bp, synthetic construct
  misc_feature 1..20: note = CRISPR gRNA sequence
  source 1..20: mol_type = other DNA
gcctcagcctcccaaagtgc

SEQ ID NO: 10242 - DNA, 20 bp, synthetic construct
  misc_feature 1..20: note = CRISPR gRNA sequence
  source 1..20: mol_type = other DNA
cctcagcctcccaaagtgct

SEQ ID NO: 10243 - DNA, 20 bp, synthetic construct
  misc_feature 1..20: note = CRISPR gRNA sequence
  source 1..20: mol_type = other DNA
ctcccaaagtgctgggacta

SEQ ID NO: 10244 - DNA, 20 bp, synthetic construct
  misc_feature 1..20: note = CRISPR gRNA sequence
  source 1..20: mol_type = other DNA
agtgctgggactacagtcac

SEQ ID NO: 10245 - DNA, 20 bp, synthetic construct
  misc_feature 1..20: note = CRISPR gRNA sequence
  source 1..20: mol_type = other DNA
gtgctgggactacagtcacg

SEQ ID NO: 10246 - DNA, 20 bp, synthetic construct
  misc_feature 1..20: note = CRISPR gRNA sequence
  source 1..20: mol_type = other DNA
cagtcacgaggcaccgcacc

SEQ ID NO: 10247 - DNA, 20 bp, synthetic construct
  misc_feature 1..20: note = CRISPR gRNA sequence
  source 1..20: mol_type = other DNA
cacgaggcaccgcacccaga

SEQ ID NO: 10248 - DNA, 20 bp, synthetic construct
  misc_feature 1..20: note = CRISPR gRNA sequence
  source 1..20: mol_type = other DNA
ccagacagatcttttttttt

SEQ ID NO: 10249 - DNA, 20 bp, synthetic construct
  misc_feature 1..20: note = CRISPR gRNA sequence
  source 1..20: mol_type = other DNA
agacagatctttttttttaa

SEQ ID NO: 10250 - DNA, 20 bp, synthetic construct
  misc_feature 1..20: note = CRISPR gRNA sequence
  source 1..20: mol_type = other DNA
gacagatctttttttttaag

SEQ ID NO: 10251 - DNA, 20 bp, synthetic construct
  misc_feature 1..20: note = CRISPR gRNA sequence
  source 1..20: mol_type = other DNA
acagatctttttttttaaga

SEQ ID NO: 10252 - DNA, 20 bp, synthetic construct
  misc_feature 1..20: note = CRISPR gRNA sequence
  source 1..20: mol_type = other DNA
cagatctttttttttaagag

SEQ ID NO: 10253 - DNA, 20 bp, synthetic construct
  misc_feature 1..20: note = CRISPR gRNA sequence
  source 1..20: mol_type = other DNA
agatctttttttttaagagg

SEQ ID NO: 10254 - DNA, 20 bp, synthetic construct
  misc_feature 1..20: note = CRISPR gRNA sequence
  source 1..20: mol_type = other DNA
tttttttaagagggggacaa

SEQ ID NO: 10255 - DNA, 20 bp, synthetic construct
  misc_feature 1..20: note = CRISPR gRNA sequence
  source 1..20: mol_type = other DNA
agggggacaacagttgcccc

SEQ ID NO: 10256 - DNA, 20 bp, synthetic construct
  misc_feature 1..20: note = CRISPR gRNA sequence
  source 1..20: mol_type = other DNA
gggggacaacagttgcccca

SEQ ID NO: 10257 - DNA, 20 bp, synthetic construct
  misc_feature 1..20: note = CRISPR gRNA sequence
  source 1..20: mol_type = other DNA
gacaacagttgccccaagga

SEQ ID NO: 10258 - DNA, 20 bp, synthetic construct
  misc_feature 1..20: note = CRISPR gRNA sequence
  source 1..20: mol_type = other DNA
cccaaggaaagcaatccccc

SEQ ID NO: 10259 - DNA, 20 bp, synthetic construct
  misc_feature 1..20: note = CRISPR gRNA sequence
  source 1..20: mol_type = other DNA
ccaaggaaagcaatccccct

SEQ ID NO: 10260 - DNA, 20 bp, synthetic construct
  misc_feature 1..20: note = CRISPR gRNA sequence
  source 1..20: mol_type = other DNA
caaggaaagcaatccccctg

SEQ ID NO: 10261 - DNA, 20 bp, synthetic construct
  misc_feature 1..20: note = CRISPR gRNA sequence
  source 1..20: mol_type = other DNA
agcaatccccctggggaatt

SEQ ID NO: 10262 - DNA, 20 bp, synthetic construct
  misc_feature 1..20: note = CRISPR gRNA sequence
  source 1..20: mol_type = other DNA
gcaatccccctggggaattt

SEQ ID NO: 10263 - DNA, 20 bp, synthetic construct
  misc_feature 1..20: note = CRISPR gRNA sequence
  source 1..20: mol_type = other DNA
caatccccctggggaatttg

SEQ ID NO: 10264 - DNA, 20 bp, synthetic construct
  misc_feature 1..20: note = CRISPR gRNA sequence
  source 1..20: mol_type = other DNA
ccctggggaatttggggcac

SEQ ID NO: 10265 - DNA, 20 bp, synthetic construct
  misc_feature 1..20: note = CRISPR gRNA sequence
  source 1..20: mol_type = other DNA
cctggggaatttggggcact

SEQ ID NO: 10266 - DNA, 20 bp, synthetic construct
  misc_feature 1..20: note = CRISPR gRNA sequence
  source 1..20: mol_type = other DNA
ctggggaatttggggcactg

SEQ ID NO: 10267 - DNA, 20 bp, synthetic construct
  misc_feature 1..20: note = CRISPR gRNA sequence
  source 1..20: mol_type = other DNA
gggaatttggggcactgggg

SEQ ID NO: 10268 - DNA, 20 bp, synthetic construct
  misc_feature 1..20: note = CRISPR gRNA sequence
  source 1..20: mol_type = other DNA
gggcactggggcagccatca

SEQ ID NO: 10269 - DNA, 20 bp, synthetic construct
  misc_feature 1..20: note = CRISPR gRNA sequence
  source 1..20: mol_type = other DNA
ggcactggggcagccatcat

SEQ ID NO: 10270 - DNA, 20 bp, synthetic construct
  misc_feature 1..20: note = CRISPR gRNA sequence
  source 1..20: mol_type = other DNA
ggcagccatcatgggaccca

SEQ ID NO: 10271 - DNA, 20 bp, synthetic construct
  misc_feature 1..20: note = CRISPR gRNA sequence
  source 1..20: mol_type = other DNA
gcagccatcatgggacccat

SEQ ID NO: 10272 - DNA, 20 bp, synthetic construct
  misc_feature 1..20: note = CRISPR gRNA sequence
  source 1..20: mol_type = other DNA
ccatcatgggacccatgggt

SEQ ID NO: 10273 - DNA, 20 bp, synthetic construct
  misc_feature 1..20: note = CRISPR gRNA sequence
  source 1..20: mol_type = other DNA
catcatgggacccatgggta

SEQ ID NO: 10274 - DNA, 20 bp, synthetic construct
  misc_feature 1..20: note = CRISPR gRNA sequence
  source 1..20: mol_type = other DNA
atcatgggacccatgggtaa

SEQ ID NO: 10275 - DNA, 20 bp, synthetic construct
  misc_feature 1..20: note = CRISPR gRNA sequence
  source 1..20: mol_type = other DNA
gggacccatgggtaagggct

SEQ ID NO: 10276 - DNA, 20 bp, synthetic construct
  misc_feature 1..20: note = CRISPR gRNA sequence
  source 1..20: mol_type = other DNA
catgggtaagggctcagtga

SEQ ID NO: 10277 - DNA, 20 bp, synthetic construct
  misc_feature 1..20: note = CRISPR gRNA sequence
  source 1..20: mol_type = other DNA
gggtaagggctcagtgacag

SEQ ID NO: 10278 - DNA, 20 bp, synthetic construct
  misc_feature 1..20: note = CRISPR gRNA sequence
  source 1..20: mol_type = other DNA
ctaacattgcctgttctctc

SEQ ID NO: 10279 - DNA, 20 bp, synthetic construct
  misc_feature 1..20: note = CRISPR gRNA sequence
  source 1..20: mol_type = other DNA
taacattgcctgttctctcc

SEQ ID NO: 10280 - DNA, 20 bp, synthetic construct
  misc_feature 1..20: note = CRISPR gRNA sequence
  source 1..20: mol_type = other DNA
ttgcctgttctctccaggac

SEQ ID NO: 10281 - DNA, 20 bp, synthetic construct
  misc_feature 1..20: note = CRISPR gRNA sequence
  source 1..20: mol_type = other DNA
cctgttctctccaggacgag

SEQ ID NO: 10282 - DNA, 20 bp, synthetic construct
  misc_feature 1..20: note = CRISPR gRNA sequence
  source 1..20: mol_type = other DNA
ctccaggacgagaagttcct

SEQ ID NO: 10283 - DNA, 20 bp, synthetic construct
  misc_feature 1..20: note = CRISPR gRNA sequence
  source 1..20: mol_type = other DNA
caggacgagaagttcctcgg

SEQ ID NO: 10284 - DNA, 20 bp, synthetic construct
  misc_feature 1..20: note = CRISPR gRNA sequence
  source 1..20: mol_type = other DNA
gagaagttcctcggaagaca

SEQ ID NO: 10285 - DNA, 20 bp, synthetic construct
  misc_feature 1..20: note = CRISPR gRNA sequence
  source 1..20: mol_type = other DNA
agttcctcggaagacacagc

SEQ ID NO: 10286 - DNA, 20 bp, synthetic construct
  misc_feature 1..20: note = CRISPR gRNA sequence
  source 1..20: mol_type = other DNA
gttcctcggaagacacagct

SEQ ID NO: 10287 - DNA, 20 bp, synthetic construct
  misc_feature 1..20: note = CRISPR gRNA sequence
  source 1..20: mol_type = other DNA
ttcctcggaagacacagctg

SEQ ID NO: 10288 - DNA, 20 bp, synthetic construct
  misc_feature 1..20: note = CRISPR gRNA sequence
  source 1..20: mol_type = other DNA
cctcggaagacacagctggg

SEQ ID NO: 10289 - DNA, 20 bp, synthetic construct
  misc_feature 1..20: note = CRISPR gRNA sequence
  source 1..20: mol_type = other DNA
ctggggagctccctgctgtt

SEQ ID NO: 10290 - DNA, 20 bp, synthetic construct
  misc_feature 1..20: note = CRISPR gRNA sequence
  source 1..20: mol_type = other DNA
tggggagctccctgctgttc

SEQ ID NO: 10291 - DNA, 20 bp, synthetic construct
  misc_feature 1..20: note = CRISPR gRNA sequence
  source 1..20: mol_type = other DNA
tccctgctgttcgggaccta

SEQ ID NO: 10292 - DNA, 20 bp, synthetic construct
  misc_feature 1..20: note = CRISPR gRNA sequence
  source 1..20: mol_type = other DNA
tgttcgggacctaaagaaac

SEQ ID NO: 10293 - DNA, 20 bp, synthetic construct
  misc_feature 1..20: note = CRISPR gRNA sequence
  source 1..20: mol_type = other DNA
ttcgggacctaaagaaactg

SEQ ID NO: 10294 - DNA, 20 bp, synthetic construct
  misc_feature 1..20: note = CRISPR gRNA sequence
  source 1..20: mol_type = other DNA
aaagaaactggagtttgcgt

SEQ ID NO: 10295 - DNA, 20 bp, synthetic construct
  misc_feature 1..20: note = CRISPR gRNA sequence
  source 1..20: mol_type = other DNA
aactggagtttgcgtaagca

SEQ ID NO: 10296 - DNA, 20 bp, synthetic construct
  misc_feature 1..20: note = CRISPR gRNA sequence
  source 1..20: mol_type = other DNA
actggagtttgcgtaagcaa

SEQ ID NO: 10297 - DNA, 20 bp, synthetic construct
  misc_feature 1..20: note = CRISPR gRNA sequence
  source 1..20: mol_type = other DNA
ctggagtttgcgtaagcaaa

SEQ ID NO: 10298 - DNA, 20 bp, synthetic construct
  misc_feature 1..20: note = CRISPR gRNA sequence
  source 1..20: mol_type = other DNA
tggagtttgcgtaagcaaag

SEQ ID NO: 10299 - DNA, 20 bp, synthetic construct
  misc_feature 1..20: note = CRISPR gRNA sequence
  source 1..20: mol_type = other DNA
agtttgcgtaagcaaagggg

SEQ ID NO: 10300 - DNA, 20 bp, synthetic construct
  misc_feature 1..20: note = CRISPR gRNA sequence
  source 1..20: mol_type = other DNA
caaaggggtggattgtcttg

SEQ ID NO: 10301 - DNA, 20 bp, synthetic construct
  misc_feature 1..20: note = CRISPR gRNA sequence
  source 1..20: mol_type = other DNA
aaaggggtggattgtcttgt

SEQ ID NO: 10302 - DNA, 20 bp, synthetic construct
  misc_feature 1..20: note = CRISPR gRNA sequence
  source 1..20: mol_type = other DNA
attgtcttgtgggtctgcgc

SEQ ID NO: 10303 - DNA, 20 bp, synthetic construct
  misc_feature 1..20: note = CRISPR gRNA sequence
  source 1..20: mol_type = other DNA
ttgtcttgtgggtctgcgca

SEQ ID NO: 10304 - DNA, 20 bp, synthetic construct
  misc_feature 1..20: note = CRISPR gRNA sequence
  source 1..20: mol_type = other DNA
tctgcgcaaggtttcccctg

SEQ ID NO: 10305 - DNA, 20 bp, synthetic construct
  misc_feature 1..20: note = CRISPR gRNA sequence
  source 1..20: mol_type = other DNA
caaggtttcccctgcagcat

SEQ ID NO: 10306 - DNA, 20 bp, synthetic construct
  misc_feature 1..20: note = CRISPR gRNA sequence
  source 1..20: mol_type = other DNA
gtttcccctgcagcattagc

SEQ ID NO: 10307 - DNA, 20 bp, synthetic construct
  misc_feature 1..20: note = CRISPR gRNA sequence
  source 1..20: mol_type = other DNA
tttcccctgcagcattagct

SEQ ID NO: 10308 - DNA, 20 bp, synthetic construct
  misc_feature 1..20: note = CRISPR gRNA sequence
  source 1..20: mol_type = other DNA
ctgggcttgtaccacctgaa

SEQ ID NO: 10309 - DNA, 20 bp, synthetic construct
  misc_feature 1..20: note = CRISPR gRNA sequence
  source 1..20: mol_type = other DNA
gggcttgtaccacctgaatg

SEQ ID NO: 10310 - DNA, 20 bp, synthetic construct
  misc_feature 1..20: note = CRISPR gRNA sequence
  source 1..20: mol_type = other DNA
ttgtaccacctgaatggaga

SEQ ID NO: 10311 - DNA, 20 bp, synthetic construct
  misc_feature 1..20: note = CRISPR gRNA sequence
  source 1..20: mol_type = other DNA
cctgaatggagatagatctc

SEQ ID NO: 10312 - DNA, 20 bp, synthetic construct
  misc_feature 1..20: note = CRISPR gRNA sequence
  source 1..20: mol_type = other DNA
taccctcttgcccaccactt

SEQ ID NO: 10313 - DNA, 20 bp, synthetic construct
  misc_feature 1..20: note = CRISPR gRNA sequence
  source 1..20: mol_type = other DNA
cttgcccaccactttggaaa

SEQ ID NO: 10314 - DNA, 20 bp, synthetic construct
  misc_feature 1..20: note = CRISPR gRNA sequence
  source 1..20: mol_type = other DNA
accactttggaaatagcttc

SEQ ID NO: 10315 - DNA, 20 bp, synthetic construct
  misc_feature 1..20: note = CRISPR gRNA sequence
  source 1..20: mol_type = other DNA
actttggaaatagcttccag

SEQ ID NO: 10316 - DNA, 20 bp, synthetic construct
  misc_feature 1..20: note = CRISPR gRNA sequence
  source 1..20: mol_type = other DNA
tggaaatagcttccagcagc

SEQ ID NO: 10317 - DNA, 20 bp, synthetic construct
  misc_feature 1..20: note = CRISPR gRNA sequence
  source 1..20: mol_type = other DNA
aatagcttccagcagctgga

SEQ ID NO: 10318 - DNA, 20 bp, synthetic construct
  misc_feature 1..20: note = CRISPR gRNA sequence
  source 1..20: mol_type = other DNA
tccagcagctggaaagtgac

SEQ ID NO: 10319 - DNA, 20 bp, synthetic construct
  misc_feature 1..20: note = CRISPR gRNA sequence
  source 1..20: mol_type = other DNA
cagctggaaagtgaccagtg

SEQ ID NO: 10320 - DNA, 20 bp, synthetic construct
  misc_feature 1..20: note = CRISPR gRNA sequence
  source 1..20: mol_type = other DNA
agctggaaagtgaccagtgt

SEQ ID NO: 10321 - DNA, 20 bp, synthetic construct
  misc_feature 1..20: note = CRISPR gRNA sequence
  source 1..20: mol_type = other DNA
tgaccagtgtgggcaaatgc

SEQ ID NO: 10322 - DNA, 20 bp, synthetic construct
  misc_feature 1..20: note = CRISPR gRNA sequence
  source 1..20: mol_type = other DNA
accagtgtgggcaaatgctg

SEQ ID NO: 10323 - DNA, 20 bp, synthetic construct
  misc_feature 1..20: note = CRISPR gRNA sequence
  source 1..20: mol_type = other DNA
ccagtgtgggcaaatgctgg

SEQ ID NO: 10324 - DNA, 20 bp, synthetic construct
  misc_feature 1..20: note = CRISPR gRNA sequence
  source 1..20: mol_type = other DNA
gggcaaatgctggaggttct

SEQ ID NO: 10325 - DNA, 20 bp, synthetic construct
  misc_feature 1..20: note = CRISPR gRNA sequence
  source 1..20: mol_type = other DNA
gctggaggttctcagatttg

SEQ ID NO: 10326 - DNA, 20 bp, synthetic construct
  misc_feature 1..20: note = CRISPR gRNA sequence
  source 1..20: mol_type = other DNA
gttctcagatttgaagctaa

SEQ ID NO: 10327 - DNA, 20 bp, synthetic construct
  misc_feature 1..20: note = CRISPR gRNA sequence
  source 1..20: mol_type = other DNA
aagctaatggacccgtttgc

SEQ ID NO: 10328 - DNA, 20 bp, synthetic construct
  misc_feature 1..20: note = CRISPR gRNA sequence
  source 1..20: mol_type = other DNA
gacccgtttgctggttaaca

SEQ ID NO: 10329 - DNA, 20 bp, synthetic construct
  misc_feature 1..20: note = CRISPR gRNA sequence
  source 1..20: mol_type = other DNA
cattcccatcactcattcaa

SEQ ID NO: 10330 - DNA, 20 bp, synthetic construct
  misc_feature 1..20: note = CRISPR gRNA sequence
  source 1..20: mol_type = other DNA
ttcccatcactcattcaaca

SEQ ID NO: 10331 - DNA, 20 bp, synthetic construct
  misc_feature 1..20: note = CRISPR gRNA sequence
  source 1..20: mol_type = other DNA
tcccatcactcattcaacag

SEQ ID NO: 10332 - DNA, 20 bp, synthetic construct
  misc_feature 1..20: note = CRISPR gRNA sequence
  source 1..20: mol_type = other DNA
actcattcaacagaggtatt

SEQ ID NO: 10333 - DNA, 20 bp, synthetic construct
  misc_feature 1..20: note = CRISPR gRNA sequence
  source 1..20: mol_type = other DNA
tattgagcacttgaatgact

SEQ ID NO: 10334 - DNA, 20 bp, synthetic construct
  misc_feature 1..20: note = CRISPR gRNA sequence
  source 1..20: mol_type = other DNA
attgagcacttgaatgactg

SEQ ID NO: 10335 - DNA, 20 bp, synthetic construct
  misc_feature 1..20: note = CRISPR gRNA sequence
  source 1..20: mol_type = other DNA
actgaggctgctgtcctcat

SEQ ID NO: 10336 - DNA, 20 bp, synthetic construct
  misc_feature 1..20: note = CRISPR gRNA sequence
  source 1..20: mol_type = other DNA
ctgctgtcctcatgagctga

SEQ ID NO: 10337 - DNA, 20 bp, synthetic construct
  misc_feature 1..20: note = CRISPR gRNA sequence
  source 1..20: mol_type = other DNA
cagtctaatcaactcccctc

SEQ ID NO: 10338 - DNA, 20 bp, synthetic construct
  misc_feature 1..20: note = CRISPR gRNA sequence
  source 1..20: mol_type = other DNA
gtctaatcaactcccctctg

SEQ ID NO: 10339 - DNA, 20 bp, synthetic construct
  misc_feature 1..20: note = CRISPR gRNA sequence
  source 1..20: mol_type = other DNA
tctaatcaactcccctctgg

SEQ ID NO: 10340 - DNA, 20 bp, synthetic construct
  misc_feature 1..20: note = CRISPR gRNA sequence
  source 1..20: mol_type = other DNA
taatcaactcccctctggag

SEQ ID NO: 10341 - DNA, 20 bp, synthetic construct
  misc_feature 1..20: note = CRISPR gRNA sequence
  source 1..20: mol_type = other DNA
aatcaactcccctctggagg

SEQ ID NO: 10342 - DNA, 20 bp, synthetic construct
  misc_feature 1..20: note = CRISPR gRNA sequence
  source 1..20: mol_type = other DNA
aactcccctctggaggaggt

SEQ ID NO: 10343 - DNA, 20 bp, synthetic construct
  misc_feature 1..20: note = CRISPR gRNA sequence
  source 1..20: mol_type = other DNA
actcccctctggaggaggtc

SEQ ID NO: 10344 - DNA, 20 bp, synthetic construct
  misc_feature 1..20: note = CRISPR gRNA sequence
  source 1..20: mol_type = other DNA
ctcccctctggaggaggtca

SEQ ID NO: 10345 - DNA, 20 bp, synthetic construct
  misc_feature 1..20: note = CRISPR gRNA sequence
  source 1..20: mol_type = other DNA
tcccctctggaggaggtcag

SEQ ID NO: 10346 - DNA, 20 bp, synthetic construct
  misc_feature 1..20: note = CRISPR gRNA sequence
  source 1..20: mol_type = other DNA
cccctctggaggaggtcagg

SEQ ID NO: 10347 - DNA, 20 bp, synthetic construct
  misc_feature 1..20: note = CRISPR gRNA sequence
  source 1..20: mol_type = other DNA
aggaggtcagggggacttcc

SEQ ID NO: 10348 - DNA, 20 bp, synthetic construct
  misc_feature 1..20: note = CRISPR gRNA sequence
  source 1..20: mol_type = other DNA
gaggtcagggggacttcctg

SEQ ID NO: 10349 - DNA, 20 bp, synthetic construct
  misc_feature 1..20: note = CRISPR gRNA sequence
  source 1..20: mol_type = other DNA
aggtcagggggacttcctgg

SEQ ID NO: 10350 - DNA, 20 bp, synthetic construct
  misc_feature 1..20: note = CRISPR gRNA sequence
  source 1..20: mol_type = other DNA
gtcagggggacttcctggag

SEQ ID NO: 10351 - DNA, 20 bp, synthetic construct
  misc_feature 1..20: note = CRISPR gRNA sequence
  source 1..20: mol_type = other DNA
tcagggggacttcctggagg

SEQ ID NO: 10352 - DNA, 20 bp, synthetic construct
  misc_feature 1..20: note = CRISPR gRNA sequence
  source 1..20: mol_type = other DNA
aggaggtgatatctgcactg

SEQ ID NO: 10353 - DNA, 20 bp, synthetic construct
  misc_feature 1..20: note = CRISPR gRNA sequence
  source 1..20: mol_type = other DNA
tgatatctgcactgaagctt

SEQ ID NO: 10354 - DNA, 20 bp, synthetic construct
  misc_feature 1..20: note = CRISPR gRNA sequence
  source 1..20: mol_type = other DNA
atctgcactgaagcttcagt

SEQ ID NO: 10355 - DNA, 20 bp, synthetic construct
  misc_feature 1..20: note = CRISPR gRNA sequence
  source 1..20: mol_type = other DNA
tctgcactgaagcttcagtg

SEQ ID NO: 10356 - DNA, 20 bp, synthetic construct
  misc_feature 1..20: note = CRISPR gRNA sequence
  source 1..20: mol_type = other DNA
actgaagcttcagtgaggat

SEQ ID NO: 10357 - DNA, 20 bp, synthetic construct
  misc_feature 1..20: note = CRISPR gRNA sequence
  source 1..20: mol_type = other DNA
ctgaagcttcagtgaggata

SEQ ID NO: 10358 - DNA, 20 bp, synthetic construct
  misc_feature 1..20: note = CRISPR gRNA sequence
  source 1..20: mol_type = other DNA
cttcagtgaggataaggaat

SEQ ID NO: 10359 - DNA, 20 bp, synthetic construct
  misc_feature 1..20: note = CRISPR gRNA sequence
  source 1..20: mol_type = other DNA
gtgaggataaggaatgagct

SEQ ID NO: 10360 - DNA, 20 bp, synthetic construct
  misc_feature 1..20: note = CRISPR gRNA sequence
  source 1..20: mol_type = other DNA
aggataaggaatgagctgag

SEQ ID NO: 10361 - DNA, 20 bp, synthetic construct
  misc_feature 1..20: note = CRISPR gRNA sequence
  source 1..20: mol_type = other DNA
ggataaggaatgagctgagt

SEQ ID NO: 10362 - DNA, 20 bp, synthetic construct
  misc_feature 1..20: note = CRISPR gRNA sequence
  source 1..20: mol_type = other DNA
gataaggaatgagctgagtg

SEQ ID NO: 10363 - DNA, 20 bp, synthetic construct
  misc_feature 1..20: note = CRISPR gRNA sequence
  source 1..20: mol_type = other DNA
taaggaatgagctgagtggg

SEQ ID NO: 10364 - DNA, 20 bp, synthetic construct
  misc_feature 1..20: note = CRISPR gRNA sequence
  source 1..20: mol_type = other DNA
aggaatgagctgagtgggga

SEQ ID NO: 10365 - DNA, 20 bp, synthetic construct
  misc_feature 1..20: note = CRISPR gRNA sequence
  source 1..20: mol_type = other DNA
ggaatgagctgagtggggag

SEQ ID NO: 10366 - DNA, 20 bp, synthetic construct
  misc_feature 1..20: note = CRISPR gRNA sequence
  source 1..20: mol_type = other DNA
gaatgagctgagtggggaga

SEQ ID NO: 10367 - DNA, 20 bp, synthetic construct
  misc_feature 1..20: note = CRISPR gRNA sequence
  source 1..20: mol_type = other DNA
aatgagctgagtggggagag

SEQ ID NO: 10368 - DNA, 20 bp, synthetic construct
  misc_feature 1..20: note = CRISPR gRNA sequence
  source 1..20: mol_type = other DNA
tgagctgagtggggagaggg

SEQ ID NO: 10369 - DNA, 20 bp, synthetic construct
  misc_feature 1..20: note = CRISPR gRNA sequence
  source 1..20: mol_type = other DNA
ctgagtggggagaggggagt

SEQ ID NO: 10370 - DNA, 20 bp, synthetic construct
  misc_feature 1..20: note = CRISPR gRNA sequence
  source 1..20: mol_type = other DNA
gtggggagaggggagtaaga

SEQ ID NO: 10371 - DNA, 20 bp, synthetic construct
  misc_feature 1..20: note = CRISPR gRNA sequence
  source 1..20: mol_type = other DNA
tggggagaggggagtaagaa

SEQ ID NO: 10372 - DNA, 20 bp, synthetic construct
  misc_feature 1..20: note = CRISPR gRNA sequence
  source 1..20: mol_type = other DNA
ggggagtaagaaaggctttc

SEQ ID NO: 10373 - DNA, 20 bp, synthetic construct
  misc_feature 1..20: note = CRISPR gRNA sequence
  source 1..20: mol_type = other DNA
gggagtaagaaaggctttcc

SEQ ID NO: 10374 - DNA, 20 bp, synthetic construct
  misc_feature 1..20: note = CRISPR gRNA sequence
  source 1..20: mol_type = other DNA
tccaggaattgtaatttcgc

SEQ ID NO: 10375 - DNA, 20 bp, synthetic construct
  misc_feature 1..20: note = CRISPR gRNA sequence
  source 1..20: mol_type = other DNA
ccaggaattgtaatttcgcc

SEQ ID NO: 10376 - DNA, 20 bp, synthetic construct
  misc_feature 1..20: note = CRISPR gRNA sequence
  source 1..20: mol_type = other DNA
caggaattgtaatttcgcca

SEQ ID NO: 10377 - DNA, 20 bp, synthetic construct
  misc_feature 1..20: note = CRISPR gRNA sequence
  source 1..20: mol_type = other DNA
attgtaatttcgccagggat

SEQ ID NO: 10378 - DNA, 20 bp, synthetic construct
  misc_feature 1..20: note = CRISPR gRNA sequence
  source 1..20: mol_type = other DNA
aatttcgccagggatcagaa

SEQ ID NO: 10379 - DNA, 20 bp, synthetic construct
  misc_feature 1..20: note = CRISPR gRNA sequence
  source 1..20: mol_type = other DNA
atttcgccagggatcagaaa

SEQ ID NO: 10380 - DNA, 20 bp, synthetic construct
  misc_feature 1..20: note = CRISPR gRNA sequence
  source 1..20: mol_type = other DNA
aatgtgtccccaaccttcca

SEQ ID NO: 10381 - DNA, 20 bp, synthetic construct
  misc_feature 1..20: note = CRISPR gRNA sequence
  source 1..20: mol_type = other DNA
atgtgtccccaaccttccat

SEQ ID NO: 10382 - DNA, 20 bp, synthetic construct
  misc_feature 1..20: note = CRISPR gRNA sequence
  source 1..20: mol_type = other DNA
gtgtccccaaccttccatag

SEQ ID NO: 10383 - DNA, 20 bp, synthetic construct
  misc_feature 1..20: note = CRISPR gRNA sequence
  source 1..20: mol_type = other DNA
tgtccccaaccttccatagg

SEQ ID NO: 10384 - DNA, 20 bp, synthetic construct
  misc_feature 1..20: note = CRISPR gRNA sequence
  source 1..20: mol_type = other DNA
ggaggatgccactatgacta

SEQ ID NO: 10385 - DNA, 20 bp, synthetic construct
  misc_feature 1..20: note = CRISPR gRNA sequence
  source 1..20: mol_type = other DNA
aggatgccactatgactatg

SEQ ID NO: 10386 - DNA, 20 bp, synthetic construct
  misc_feature 1..20: note = CRISPR gRNA sequence
  source 1..20: mol_type = other DNA
tggagtccttttccctcctg

SEQ ID NO: 10387 - DNA, 20 bp, synthetic construct
  misc_feature 1..20: note = CRISPR gRNA sequence
  source 1..20: mol_type = other DNA
gtccttttccctcctgtggc

SEQ ID NO: 10388 - DNA, 20 bp, synthetic construct
  misc_feature 1..20: note = CRISPR gRNA sequence
  source 1..20: mol_type = other DNA
tccttttccctcctgtggcc

SEQ ID NO: 10389 - DNA, 20 bp, synthetic construct
  misc_feature 1..20: note = CRISPR gRNA sequence
  source 1..20: mol_type = other DNA
gcacaacgtcccttgtgcct

SEQ ID NO: 10390 - DNA, 20 bp, synthetic construct
  misc_feature 1..20: note = CRISPR gRNA sequence
  source 1..20: mol_type = other DNA
cctgagcttgtttacttcca

SEQ ID NO: 10391 - DNA, 20 bp, synthetic construct
  misc_feature 1..20: note = CRISPR gRNA sequence
  source 1..20: mol_type = other DNA
gcttgtttacttccacagcc

SEQ ID NO: 10392 - DNA, 20 bp, synthetic construct
  misc_feature 1..20: note = CRISPR gRNA sequence
  source 1..20: mol_type = other DNA
cttgtttacttccacagcca

SEQ ID NO: 10393 - DNA, 20 bp, synthetic construct
  misc_feature 1..20: note = CRISPR gRNA sequence
  source 1..20: mol_type = other DNA
ttgtttacttccacagccaa

SEQ ID NO: 10394 - DNA, 20 bp, synthetic construct
  misc_feature 1..20: note = CRISPR gRNA sequence
  source 1..20: mol_type = other DNA
ttacttccacagccaaggga

SEQ ID NO: 10395 - DNA, 20 bp, synthetic construct
  misc_feature 1..20: note = CRISPR gRNA sequence
  source 1..20: mol_type = other DNA
cagccaagggatggcctccc

SEQ ID NO: 10396 - DNA, 20 bp, synthetic construct
  misc_feature 1..20: note = CRISPR gRNA sequence
  source 1..20: mol_type = other DNA
agccaagggatggcctcccc

SEQ ID NO: 10397 - DNA, 20 bp, synthetic construct
  misc_feature 1..20: note = CRISPR gRNA sequence
  source 1..20: mol_type = other DNA
gccaagggatggcctcccca

SEQ ID NO: 10398 - DNA, 20 bp, synthetic construct
  misc_feature 1..20: note = CRISPR gRNA sequence
  source 1..20: mol_type = other DNA
caagggatggcctccccagg

SEQ ID NO: 10399 - DNA, 20 bp, synthetic construct
  misc_feature 1..20: note = CRISPR gRNA sequence
  source 1..20: mol_type = other DNA
ttcccccattttgaaattcc

SEQ ID NO: 10400 - DNA, 20 bp, synthetic construct
  misc_feature 1..20: note = CRISPR gRNA sequence
  source 1..20: mol_type = other DNA
tcccccattttgaaattccc

SEQ ID NO: 10401 - DNA, 20 bp, synthetic construct
  misc_feature 1..20: note = CRISPR gRNA sequence
  source 1..20: mol_type = other DNA
ccccattttgaaattcccag

SEQ ID NO: 10402 - DNA, 20 bp, synthetic construct
  misc_feature 1..20: note = CRISPR gRNA sequence
  source 1..20: mol_type = other DNA
tcccaggagcttttgatgtg

SEQ ID NO: 10403 - DNA, 20 bp, synthetic construct
  misc_feature 1..20: note = CRISPR gRNA sequence
  source 1..20: mol_type = other DNA
aggagcttttgatgtgcagc

SEQ ID NO: 10404 - DNA, 20 bp, synthetic construct
  misc_feature 1..20: note = CRISPR gRNA sequence
  source 1..20: mol_type = other DNA
ggagcttttgatgtgcagct

SEQ ID NO: 10405 - DNA, 20 bp, synthetic construct
  misc_feature 1..20: note = CRISPR gRNA sequence
  source 1..20: mol_type = other DNA
gatgtgcagctaggatgaaa

SEQ ID NO: 10406 - DNA, 20 bp, synthetic construct
  misc_feature 1..20: note = CRISPR gRNA sequence
  source 1..20: mol_type = other DNA
aaaaagcaaccctacttgcc

SEQ ID NO: 10407 - DNA, 20 bp, synthetic construct
  misc_feature 1..20: note = CRISPR gRNA sequence
  source 1..20: mol_type = other DNA
aaaagcaaccctacttgcct

SEQ ID NO: 10408 - DNA, 20 bp, synthetic construct
  misc_feature 1..20: note = CRISPR gRNA sequence
  source 1..20: mol_type = other DNA
ctacttgcctgggactatcc

SEQ ID NO: 10409 - DNA, 20 bp, synthetic construct
  misc_feature 1..20: note = CRISPR gRNA sequence
  source 1..20: mol_type = other DNA
tatcctggtttgaaaactga

SEQ ID NO: 10410 - DNA, 20 bp, synthetic construct
  misc_feature 1..20: note = CRISPR gRNA sequence
  source 1..20: mol_type = other DNA
aactgaaagtcttgcatccc

SEQ ID NO: 10411 - DNA, 20 bp, synthetic construct
  misc_feature 1..20: note = CRISPR gRNA sequence
  source 1..20: mol_type = other DNA
tgaaagtcttgcatcccaag

SEQ ID NO: 10412 - DNA, 20 bp, synthetic construct
  misc_feature 1..20: note = CRISPR gRNA sequence
  source 1..20: mol_type = other DNA
ttgcatcccaagaagcccct

SEQ ID NO: 10413 - DNA, 20 bp, synthetic construct
  misc_feature 1..20: note = CRISPR gRNA sequence
  source 1..20: mol_type = other DNA
cccaagaagccccttagtcc

SEQ ID NO: 10414 - DNA, 20 bp, synthetic construct
  misc_feature 1..20: note = CRISPR gRNA sequence
  source 1..20: mol_type = other DNA
ccaagaagccccttagtccc

SEQ ID NO: 10415 - DNA, 20 bp, synthetic construct
  misc_feature 1..20: note = CRISPR gRNA sequence
  source 1..20: mol_type = other DNA
ccccttagtcccaggcaaac

SEQ ID NO: 10416 - DNA, 20 bp, synthetic construct
  misc_feature 1..20: note = CRISPR gRNA sequence
  source 1..20: mol_type = other DNA
cccttagtcccaggcaaact

SEQ ID NO: 10417 - DNA, 20 bp, synthetic construct
  misc_feature 1..20: note = CRISPR gRNA sequence
  source 1..20: mol_type = other DNA
tagtcccaggcaaactggga

SEQ ID NO: 10418 - DNA, 20 bp, synthetic construct
  misc_feature 1..20: note = CRISPR gRNA sequence
  source 1..20: mol_type = other DNA
cccaggcaaactgggacagt

SEQ ID NO: 10419 - DNA, 20 bp, synthetic construct
  misc_feature 1..20: note = CRISPR gRNA sequence
  source 1..20: mol_type = other DNA
acagttggttgctctatgtg

SEQ ID NO: 10420 - DNA, 20 bp, synthetic construct
  misc_feature 1..20: note = CRISPR gRNA sequence
  source 1..20: mol_type = other DNA
ttggttgctctatgtgtggc

SEQ ID NO: 10421 - DNA, 20 bp, synthetic construct
  misc_feature 1..20: note = CRISPR gRNA sequence
  source 1..20: mol_type = other DNA
tggttgctctatgtgtggcc

SEQ ID NO: 10422 - DNA, 20 bp, synthetic construct
  misc_feature 1..20: note = CRISPR gRNA sequence
  source 1..20: mol_type = other DNA
ggttgctctatgtgtggcca

SEQ ID NO: 10423 - DNA, 20 bp, synthetic construct
  misc_feature 1..20: note = CRISPR gRNA sequence
  source 1..20: mol_type = other DNA
gctctatgtgtggccagggc

SEQ ID NO: 10424 - DNA, 20 bp, synthetic construct
  misc_feature 1..20: note = CRISPR gRNA sequence
  source 1..20: mol_type = other DNA
ctctatgtgtggccagggct

SEQ ID NO: 10425 - DNA, 20 bp, synthetic construct
  misc_feature 1..20: note = CRISPR gRNA sequence
  source 1..20: mol_type = other DNA
tctatgtgtggccagggctg

SEQ ID NO: 10426 - DNA, 20 bp, synthetic construct
  misc_feature 1..20: note = CRISPR gRNA sequence
  source 1..20: mol_type = other DNA
ctatgtgtggccagggctgg

SEQ ID NO: 10427 - DNA, 20 bp, synthetic construct
  misc_feature 1..20: note = CRISPR gRNA sequence
  source 1..20: mol_type = other DNA
cagggctgggggccacaccc

SEQ ID NO: 10428 - DNA, 20 bp, synthetic construct
  misc_feature 1..20: note = CRISPR gRNA sequence
  source 1..20: mol_type = other DNA
agggctgggggccacaccct

SEQ ID NO: 10429 - DNA, 20 bp, synthetic construct
  misc_feature 1..20: note = CRISPR gRNA sequence
  source 1..20: mol_type = other DNA
gctgggggccacaccctagg

SEQ ID NO: 10430 - DNA, 20 bp, synthetic construct
  misc_feature 1..20: note = CRISPR gRNA sequence
  source 1..20: mol_type = other DNA
cacaccctaggcagtgttgc

SEQ ID NO: 10431 - DNA, 20 bp, synthetic construct
  misc_feature 1..20: note = CRISPR gRNA sequence
  source 1..20: mol_type = other DNA
acaccctaggcagtgttgct

SEQ ID NO: 10432 - DNA, 20 bp, synthetic construct
  misc_feature 1..20: note = CRISPR gRNA sequence
  source 1..20: mol_type = other DNA
caccctaggcagtgttgctg

SEQ ID NO: 10433 - DNA, 20 bp, synthetic construct
  misc_feature 1..20: note = CRISPR gRNA sequence
  source 1..20: mol_type = other DNA
aggcagtgttgctggggtga

SEQ ID NO: 10434 - DNA, 20 bp, synthetic construct
  misc_feature 1..20: note = CRISPR gRNA sequence
  source 1..20: mol_type = other DNA
tgttgctggggtgacagaaa

SEQ ID NO: 10435 - DNA, 20 bp, synthetic construct
  misc_feature 1..20: note = CRISPR gRNA sequence
  source 1..20: mol_type = other DNA
ttgctggggtgacagaaatg

SEQ ID NO: 10436 - DNA, 20 bp, synthetic construct
  misc_feature 1..20: note = CRISPR gRNA sequence
  source 1..20: mol_type = other DNA
gggtgacagaaatggagacc

SEQ ID NO: 10437 - DNA, 20 bp, synthetic construct
  misc_feature 1..20: note = CRISPR gRNA sequence
  source 1..20: mol_type = other DNA
ggtgacagaaatggagacct

SEQ ID NO: 10438 - DNA, 20 bp, synthetic construct
  misc_feature 1..20: note = CRISPR gRNA sequence
  source 1..20: mol_type = other DNA
acagaaatggagacctaggc

SEQ ID NO: 10439 - DNA, 20 bp, synthetic construct
  misc_feature 1..20: note = CRISPR gRNA sequence
  source 1..20: mol_type = other DNA
cagaaatggagacctaggca

SEQ ID NO: 10440 - DNA, 20 bp, synthetic construct
  misc_feature 1..20: note = CRISPR gRNA sequence
  source 1..20: mol_type = other DNA
tggagacctaggcaaggctc

SEQ ID NO: 10441 - DNA, 20 bp, synthetic construct
  misc_feature 1..20: note = CRISPR gRNA sequence
  source 1..20: mol_type = other DNA
ggagacctaggcaaggctct

SEQ ID NO: 10442 - DNA, 20 bp, synthetic construct
  misc_feature 1..20: note = CRISPR gRNA sequence
  source 1..20: mol_type = other DNA
gagacctaggcaaggctcta

SEQ ID NO: 10443 - DNA, 20 bp, synthetic construct
  misc_feature 1..20: note = CRISPR gRNA sequence
  source 1..20: mol_type = other DNA
gacctaggcaaggctctagg

SEQ ID NO: 10444 - DNA, 20 bp, synthetic construct
  misc_feature 1..20: note = CRISPR gRNA sequence
  source 1..20: mol_type = other DNA
aggcaaggctctagggagtc

SEQ ID NO: 10445 - DNA, 20 bp, synthetic construct
  misc_feature 1..20: note = CRISPR gRNA sequence
  source 1..20: mol_type = other DNA
ctagggagtccagttgtgtc

SEQ ID NO: 10446 - DNA, 20 bp, synthetic construct
  misc_feature 1..20: note = CRISPR gRNA sequence
  source 1..20: mol_type = other DNA
tagggagtccagttgtgtct

SEQ ID NO: 10447 - DNA, 20 bp, synthetic construct
  misc_feature 1..20: note = CRISPR gRNA sequence
  source 1..20: mol_type = other DNA
ccagttgtgtctgggtcact

SEQ ID NO: 10448 - DNA, 20 bp, synthetic construct
  misc_feature 1..20: note = CRISPR gRNA sequence
  source 1..20: mol_type = other DNA
cagttgtgtctgggtcactg

SEQ ID NO: 10449 - DNA, 20 bp, synthetic construct
  misc_feature 1..20: note = CRISPR gRNA sequence
  source 1..20: mol_type = other DNA
gttgtgtctgggtcactgag

SEQ ID NO: 10450 - DNA, 20 bp, synthetic construct
  misc_feature 1..20: note = CRISPR gRNA sequence
  source 1..20: mol_type = other DNA
ttgtgtctgggtcactgagg

SEQ ID NO: 10451 - DNA, 20 bp, synthetic construct
  misc_feature 1..20: note = CRISPR gRNA sequence
  source 1..20: mol_type = other DNA
tgtgtctgggtcactgagga

SEQ ID NO: 10452 - DNA, 20 bp, synthetic construct
  misc_feature 1..20: note = CRISPR gRNA sequence
  source 1..20: mol_type = other DNA
gtgtctgggtcactgaggag

SEQ ID NO: 10453 - DNA, 20 bp, synthetic construct
  misc_feature 1..20: note = CRISPR gRNA sequence
  source 1..20: mol_type = other DNA
tctgggtcactgaggagggg

SEQ ID NO: 10454 - DNA, 20 bp, synthetic construct
  misc_feature 1..20: note = CRISPR gRNA sequence
  source 1..20: mol_type = other DNA
gaggggcagcccaccataca

SEQ ID NO: 10455 - DNA, 20 bp, synthetic construct
  misc_feature 1..20: note = CRISPR gRNA sequence
  source 1..20: mol_type = other DNA
aggggcagcccaccatacat

SEQ ID NO: 10456 - DNA, 20 bp, synthetic construct
  misc_feature 1..20: note = CRISPR gRNA sequence
  source 1..20: mol_type = other DNA
gcccaccatacatgggcccc

SEQ ID NO: 10457 - DNA, 20 bp, synthetic construct
  misc_feature 1..20: note = CRISPR gRNA sequence
  source 1..20: mol_type = other DNA
accatacatgggccccaaga

SEQ ID NO: 10458 - DNA, 20 bp, synthetic construct
  misc_feature 1..20: note = CRISPR gRNA sequence
  source 1..20: mol_type = other DNA
agcacaataattattatatt

SEQ ID NO: 10459 - DNA, 20 bp, synthetic construct
  misc_feature 1..20: note = CRISPR gRNA sequence
  source 1..20: mol_type = other DNA
attattatatttagatctgt

SEQ ID NO: 10460 - DNA, 20 bp, synthetic construct
  misc_feature 1..20: note = CRISPR gRNA sequence
  source 1..20: mol_type = other DNA
tatttagatctgtcagaata

SEQ ID NO: 10461 - DNA, 20 bp, synthetic construct
  misc_feature 1..20: note = CRISPR gRNA sequence
  source 1..20: mol_type = other DNA
ttccttttcttttctttctt

SEQ ID NO: 10462 - DNA, 20 bp, synthetic construct
  misc_feature 1..20: note = CRISPR gRNA sequence
  source 1..20: mol_type = other DNA
tccttttcttttctttcttg

SEQ ID NO: 10463 - DNA, 20 bp, synthetic construct
  misc_feature 1..20: note = CRISPR gRNA sequence
  source 1..20: mol_type = other DNA
ttttcttttctttcttgagg

SEQ ID NO: 10464 - DNA, 20 bp, synthetic construct
  misc_feature 1..20: note = CRISPR gRNA sequence
  source 1..20: mol_type = other DNA
ttcttttctttcttgaggca

SEQ ID NO: 10465 - DNA, 20 bp, synthetic construct
  misc_feature 1..20: note = CRISPR gRNA sequence
  source 1..20: mol_type = other DNA
cagagtcttactctgtccct

SEQ ID NO: 10466 - DNA, 20 bp, synthetic construct
  misc_feature 1..20: note = CRISPR gRNA sequence
  source 1..20: mol_type = other DNA
agagtcttactctgtccctc

SEQ ID NO: 10467 - DNA, 20 bp, synthetic construct
  misc_feature 1..20: note = CRISPR gRNA sequence
  source 1..20: mol_type = other DNA
tcttactctgtccctcaggc

SEQ ID NO: 10468 - DNA, 20 bp, synthetic construct
  misc_feature 1..20: note = CRISPR gRNA sequence
  source 1..20: mol_type = other DNA
ttactctgtccctcaggctg

SEQ ID NO: 10469 - DNA, 20 bp, synthetic construct
  misc_feature 1..20: note = CRISPR gRNA sequence
  source 1..20: mol_type = other DNA
ctgtccctcaggctggagtt

SEQ ID NO: 10470 - DNA, 20 bp, synthetic construct
  misc_feature 1..20: note = CRISPR gRNA sequence
  source 1..20: mol_type = other DNA
tccctcaggctggagttcag

SEQ ID NO: 10471 - DNA, 20 bp, synthetic construct
  misc_feature 1..20: note = CRISPR gRNA sequence
  source 1..20: mol_type = other DNA
ggagttcagtggcacaatca

SEQ ID NO: 10472 - DNA, 20 bp, synthetic construct
  misc_feature 1..20: note = CRISPR gRNA sequence
  source 1..20: mol_type = other DNA
ggcacaatcacagctcacca

SEQ ID NO: 10473 - DNA, 20 bp, synthetic construct
  misc_feature 1..20: note = CRISPR gRNA sequence
  source 1..20: mol_type = other DNA
caccacagcctcaacctccc

SEQ ID NO: 10474 - DNA, 20 bp, synthetic construct
  misc_feature 1..20: note = CRISPR gRNA sequence
  source 1..20: mol_type = other DNA
accacagcctcaacctccct

SEQ ID NO: 10475 - DNA, 20 bp, synthetic construct
  misc_feature 1..20: note = CRISPR gRNA sequence
  source 1..20: mol_type = other DNA
gcctcaacctccctaggctc

SEQ ID NO: 10476 - DNA, 20 bp, synthetic construct
  misc_feature 1..20: note = CRISPR gRNA sequence
  source 1..20: mol_type = other DNA
ctcaagtgatcctcccacct

SEQ ID NO: 10477 - DNA, 20 bp, synthetic construct
  misc_feature 1..20: note = CRISPR gRNA sequence
  source 1..20: mol_type = other DNA
tcctcccacctcagcctccc

SEQ ID NO: 10478 - DNA, 20 bp, synthetic construct
  misc_feature 1..20: note = CRISPR gRNA sequence
  source 1..20: mol_type = other DNA
tcccacctcagcctccctag

SEQ ID NO: 10479 - DNA, 20 bp, synthetic construct
  misc_feature 1..20: note = CRISPR gRNA sequence
  source 1..20: mol_type = other DNA
acctcagcctccctagtagc

SEQ ID NO: 10480 - DNA, 20 bp, synthetic construct
  misc_feature 1..20: note = CRISPR gRNA sequence
  source 1..20: mol_type = other DNA
cctcagcctccctagtagct

SEQ ID NO: 10481 - DNA, 20 bp, synthetic construct
  misc_feature 1..20: note = CRISPR gRNA sequence
  source 1..20: mol_type = other DNA
ctccctagtagctgggacta

SEQ ID NO: 10482 - DNA, 20 bp, synthetic construct
  misc_feature 1..20: note = CRISPR gRNA sequence
  source 1..20: mol_type = other DNA
tccctagtagctgggactac

SEQ ID NO: 10483 - DNA, 20 bp, synthetic construct
  misc_feature 1..20: note = CRISPR gRNA sequence
  source 1..20: mol_type = other DNA
actaatttttgtattttttg

SEQ ID NO: 10484 - DNA, 20 bp, synthetic construct
  misc_feature 1..20: note = CRISPR gRNA sequence
  source 1..20: mol_type = other DNA
taatttttgtattttttgta

SEQ ID NO: 10485 - DNA, 20 bp, synthetic construct
  misc_feature 1..20: note = CRISPR gRNA sequence
  source 1..20: mol_type = other DNA
ttttgtattttttgtagaga

SEQ ID NO: 10486 - DNA, 20 bp, synthetic construct
  misc_feature 1..20: note = CRISPR gRNA sequence
  source 1..20: mol_type = other DNA
tttgtattttttgtagagac

SEQ ID NO: 10487 - DNA, 20 bp, synthetic construct
  misc_feature 1..20: note = CRISPR gRNA sequence
  source 1..20: mol_type = other DNA
caggatttcaccatgttgcc

SEQ ID NO: 10488 - DNA, 20 bp, synthetic construct
  misc_feature 1..20: note = CRISPR gRNA sequence
  source 1..20: mol_type = other DNA
tttcaccatgttgcccagtc

SEQ ID NO: 10489 - DNA, 20 bp, synthetic construct
  misc_feature 1..20: note = CRISPR gRNA sequence
  source 1..20: mol_type = other DNA
atgttgcccagtctggtctc

SEQ ID NO: 10490 - DNA, 20 bp, synthetic construct
  misc_feature 1..20: note = CRISPR gRNA sequence
  source 1..20: mol_type = other DNA
ccagtctggtctcgagctcc

SEQ ID NO: 10491 - DNA, 20 bp, synthetic construct
  misc_feature 1..20: note = CRISPR gRNA sequence
  source 1..20: mol_type = other DNA
cagtctggtctcgagctcct

SEQ ID NO: 10492 - DNA, 20 bp, synthetic construct
  misc_feature 1..20: note = CRISPR gRNA sequence
  source 1..20: mol_type = other DNA
ggtctcgagctcctgggctc

SEQ ID NO: 10493 - DNA, 20 bp, synthetic construct
  misc_feature 1..20: note = CRISPR gRNA sequence
  source 1..20: mol_type = other DNA
ctcaagcaatcctcccacct

SEQ ID NO: 10494 - DNA, 20 bp, synthetic construct
  misc_feature 1..20: note = CRISPR gRNA sequence
  source 1..20: mol_type = other DNA
cctcccacctcagcctccca

SEQ ID NO: 10495 - DNA, 20 bp, synthetic construct
  misc_feature 1..20: note = CRISPR gRNA sequence
  source 1..20: mol_type = other DNA
acctcagcctcccaaagtgc

SEQ ID NO: 10496 - DNA, 20 bp, synthetic construct
  misc_feature 1..20: note = CRISPR gRNA sequence
  source 1..20: mol_type = other DNA
cctcagcctcccaaagtgct

SEQ ID NO: 10497 - DNA, 20 bp, synthetic construct
  misc_feature 1..20: note = CRISPR gRNA sequence
  source 1..20: mol_type = other DNA
ctcccaaagtgctaggatta

SEQ ID NO: 10498 - DNA, 20 bp, synthetic construct
  misc_feature 1..20: note = CRISPR gRNA sequence
  source 1..20: mol_type = other DNA
tcccaaagtgctaggattac

SEQ ID NO: 10499 - DNA, 20 bp, synthetic construct
  misc_feature 1..20: note = CRISPR gRNA sequence
  source 1..20: mol_type = other DNA
agtgctaggattacaggtgc

SEQ ID NO: 10500 - DNA, 20 bp, synthetic construct
  misc_feature 1..20: note = CRISPR gRNA sequence
  source 1..20: mol_type = other DNA
caggtgcgagctcccgcacc

SEQ ID NO: 10501 - DNA, 20 bp, synthetic construct
  misc_feature 1..20: note = CRISPR gRNA sequence
  source 1..20: mol_type = other DNA
tgcgagctcccgcacctggc

SEQ ID NO: 10502 - DNA, 20 bp, synthetic construct
  misc_feature 1..20: note = CRISPR gRNA sequence
  source 1..20: mol_type = other DNA
gctcccgcacctggccagaa

SEQ ID NO: 10503 - DNA, 20 bp, synthetic construct
  misc_feature 1..20: note = CRISPR gRNA sequence
  source 1..20: mol_type = other DNA
ctcccgcacctggccagaac

SEQ ID NO: 10504 - DNA, 20 bp, synthetic construct
  misc_feature 1..20: note = CRISPR gRNA sequence
  source 1..20: mol_type = other DNA
agaacaggcttttaaatttg

SEQ ID NO: 10505 - DNA, 20 bp, synthetic construct
  misc_feature 1..20: note = CRISPR gRNA sequence
  source 1..20: mol_type = other DNA
accttccatctcaattatct

SEQ ID NO: 10506 - DNA, 20 bp, synthetic construct
  misc_feature 1..20: note = CRISPR gRNA sequence
  source 1..20: mol_type = other DNA
ccttccatctcaattatctc

SEQ ID NO: 10507 - DNA, 20 bp, synthetic construct
  misc_feature 1..20: note = CRISPR gRNA sequence
  source 1..20: mol_type = other DNA
tctcaggccaccctcctcta

SEQ ID NO: 10508 - DNA, 20 bp, synthetic construct
  misc_feature 1..20: note = CRISPR gRNA sequence
  source 1..20: mol_type = other DNA
ctcaggccaccctcctctac

SEQ ID NO: 10509 - DNA, 20 bp, synthetic construct
  misc_feature 1..20: note = CRISPR gRNA sequence
  source 1..20: mol_type = other DNA
tcatctccccattgtacaaa

SEQ ID NO: 10510 - DNA, 20 bp, synthetic construct
  misc_feature 1..20: note = CRISPR gRNA sequence
  source 1..20: mol_type = other DNA
attgtacaaatggcaatgct

SEQ ID NO: 10511 - DNA, 20 bp, synthetic construct
  misc_feature 1..20: note = CRISPR gRNA sequence
  source 1..20: mol_type = other DNA
caaatggcaatgctgagaac

SEQ ID NO: 10512 - DNA, 20 bp, synthetic construct
  misc_feature 1..20: note = CRISPR gRNA sequence
  source 1..20: mol_type = other DNA
aatggcaatgctgagaacaa

SEQ ID NO: 10513 - DNA, 20 bp, synthetic construct
  misc_feature 1..20: note = CRISPR gRNA sequence
  source 1..20: mol_type = other DNA
gactttaaattgtttatcca

SEQ ID NO: 10514 - DNA, 20 bp, synthetic construct
  misc_feature 1..20: note = CRISPR gRNA sequence
  source 1..20: mol_type = other DNA
attgtttatccaaagtcata

SEQ ID NO: 10515 - DNA, 20 bp, synthetic construct
  misc_feature 1..20: note = CRISPR gRNA sequence
  source 1..20: mol_type = other DNA
ttgtttatccaaagtcataa

SEQ ID NO: 10516 - DNA, 20 bp, synthetic construct
  misc_feature 1..20: note = CRISPR gRNA sequence
  source 1..20: mol_type = other DNA
ttatccaaagtcataaaggt

SEQ ID NO: 10517 - DNA, 20 bp, synthetic construct
  misc_feature 1..20: note = CRISPR gRNA sequence
  source 1..20: mol_type = other DNA
tatccaaagtcataaaggtc

SEQ ID NO: 10518 - DNA, 20 bp, synthetic construct
  misc_feature 1..20: note = CRISPR gRNA sequence
  source 1..20: mol_type = other DNA
caaagtcataaaggtcaggt

SEQ ID NO: 10519 - DNA, 20 bp, synthetic construct
  misc_feature 1..20: note = CRISPR gRNA sequence
  source 1..20: mol_type = other DNA
tcataaaggtcaggtcagcc

SEQ ID NO: 10520 - DNA, 20 bp, synthetic construct
  misc_feature 1..20: note = CRISPR gRNA sequence
  source 1..20: mol_type = other DNA
ggtcaggtcagcctggccct

SEQ ID NO: 10521 - DNA, 20 bp, synthetic construct
  misc_feature 1..20: note = CRISPR gRNA sequence
  source 1..20: mol_type = other DNA
ctggccctaagctccttcca

SEQ ID NO: 10522 - DNA, 20 bp, synthetic construct
  misc_feature 1..20: note = CRISPR gRNA sequence
  source 1..20: mol_type = other DNA
ctaagctccttccacagaaa

SEQ ID NO: 10523 - DNA, 20 bp, synthetic construct
  misc_feature 1..20: note = CRISPR gRNA sequence
  source 1..20: mol_type = other DNA
ctaaatgaatgtttgttcct

SEQ ID NO: 10524 - DNA, 20 bp, synthetic construct
  misc_feature 1..20: note = CRISPR gRNA sequence
  source 1..20: mol_type = other DNA
aatgaatgtttgttccttgg

SEQ ID NO: 10525 - DNA, 20 bp, synthetic construct
  misc_feature 1..20: note = CRISPR gRNA sequence
  source 1..20: mol_type = other DNA
atgaatgtttgttccttggt

SEQ ID NO: 10526 - DNA, 20 bp, synthetic construct
  misc_feature 1..20: note = CRISPR gRNA sequence
  source 1..20: mol_type = other DNA
tgaatgtttgttccttggta

SEQ ID NO: 10527 - DNA, 20 bp, synthetic construct
  misc_feature 1..20: note = CRISPR gRNA sequence
  source 1..20: mol_type = other DNA
gaatgtttgttccttggtag

SEQ ID NO: 10528 - DNA, 20 bp, synthetic construct
  misc_feature 1..20: note = CRISPR gRNA sequence
  source 1..20: mol_type = other DNA
tttgttccttggtaggggtc

SEQ ID NO: 10529 - DNA, 20 bp, synthetic construct
  misc_feature 1..20: note = CRISPR gRNA sequence
  source 1..20: mol_type = other DNA
ggtctagatcatctaatgat

SEQ ID NO: 10530 - DNA, 20 bp, synthetic construct
  misc_feature 1..20: note = CRISPR gRNA sequence
  source 1..20: mol_type = other DNA
gtctagatcatctaatgatt

SEQ ID NO: 10531 - DNA, 20 bp, synthetic construct
  misc_feature 1..20: note = CRISPR gRNA sequence
  source 1..20: mol_type = other DNA
tagatcatctaatgattagg

SEQ ID NO: 10532 - DNA, 20 bp, synthetic construct
  misc_feature 1..20: note = CRISPR gRNA sequence
  source 1..20: mol_type = other DNA
agatcatctaatgattagga

SEQ ID NO: 10533 - DNA, 20 bp, synthetic construct
  misc_feature 1..20: note = CRISPR gRNA sequence
  source 1..20: mol_type = other DNA
atcatctaatgattaggaag

SEQ ID NO: 10534 - DNA, 20 bp, synthetic construct
  misc_feature 1..20: note = CRISPR gRNA sequence
  source 1..20: mol_type = other DNA
ggaaggagttgttatgcctg

SEQ ID NO: 10535 - DNA, 20 bp, synthetic construct
  misc_feature 1..20: note = CRISPR gRNA sequence
  source 1..20: mol_type = other DNA
tgttatgcctgtggtatatt

SEQ ID NO: 10536 - DNA, 20 bp, synthetic construct
  misc_feature 1..20: note = CRISPR gRNA sequence
  source 1..20: mol_type = other DNA
tattcggtgctgtttttttt

SEQ ID NO: 10537 - DNA, 20 bp, synthetic construct
  misc_feature 1..20: note = CRISPR gRNA sequence
  source 1..20: mol_type = other DNA
ttcggtgctgtttttttttg

SEQ ID NO: 10538 - DNA, 20 bp, synthetic construct
  misc_feature 1..20: note = CRISPR gRNA sequence
  source 1..20: mol_type = other DNA
gtgctgtttttttttggaga

SEQ ID NO: 10539 - DNA, 20 bp, synthetic construct
  misc_feature 1..20: note = CRISPR gRNA sequence
  source 1..20: mol_type = other DNA
tgctgtttttttttggagat

SEQ ID NO: 10540 - DNA, 20 bp, synthetic construct
  misc_feature 1..20: note = CRISPR gRNA sequence
  source 1..20: mol_type = other DNA
gctgtttttttttggagatg

SEQ ID NO: 10541 - DNA, 20 bp, synthetic construct
  misc_feature 1..20: note = CRISPR gRNA sequence
  source 1..20: mol_type = other DNA
tggggtcttgctctgtcacc

SEQ ID NO: 10542 - DNA, 20 bp, synthetic construct
  misc_feature 1..20: note = CRISPR gRNA sequence
  source 1..20: mol_type = other DNA
ggggtcttgctctgtcaccc

SEQ ID NO: 10543 - DNA, 20 bp, synthetic construct
  misc_feature 1..20: note = CRISPR gRNA sequence
  source 1..20: mol_type = other DNA
tcttgctctgtcacccaggc

SEQ ID NO: 10544 - DNA, 20 bp, synthetic construct
  misc_feature 1..20: note = CRISPR gRNA sequence
  source 1..20: mol_type = other DNA
ctgtcacccaggctagaatg

SEQ ID NO: 10545 - DNA, 20 bp, synthetic construct
  misc_feature 1..20: note = CRISPR gRNA sequence
  source 1..20: mol_type = other DNA
tcacccaggctagaatgcag

SEQ ID NO: 10546 - DNA, 20 bp, synthetic construct
  misc_feature 1..20: note = CRISPR gRNA sequence
  source 1..20: mol_type = other DNA
agaatgcagtggtatgatct

SEQ ID NO: 10547 - DNA, 20 bp, synthetic construct
  misc_feature 1..20: note = CRISPR gRNA sequence
  source 1..20: mol_type = other DNA
tcactgcaatctccacctct

SEQ ID NO: 10548 - DNA, 20 bp, synthetic construct
  misc_feature 1..20: note = CRISPR gRNA sequence
  source 1..20: mol_type = other DNA
caatctccacctctcggttc

SEQ ID NO: 10549 - DNA, 20 bp, synthetic construct
  misc_feature 1..20: note = CRISPR gRNA sequence
  source 1..20: mol_type = other DNA
ttcaagcaattttcctgcct

SEQ ID NO: 10550 - DNA, 20 bp, synthetic construct
  misc_feature 1..20: note = CRISPR gRNA sequence
  source 1..20: mol_type = other DNA
ttttcctgcctcagcctccc

SEQ ID NO: 10551 - DNA, 20 bp, synthetic construct
  misc_feature 1..20: note = CRISPR gRNA sequence
  source 1..20: mol_type = other DNA
tcctgcctcagcctcccgag

SEQ ID NO: 10552 - DNA, 20 bp, synthetic construct
  misc_feature 1..20: note = CRISPR gRNA sequence
  source 1..20: mol_type = other DNA
gcctcagcctcccgagtagc

SEQ ID NO: 10553 - DNA, 20 bp, synthetic construct
  misc_feature 1..20: note = CRISPR gRNA sequence
  source 1..20: mol_type = other DNA
cctcagcctcccgagtagct

SEQ ID NO: 10554 - DNA, 20 bp, synthetic construct
  misc_feature 1..20: note = CRISPR gRNA sequence
  source 1..20: mol_type = other DNA
ctcccgagtagctgggatta

SEQ ID NO: 10555 - DNA, 20 bp, synthetic construct
  misc_feature 1..20: note = CRISPR gRNA sequence
  source 1..20: mol_type = other DNA
tcccgagtagctgggattac

SEQ ID NO: 10556 - DNA, 20 bp, synthetic construct
  misc_feature 1..20: note = CRISPR gRNA sequence
  source 1..20: mol_type = other DNA
caggtgtacaccactacacc

SEQ ID NO: 10557 - DNA, 20 bp, synthetic construct
  misc_feature 1..20: note = CRISPR gRNA sequence
  source 1..20: mol_type = other DNA
ctggctaatttttgtatttt

SEQ ID NO: 10558 - DNA, 20 bp, synthetic construct
  misc_feature 1..20: note = CRISPR gRNA sequence
  source 1..20: mol_type = other DNA
gctaatttttgtatttttag

SEQ ID NO: 10559 - DNA, 20 bp, synthetic construct
  misc_feature 1..20: note = CRISPR gRNA sequence
  source 1..20: mol_type = other DNA
taatttttgtatttttagta

SEQ ID NO: 10560 - DNA, 20 bp, synthetic construct
  misc_feature 1..20: note = CRISPR gRNA sequence
  source 1..20: mol_type = other DNA
ttttgtatttttagtagaga

SEQ ID NO: 10561 - DNA, 20 bp, synthetic construct
  misc_feature 1..20: note = CRISPR gRNA sequence
  source 1..20: mol_type = other DNA
tttgtatttttagtagagac

SEQ ID NO: 10562 - DNA, 20 bp, synthetic construct
  misc_feature 1..20: note = CRISPR gRNA sequence
  source 1..20: mol_type = other DNA
gagacgggctttaaccatgt

SEQ ID NO: 10563 - DNA, 20 bp, synthetic construct
  misc_feature 1..20: note = CRISPR gRNA sequence
  source 1..20: mol_type = other DNA
cgggctttaaccatgttggc

SEQ ID NO: 10564 - DNA, 20 bp, synthetic construct
  misc_feature 1..20: note = CRISPR gRNA sequence
  source 1..20: mol_type = other DNA
gggctttaaccatgttggcc

SEQ ID NO: 10565 - DNA, 20 bp, synthetic construct
  misc_feature 1..20: note = CRISPR gRNA sequence
  source 1..20: mol_type = other DNA
tttaaccatgttggccaggc

SEQ ID NO: 10566 - DNA, 20 bp, synthetic construct
  misc_feature 1..20: note = CRISPR gRNA sequence
  source 1..20: mol_type = other DNA
ccaggctggtcttgaactcc

SEQ ID NO: 10567 - DNA, 20 bp, synthetic construct
  misc_feature 1..20: note = CRISPR gRNA sequence
  source 1..20: mol_type = other DNA
tggtcttgaactcctggcct

SEQ ID NO: 10568 - DNA, 20 bp, synthetic construct
  misc_feature 1..20: note = CRISPR gRNA sequence
  source 1..20: mol_type = other DNA
ctcagatgttcctcccacct

SEQ ID NO: 10569 - DNA, 20 bp, synthetic construct
  misc_feature 1..20: note = CRISPR gRNA sequence
  source 1..20: mol_type = other DNA
cctcccacctcagcctccca

SEQ ID NO: 10570 - DNA, 20 bp, synthetic construct
  misc_feature 1..20: note = CRISPR gRNA sequence
  source 1..20: mol_type = other DNA
acctcagcctcccaaagtgc

SEQ ID NO: 10571 - DNA, 20 bp, synthetic construct
  misc_feature 1..20: note = CRISPR gRNA sequence
  source 1..20: mol_type = other DNA
cctcagcctcccaaagtgct

SEQ ID NO: 10572 - DNA, 20 bp, synthetic construct
  misc_feature 1..20: note = CRISPR gRNA sequence
  source 1..20: mol_type = other DNA
ctcccaaagtgctgggatta

SEQ ID NO: 10573 - DNA, 20 bp, synthetic construct
  misc_feature 1..20: note = CRISPR gRNA sequence
  source 1..20: mol_type = other DNA
tcccaaagtgctgggattac

SEQ ID NO: 10574 - DNA, 20 bp, synthetic construct
  misc_feature 1..20: note = CRISPR gRNA sequence
  source 1..20: mol_type = other DNA
agtgctgggattacaggtgt

SEQ ID NO: 10575 - DNA, 20 bp, synthetic construct
  misc_feature 1..20: note = CRISPR gRNA sequence
  source 1..20: mol_type = other DNA
caggtgtaagccaccatgcc

SEQ ID NO: 10576 - DNA, 20 bp, synthetic construct
  misc_feature 1..20: note = CRISPR gRNA sequence
  source 1..20: mol_type = other DNA
accatgcccagcttataatt

SEQ ID NO: 10577 - DNA, 20 bp, synthetic construct
  misc_feature 1..20: note = CRISPR gRNA sequence
  source 1..20: mol_type = other DNA
tatataatctcattaatctc

SEQ ID NO: 10578 - DNA, 20 bp, synthetic construct
  misc_feature 1..20: note = CRISPR gRNA sequence
  source 1..20: mol_type = other DNA
tataatctcattaatctcaa

SEQ ID NO: 10579 - DNA, 20 bp, synthetic construct
  misc_feature 1..20: note = CRISPR gRNA sequence
  source 1..20: mol_type = other DNA
attaatctcaagagctactg

SEQ ID NO: 10580 - DNA, 20 bp, synthetic construct
  misc_feature 1..20: note = CRISPR gRNA sequence
  source 1..20: mol_type = other DNA
aatctcaagagctactgtgg

SEQ ID NO: 10581 - DNA, 20 bp, synthetic construct
  misc_feature 1..20: note = CRISPR gRNA sequence
  source 1..20: mol_type = other DNA
tcaagagctactgtggaaga

SEQ ID NO: 10582 - DNA, 20 bp, synthetic construct
  misc_feature 1..20: note = CRISPR gRNA sequence
  source 1..20: mol_type = other DNA
gagctactgtggaagacaga

SEQ ID NO: 10583 - DNA, 20 bp, synthetic construct
  misc_feature 1..20: note = CRISPR gRNA sequence
  source 1..20: mol_type = other DNA
tcatcatcttccccatttta

SEQ ID NO: 10584 - DNA, 20 bp, synthetic construct
  misc_feature 1..20: note = CRISPR gRNA sequence
  source 1..20: mol_type = other DNA
atcttccccattttacagat

SEQ ID NO: 10585 - DNA, 20 bp, synthetic construct
  misc_feature 1..20: note = CRISPR gRNA sequence
  source 1..20: mol_type = other DNA
tcttccccattttacagatg

SEQ ID NO: 10586 - DNA, 20 bp, synthetic construct
  misc_feature 1..20: note = CRISPR gRNA sequence
  source 1..20: mol_type = other DNA
ttccccattttacagatgag

SEQ ID NO: 10587 - DNA, 20 bp, synthetic construct
  misc_feature 1..20: note = CRISPR gRNA sequence
  source 1..20: mol_type = other DNA
ccattttacagatgaggaga

SEQ ID NO: 10588 - DNA, 20 bp, synthetic construct
  misc_feature 1..20: note = CRISPR gRNA sequence
  source 1..20: mol_type = other DNA
attttacagatgaggagacg

SEQ ID NO: 10589 - DNA, 20 bp, synthetic construct
  misc_feature 1..20: note = CRISPR gRNA sequence
  source 1..20: mol_type = other DNA
ttttacagatgaggagacgg

SEQ ID NO: 10590 - DNA, 20 bp, synthetic construct
  misc_feature 1..20: note = CRISPR gRNA sequence
  source 1..20: mol_type = other DNA
cagatgaggagacggaggcc

SEQ ID NO: 10591 - DNA, 20 bp, synthetic construct
  misc_feature 1..20: note = CRISPR gRNA sequence
  source 1..20: mol_type = other DNA
tgaggagacggaggcctggt

SEQ ID NO: 10592 - DNA, 20 bp, synthetic construct
  misc_feature 1..20: note = CRISPR gRNA sequence
  source 1..20: mol_type = other DNA
gaggagacggaggcctggtg

SEQ ID NO: 10593 - DNA, 20 bp, synthetic construct
  misc_feature 1..20: note = CRISPR gRNA sequence
  source 1..20: mol_type = other DNA
gacggaggcctggtgaggtt

SEQ ID NO: 10594 - DNA, 20 bp, synthetic construct
  misc_feature 1..20: note = CRISPR gRNA sequence
  source 1..20: mol_type = other DNA
gaggttaagtgacttgcccg

SEQ ID NO: 10595 - DNA, 20 bp, synthetic construct
  misc_feature 1..20: note = CRISPR gRNA sequence
  source 1..20: mol_type = other DNA
gtgacttgcccgtggtcccc

SEQ ID NO: 10596 - DNA, 20 bp, synthetic construct
  misc_feature 1..20: note = CRISPR gRNA sequence
  source 1..20: mol_type = other DNA
cttgcccgtggtcccccagc

SEQ ID NO: 10597 - DNA, 20 bp, synthetic construct
  misc_feature 1..20: note = CRISPR gRNA sequence
  source 1..20: mol_type = other DNA
tcccccagctggtcacccac

SEQ ID NO: 10598 - DNA, 20 bp, synthetic construct
  misc_feature 1..20: note = CRISPR gRNA sequence
  source 1..20: mol_type = other DNA
gctggtcacccacaagctat

SEQ ID NO: 10599 - DNA, 20 bp, synthetic construct
  misc_feature 1..20: note = CRISPR gRNA sequence
  source 1..20: mol_type = other DNA
atcactgctcccctgtgccc

SEQ ID NO: 10600 - DNA, 20 bp, synthetic construct
  misc_feature 1..20: note = CRISPR gRNA sequence
  source 1..20: mol_type = other DNA
ctcccctgtgccccagaaaa

SEQ ID NO: 10601 - DNA, 20 bp, synthetic construct
  misc_feature 1..20: note = CRISPR gRNA sequence
  source 1..20: mol_type = other DNA
cctgtgccccagaaaaaagc

SEQ ID NO: 10602 - DNA, 20 bp, synthetic construct
  misc_feature 1..20: note = CRISPR gRNA sequence
  source 1..20: mol_type = other DNA
ccagtgtctcttgttttgaa

SEQ ID NO: 10603 - DNA, 20 bp, synthetic construct
  misc_feature 1..20: note = CRISPR gRNA sequence
  source 1..20: mol_type = other DNA
agtgtctcttgttttgaaca

SEQ ID NO: 10604 - DNA, 20 bp, synthetic construct
  misc_feature 1..20: note = CRISPR gRNA sequence
  source 1..20: mol_type = other DNA
ctcttgttttgaacagagac

SEQ ID NO: 10605 - DNA, 20 bp, synthetic construct
  misc_feature 1..20: note = CRISPR gRNA sequence
  source 1..20: mol_type = other DNA
tcttgttttgaacagagaca

SEQ ID NO: 10606 - DNA, 20 bp, synthetic construct
  misc_feature 1..20: note = CRISPR gRNA sequence
  source 1..20: mol_type = other DNA
gacaaggtgctaaatttgtc

SEQ ID NO: 10607 - DNA, 20 bp, synthetic construct
  misc_feature 1..20: note = CRISPR gRNA sequence
  source 1..20: mol_type = other DNA
caaggtgctaaatttgtcca

SEQ ID NO: 10608 - DNA, 20 bp, synthetic construct
  misc_feature 1..20: note = CRISPR gRNA sequence
  source 1..20: mol_type = other DNA
aaggtgctaaatttgtccag

SEQ ID NO: 10609 - DNA, 20 bp, synthetic construct
  misc_feature 1..20: note = CRISPR gRNA sequence
  source 1..20: mol_type = other DNA
gaggtaaaaatgatgctgaa

SEQ ID NO: 10610 - DNA, 20 bp, synthetic construct
  misc_feature 1..20: note = CRISPR gRNA sequence
  source 1..20: mol_type = other DNA
aggtaaaaatgatgctgaaa

SEQ ID NO: 10611 - DNA, 20 bp, synthetic construct
  misc_feature 1..20: note = CRISPR gRNA sequence
  source 1..20: mol_type = other DNA
ggtaaaaatgatgctgaaaa

SEQ ID NO: 10612 - DNA, 20 bp, synthetic construct
  misc_feature 1..20: note = CRISPR gRNA sequence
  source 1..20: mol_type = other DNA
gtaaaaatgatgctgaaaag

SEQ ID NO: 10613 - DNA, 20 bp, synthetic construct
  misc_feature 1..20: note = CRISPR gRNA sequence
  source 1..20: mol_type = other DNA
aatgtctgaaaacaataact

SEQ ID NO: 10614 - DNA, 20 bp, synthetic construct
  misc_feature 1..20: note = CRISPR gRNA sequence
  source 1..20: mol_type = other DNA
atgtctgaaaacaataactg

SEQ ID NO: 10615 - DNA, 20 bp, synthetic construct
  misc_feature 1..20: note = CRISPR gRNA sequence
  source 1..20: mol_type = other DNA
tgtctgaaaacaataactga

SEQ ID NO: 10616 - DNA, 20 bp, synthetic construct
  misc_feature 1..20: note = CRISPR gRNA sequence
  source 1..20: mol_type = other DNA
caataactgagggccctttc

SEQ ID NO: 10617 - DNA, 20 bp, synthetic construct
  misc_feature 1..20: note = CRISPR gRNA sequence
  source 1..20: mol_type = other DNA
ttctggccttaaattatttt

SEQ ID NO: 10618 - DNA, 20 bp, synthetic construct
  misc_feature 1..20: note = CRISPR gRNA sequence
  source 1..20: mol_type = other DNA
taaattattttcagctgaaa

SEQ ID NO: 10619 - DNA, 20 bp, synthetic construct
  misc_feature 1..20: note = CRISPR gRNA sequence
  source 1..20: mol_type = other DNA
ttttcagctgaaaaagcccc

SEQ ID NO: 10620 - DNA, 20 bp, synthetic construct
  misc_feature 1..20: note = CRISPR gRNA sequence
  source 1..20: mol_type = other DNA
gctgaaaaagcccctagttc

SEQ ID NO: 10621 - DNA, 20 bp, synthetic construct
  misc_feature 1..20: note = CRISPR gRNA sequence
  source 1..20: mol_type = other DNA
aaaagcccctagttcaagat

SEQ ID NO: 10622 - DNA, 20 bp, synthetic construct
  misc_feature 1..20: note = CRISPR gRNA sequence
  source 1..20: mol_type = other DNA
tcaagatcggaactgcgctc

SEQ ID NO: 10623 - DNA, 20 bp, synthetic construct
  misc_feature 1..20: note = CRISPR gRNA sequence
  source 1..20: mol_type = other DNA
caagatcggaactgcgctct

SEQ ID NO: 10624 - DNA, 20 bp, synthetic construct
  misc_feature 1..20: note = CRISPR gRNA sequence
  source 1..20: mol_type = other DNA
aagatcggaactgcgctctg

SEQ ID NO: 10625 - DNA, 20 bp, synthetic construct
  misc_feature 1..20: note = CRISPR gRNA sequence
  source 1..20: mol_type = other DNA
cggaactgcgctctggggaa

SEQ ID NO: 10626 - DNA, 20 bp, synthetic construct
  misc_feature 1..20: note = CRISPR gRNA sequence
  source 1..20: mol_type = other DNA
aactgcgctctggggaacag

SEQ ID NO: 10627 - DNA, 20 bp, synthetic construct
  misc_feature 1..20: note = CRISPR gRNA sequence
  source 1..20: mol_type = other DNA
gctctggggaacagcggcca

SEQ ID NO: 10628 - DNA, 20 bp, synthetic construct
  misc_feature 1..20: note = CRISPR gRNA sequence
  source 1..20: mol_type = other DNA
ctctggggaacagcggccat

SEQ ID NO: 10629 - DNA, 20 bp, synthetic construct
  misc_feature 1..20: note = CRISPR gRNA sequence
  source 1..20: mol_type = other DNA
tctggggaacagcggccatg

SEQ ID NO: 10630 - DNA, 20 bp, synthetic construct
  misc_feature 1..20: note = CRISPR gRNA sequence
  source 1..20: mol_type = other DNA
ggggaacagcggccatgggg

SEQ ID NO: 10631 - DNA, 20 bp, synthetic construct
  misc_feature 1..20: note = CRISPR gRNA sequence
  source 1..20: mol_type = other DNA
acagcggccatggggtggaa

SEQ ID NO: 10632 - DNA, 20 bp, synthetic construct
  misc_feature 1..20: note = CRISPR gRNA sequence
  source 1..20: mol_type = other DNA
ggccatggggtggaacagcc

SEQ ID NO: 10633 - DNA, 20 bp, synthetic construct
  misc_feature 1..20: note = CRISPR gRNA sequence
  source 1..20: mol_type = other DNA
ccatggggtggaacagccta

SEQ ID NO: 10634 - DNA, 20 bp, synthetic construct
  misc_feature 1..20: note = CRISPR gRNA sequence
  source 1..20: mol_type = other DNA
ggggtggaacagcctagagc

SEQ ID NO: 10635 - DNA, 20 bp, synthetic construct
  misc_feature 1..20: note = CRISPR gRNA sequence
  source 1..20: mol_type = other DNA
gggtggaacagcctagagcc

SEQ ID NO: 10636 - DNA, 20 bp, synthetic construct
  misc_feature 1..20: note = CRISPR gRNA sequence
  source 1..20: mol_type = other DNA
acagcctagagccgggtgat

SEQ ID NO: 10637 - DNA, 20 bp, synthetic construct
  misc_feature 1..20: note = CRISPR gRNA sequence
  source 1..20: mol_type = other DNA
gagccgggtgatcagccacc

SEQ ID NO: 10638 - DNA, 20 bp, synthetic construct
  misc_feature 1..20: note = CRISPR gRNA sequence
  source 1..20: mol_type = other DNA
gccgggtgatcagccacctg

SEQ ID NO: 10639 - DNA, 20 bp, synthetic construct
  misc_feature 1..20: note = CRISPR gRNA sequence
  source 1..20: mol_type = other DNA
gtgatcagccacctggagac

SEQ ID NO: 10640 - DNA, 20 bp, synthetic construct
  misc_feature 1..20: note = CRISPR gRNA sequence
  source 1..20: mol_type = other DNA
atcagccacctggagaccgg

SEQ ID NO: 10641 - DNA, 20 bp, synthetic construct
  misc_feature 1..20: note = CRISPR gRNA sequence
  source 1..20: mol_type = other DNA
cctggagaccggaagccccc

SEQ ID NO: 10642 - DNA, 20 bp, synthetic construct
  misc_feature 1..20: note = CRISPR gRNA sequence
  source 1..20: mol_type = other DNA
ctggagaccggaagcccccg

SEQ ID NO: 10643 - DNA, 20 bp, synthetic construct
  misc_feature 1..20: note = CRISPR gRNA sequence
  source 1..20: mol_type = other DNA
ggagaccggaagcccccgag

SEQ ID NO: 10644 - DNA, 20 bp, synthetic construct
  misc_feature 1..20: note = CRISPR gRNA sequence
  source 1..20: mol_type = other DNA
gagaccggaagcccccgagg

SEQ ID NO: 10645 - DNA, 20 bp, synthetic construct
  misc_feature 1..20: note = CRISPR gRNA sequence
  source 1..20: mol_type = other DNA
gaagcccccgaggaggttct

SEQ ID NO: 10646 - DNA, 20 bp, synthetic construct
  misc_feature 1..20: note = CRISPR gRNA sequence
  source 1..20: mol_type = other DNA
aagcccccgaggaggttctg

SEQ ID NO: 10647 - DNA, 20 bp, synthetic construct
  misc_feature 1..20: note = CRISPR gRNA sequence
  source 1..20: mol_type = other DNA
cccccgaggaggttctgagg

SEQ ID NO: 10648 - DNA, 20 bp, synthetic construct
  misc_feature 1..20: note = CRISPR gRNA sequence
  source 1..20: mol_type = other DNA
ccccgaggaggttctgagga

SEQ ID NO: 10649 - DNA, 20 bp, synthetic construct
  misc_feature 1..20: note = CRISPR gRNA sequence
  source 1..20: mol_type = other DNA
cgaggaggttctgaggaagg

SEQ ID NO: 10650 - DNA, 20 bp, synthetic construct
  misc_feature 1..20: note = CRISPR gRNA sequence
  source 1..20: mol_type = other DNA
gaggaggttctgaggaagga

SEQ ID NO: 10651 - DNA, 20 bp, synthetic construct
  misc_feature 1..20: note = CRISPR gRNA sequence
  source 1..20: mol_type = other DNA
gaggttctgaggaaggaagg

SEQ ID NO: 10652 - DNA, 20 bp, synthetic construct
  misc_feature 1..20: note = CRISPR gRNA sequence
  source 1..20: mol_type = other DNA
aggttctgaggaaggaagga

SEQ ID NO: 10653 - DNA, 20 bp, synthetic construct
  misc_feature 1..20: note = CRISPR gRNA sequence
  source 1..20: mol_type = other DNA
ttctgaggaaggaaggaagg

SEQ ID NO: 10654 - DNA, 20 bp, synthetic construct
  misc_feature 1..20: note = CRISPR gRNA sequence
  source 1..20: mol_type = other DNA
tctgaggaaggaaggaagga

SEQ ID NO: 10655 - DNA, 20 bp, synthetic construct
  misc_feature 1..20: note = CRISPR gRNA sequence
  source 1..20: mol_type = other DNA
ggaaggaaggaaggaaggaa

SEQ ID NO: 10656 - DNA, 20 bp, synthetic construct
  misc_feature 1..20: note = CRISPR gRNA sequence
  source 1..20: mol_type = other DNA
aggaaggaaaagactatttc

SEQ ID NO: 10657 - DNA, 20 bp, synthetic construct
  misc_feature 1..20: note = CRISPR gRNA sequence
  source 1..20: mol_type = other DNA
gactatttctggcattttct

SEQ ID NO: 10658 - DNA, 20 bp, synthetic construct
  misc_feature 1..20: note = CRISPR gRNA sequence
  source 1..20: mol_type = other DNA
actatttctggcattttctc

SEQ ID NO: 10659 - DNA, 20 bp, synthetic construct
  misc_feature 1..20: note = CRISPR gRNA sequence
  source 1..20: mol_type = other DNA
tctcaggcttctactgtgcc

SEQ ID NO: 10660 - DNA, 20 bp, synthetic construct
  misc_feature 1..20: note = CRISPR gRNA sequence
  source 1..20: mol_type = other DNA
ctcaggcttctactgtgccc

SEQ ID NO: 10661 - DNA, 20 bp, synthetic construct
  misc_feature 1..20: note = CRISPR gRNA sequence
  source 1..20: mol_type = other DNA
tactgtgcccaggcaccctg

SEQ ID NO: 10662 - DNA, 20 bp, synthetic construct
  misc_feature 1..20: note = CRISPR gRNA sequence
  source 1..20: mol_type = other DNA
acctcatctgtctgtcaaat

SEQ ID NO: 10663 - DNA, 20 bp, synthetic construct
  misc_feature 1..20: note = CRISPR gRNA sequence
  source 1..20: mol_type = other DNA
cctcatctgtctgtcaaatc

SEQ ID NO: 10664 - DNA, 20 bp, synthetic construct
  misc_feature 1..20: note = CRISPR gRNA sequence
  source 1..20: mol_type = other DNA
ctcatctgtctgtcaaatca

SEQ ID NO: 10665 - DNA, 20 bp, synthetic construct
  misc_feature 1..20: note = CRISPR gRNA sequence
  source 1..20: mol_type = other DNA
gtctgtcaaatcagggttct

SEQ ID NO: 10666 - DNA, 20 bp, synthetic construct
  misc_feature 1..20: note = CRISPR gRNA sequence
  source 1..20: mol_type = other DNA
cttagccactcacaacccta

SEQ ID NO: 10667 - DNA, 20 bp, synthetic construct
  misc_feature 1..20: note = CRISPR gRNA sequence
  source 1..20: mol_type = other DNA
ttagccactcacaaccctac

SEQ ID NO: 10668 - DNA, 20 bp, synthetic construct
  misc_feature 1..20: note = CRISPR gRNA sequence
  source 1..20: mol_type = other DNA
tagccactcacaaccctaca

SEQ ID NO: 10669 - DNA, 20 bp, synthetic construct
  misc_feature 1..20: note = CRISPR gRNA sequence
  source 1..20: mol_type = other DNA
acagggacttcgtttgtaca

SEQ ID NO: 10670 - DNA, 20 bp, synthetic construct
  misc_feature 1..20: note = CRISPR gRNA sequence
  source 1..20: mol_type = other DNA
agggacttcgtttgtacaca

SEQ ID NO: 10671 - DNA, 20 bp, synthetic construct
  misc_feature 1..20: note = CRISPR gRNA sequence
  source 1..20: mol_type = other DNA
ttgtacacagagtccttccc

SEQ ID NO: 10672 - DNA, 20 bp, synthetic construct
  misc_feature 1..20: note = CRISPR gRNA sequence
  source 1..20: mol_type = other DNA
cacagagtccttccccagtt

SEQ ID NO: 10673 - DNA, 20 bp, synthetic construct
  misc_feature 1..20: note = CRISPR gRNA sequence
  source 1..20: mol_type = other DNA
cccttatctcctacactcgc

SEQ ID NO: 10674 - DNA, 20 bp, synthetic construct
  misc_feature 1..20: note = CRISPR gRNA sequence
  source 1..20: mol_type = other DNA
ccttatctcctacactcgct

SEQ ID NO: 10675 - DNA, 20 bp, synthetic construct
  misc_feature 1..20: note = CRISPR gRNA sequence
  source 1..20: mol_type = other DNA
gctgggtgctctctccattc

SEQ ID NO: 10676 - DNA, 20 bp, synthetic construct
  misc_feature 1..20: note = CRISPR gRNA sequence
  source 1..20: mol_type = other DNA
tgctctctccattccagcca

SEQ ID NO: 10677 - DNA, 20 bp, synthetic construct
  misc_feature 1..20: note = CRISPR gRNA sequence
  source 1..20: mol_type = other DNA
gctctctccattccagccac

SEQ ID NO: 10678 - DNA, 20 bp, synthetic construct
  misc_feature 1..20: note = CRISPR gRNA sequence
  source 1..20: mol_type = other DNA
ctctctccattccagccaca

SEQ ID NO: 10679 - DNA, 20 bp, synthetic construct
  misc_feature 1..20: note = CRISPR gRNA sequence
  source 1..20: mol_type = other DNA
cagccacagggcctccttgc

SEQ ID NO: 10680 - DNA, 20 bp, synthetic construct
  misc_feature 1..20: note = CRISPR gRNA sequence
  source 1..20: mol_type = other DNA
cttgctggctttcaacctcc

SEQ ID NO: 10681 - DNA, 20 bp, synthetic construct
  misc_feature 1..20: note = CRISPR gRNA sequence
  source 1..20: mol_type = other DNA
ttgctggctttcaacctcct

SEQ ID NO: 10682 - DNA, 20 bp, synthetic construct
  misc_feature 1..20: note = CRISPR gRNA sequence
  source 1..20: mol_type = other DNA
cctaggcatgcttctgcctc

SEQ ID NO: 10683 - DNA, 20 bp, synthetic construct
  misc_feature 1..20: note = CRISPR gRNA sequence
  source 1..20: mol_type = other DNA
ctaggcatgcttctgcctcc

SEQ ID NO: 10684 - DNA, 20 bp, synthetic construct
  misc_feature 1..20: note = CRISPR gRNA sequence
  source 1..20: mol_type = other DNA
ctgcctccaggcctttgcac

SEQ ID NO: 10685 - DNA, 20 bp, synthetic construct
  misc_feature 1..20: note = CRISPR gRNA sequence
  source 1..20: mol_type = other DNA
caccggctgtgccctctgcc

SEQ ID NO: 10686 - DNA, 20 bp, synthetic construct
  misc_feature 1..20: note = CRISPR gRNA sequence
  source 1..20: mol_type = other DNA
ctgcctggaatacttctccc

SEQ ID NO: 10687 - DNA, 20 bp, synthetic construct
  misc_feature 1..20: note = CRISPR gRNA sequence
  source 1..20: mol_type = other DNA
cttctccccagatatctgca

SEQ ID NO: 10688 - DNA, 20 bp, synthetic construct
  misc_feature 1..20: note = CRISPR gRNA sequence
  source 1..20: mol_type = other DNA
gctcatgccttcacctcctc

SEQ ID NO: 10689 - DNA, 20 bp, synthetic construct
  misc_feature 1..20: note = CRISPR gRNA sequence
  source 1..20: mol_type = other DNA
cacctcctctggtctttact

SEQ ID NO: 10690 - DNA, 20 bp, synthetic construct
  misc_feature 1..20: note = CRISPR gRNA sequence
  source 1..20: mol_type = other DNA
tcctctggtctttactcagt

SEQ ID NO: 10691 - DNA, 20 bp, synthetic construct
  misc_feature 1..20: note = CRISPR gRNA sequence
  source 1..20: mol_type = other DNA
cctctggtctttactcagtg

SEQ ID NO: 10692 - DNA, 20 bp, synthetic construct
  misc_feature 1..20: note = CRISPR gRNA sequence
  source 1..20: mol_type = other DNA
ttttttctttttcttttttt

SEQ ID NO: 10693 - DNA, 20 bp, synthetic construct
  misc_feature 1..20: note = CRISPR gRNA sequence
  source 1..20: mol_type = other DNA
tttttctttttctttttttg

SEQ ID NO: 10694 - DNA, 20 bp, synthetic construct
  misc_feature 1..20: note = CRISPR gRNA sequence
  source 1..20: mol_type = other DNA
ttctttttctttttttgagg

SEQ ID NO: 10695 - DNA, 20 bp, synthetic construct
  misc_feature 1..20: note = CRISPR gRNA sequence
  source 1..20: mol_type = other DNA
ctttttctttttttgaggtg

SEQ ID NO: 10696 - DNA, 20 bp, synthetic construct
  misc_feature 1..20: note = CRISPR gRNA sequence
  source 1..20: mol_type = other DNA
tggagtctcgctctgtcacc

SEQ ID NO: 10697 - DNA, 20 bp, synthetic construct
  misc_feature 1..20: note = CRISPR gRNA sequence
  source 1..20: mol_type = other DNA
ggagtctcgctctgtcaccc

SEQ ID NO: 10698 - DNA, 20 bp, synthetic construct
  misc_feature 1..20: note = CRISPR gRNA sequence
  source 1..20: mol_type = other DNA
tctcgctctgtcacccaggc

SEQ ID NO: 10699 - DNA, 20 bp, synthetic construct
  misc_feature 1..20: note = CRISPR gRNA sequence
  source 1..20: mol_type = other DNA
tcgctctgtcacccaggctg

SEQ ID NO: 10700 - DNA, 20 bp, synthetic construct
  misc_feature 1..20: note = CRISPR gRNA sequence
  source 1..20: mol_type = other DNA
ctgtcacccaggctggagtg

SEQ ID NO: 10701 - DNA, 20 bp, synthetic construct
  misc_feature 1..20: note = CRISPR gRNA sequence
  source 1..20: mol_type = other DNA
tcacccaggctggagtgcag

SEQ ID NO: 10702 - DNA, 20 bp, synthetic construct
  misc_feature 1..20: note = CRISPR gRNA sequence
  source 1..20: mol_type = other DNA
cactgcaacctcctcctccc

SEQ ID NO: 10703 - DNA, 20 bp, synthetic construct
  misc_feature 1..20: note = CRISPR gRNA sequence
  source 1..20: mol_type = other DNA
aacctcctcctcccaagtcc

SEQ ID NO: 10704 - DNA, 20 bp, synthetic construct
  misc_feature 1..20: note = CRISPR gRNA sequence
  source 1..20: mol_type = other DNA
tccaagtgattctcttgcct

SEQ ID NO: 10705 - DNA, 20 bp, synthetic construct
  misc_feature 1..20: note = CRISPR gRNA sequence
  source 1..20: mol_type = other DNA
ttctcttgcctcagcctccc

SEQ ID NO: 10706 - DNA, 20 bp, synthetic construct
  misc_feature 1..20: note = CRISPR gRNA sequence
  source 1..20: mol_type = other DNA
tcttgcctcagcctcccgag

SEQ ID NO: 10707 - DNA, 20 bp, synthetic construct
  misc_feature 1..20: note = CRISPR gRNA sequence
  source 1..20: mol_type = other DNA
gcctcagcctcccgagtagc

SEQ ID NO: 10708 - DNA, 20 bp, synthetic construct
  misc_feature 1..20: note = CRISPR gRNA sequence
  source 1..20: mol_type = other DNA
cctcagcctcccgagtagct

SEQ ID NO: 10709 - DNA, 20 bp, synthetic construct
  misc_feature 1..20: note = CRISPR gRNA sequence
  source 1..20: mol_type = other DNA
ctcccgagtagctgggacta

SEQ ID NO: 10710 - DNA, 20 bp, synthetic construct
  misc_feature 1..20: note = CRISPR gRNA sequence
  source 1..20: mol_type = other DNA
tcccgagtagctgggactac

SEQ ID NO: 10711 - DNA, 20 bp, synthetic construct
  misc_feature 1..20: note = CRISPR gRNA sequence
  source 1..20: mol_type = other DNA
caggcacatgtcaccacatc

SEQ ID NO: 10712 - DNA, 20 bp, synthetic construct
  misc_feature 1..20: note = CRISPR gRNA sequence
  source 1..20: mol_type = other DNA
tggctaattttttgtatttt

SEQ ID NO: 10713 - DNA, 20 bp, synthetic construct
  misc_feature 1..20: note = CRISPR gRNA sequence
  source 1..20: mol_type = other DNA
ctaattttttgtatttttag

SEQ ID NO: 10714 - DNA, 20 bp, synthetic construct
  misc_feature 1..20: note = CRISPR gRNA sequence
  source 1..20: mol_type = other DNA
aattttttgtatttttagta

SEQ ID NO: 10715 - DNA, 20 bp, synthetic construct
  misc_feature 1..20: note = CRISPR gRNA sequence
  source 1..20: mol_type = other DNA
ttttgtatttttagtagaga

SEQ ID NO: 10716 - DNA, 20 bp, synthetic construct
  misc_feature 1..20: note = CRISPR gRNA sequence
  source 1..20: mol_type = other DNA
tttgtatttttagtagagac

SEQ ID NO: 10717 - DNA, 20 bp, synthetic construct
  misc_feature 1..20: note = CRISPR gRNA sequence
  source 1..20: mol_type = other DNA
ttgtatttttagtagagacg

SEQ ID NO: 10718 - DNA, 20 bp, synthetic construct
  misc_feature 1..20: note = CRISPR gRNA sequence
  source 1..20: mol_type = other DNA
gagacggggtttcaccgtgt

SEQ ID NO: 10719 - DNA, 20 bp, synthetic construct
  misc_feature 1..20: note = CRISPR gRNA sequence
  source 1..20: mol_type = other DNA
cggggtttcaccgtgttagc

SEQ ID NO: 10720 - DNA, 20 bp, synthetic construct
  misc_feature 1..20: note = CRISPR gRNA sequence
  source 1..20: mol_type = other DNA
ggggtttcaccgtgttagcc

SEQ ID NO: 10721 - DNA, 20 bp, synthetic construct
  misc_feature 1..20: note = CRISPR gRNA sequence
  source 1..20: mol_type = other DNA
tttcaccgtgttagccagga

SEQ ID NO: 10722 - DNA, 20 bp, synthetic construct
  misc_feature 1..20: note = CRISPR gRNA sequence
  source 1..20: mol_type = other DNA
acctcgtgatccccccacct

SEQ ID NO: 10723 - DNA, 20 bp, synthetic construct
  misc_feature 1..20: note = CRISPR gRNA sequence
  source 1..20: mol_type = other DNA
ccccccacctcggcctccca

SEQ ID NO: 10724 - DNA, 20 bp, synthetic construct
  misc_feature 1..20: note = CRISPR gRNA sequence
  source 1..20: mol_type = other DNA
acctcggcctcccaaagtgc

SEQ ID NO: 10725 - DNA, 20 bp, synthetic construct
  misc_feature 1..20: note = CRISPR gRNA sequence
  source 1..20: mol_type = other DNA
cctcggcctcccaaagtgct

SEQ ID NO: 10726 - DNA, 20 bp, synthetic construct
  misc_feature 1..20: note = CRISPR gRNA sequence
  source 1..20: mol_type = other DNA
ctcccaaagtgctgggatta

SEQ ID NO: 10727 - DNA, 20 bp, synthetic construct
  misc_feature 1..20: note = CRISPR gRNA sequence
  source 1..20: mol_type = other DNA
tcccaaagtgctgggattac

SEQ ID NO: 10728 - DNA, 20 bp, synthetic construct
  misc_feature 1..20: note = CRISPR gRNA sequence
  source 1..20: mol_type = other DNA
agtgctgggattacaggcgt

SEQ ID NO: 10729 - DNA, 20 bp, synthetic construct
  misc_feature 1..20: note = CRISPR gRNA sequence
  source 1..20: mol_type = other DNA
caggcgtgagccaccacacc

SEQ ID NO: 10730 - DNA, 20 bp, synthetic construct
  misc_feature 1..20: note = CRISPR gRNA sequence
  source 1..20: mol_type = other DNA
tgagccaccacacccggcct

SEQ ID NO: 10731 - DNA, 20 bp, synthetic construct
  misc_feature 1..20: note = CRISPR gRNA sequence
  source 1..20: mol_type = other DNA
ccaccacacccggcctcagt

SEQ ID NO: 10732 - DNA, 20 bp, synthetic construct
  misc_feature 1..20: note = CRISPR gRNA sequence
  source 1..20: mol_type = other DNA
caccacacccggcctcagtg

SEQ ID NO: 10733 - DNA, 20 bp, synthetic construct
  misc_feature 1..20: note = CRISPR gRNA sequence
  source 1..20: mol_type = other DNA
gaggtcttttctgaccctca

SEQ ID NO: 10734 - DNA, 20 bp, synthetic construct
  misc_feature 1..20: note = CRISPR gRNA sequence
  source 1..20: mol_type = other DNA
cacagttaaaaataaaactc

SEQ ID NO: 10735 - DNA, 20 bp, synthetic construct
  misc_feature 1..20: note = CRISPR gRNA sequence
  source 1..20: mol_type = other DNA
gttaaaaataaaactctggc

SEQ ID NO: 10736 - DNA, 20 bp, synthetic construct
  misc_feature 1..20: note = CRISPR gRNA sequence
  source 1..20: mol_type = other DNA
ttaaaaataaaactctggcc

SEQ ID NO: 10737 - DNA, 20 bp, synthetic construct
  misc_feature 1..20: note = CRISPR gRNA sequence
  source 1..20: mol_type = other DNA
aataaaactctggccaggcg

SEQ ID NO: 10738 - DNA, 20 bp, synthetic construct
  misc_feature 1..20: note = CRISPR gRNA sequence
  source 1..20: mol_type = other DNA
aaaactctggccaggcgcag

SEQ ID NO: 10739 - DNA, 20 bp, synthetic construct
  misc_feature 1..20: note = CRISPR gRNA sequence
  source 1..20: mol_type = other DNA
gtggcttatgcctgtaatcc

SEQ ID NO: 10740 - DNA, 20 bp, synthetic construct
  misc_feature 1..20: note = CRISPR gRNA sequence
  source 1..20: mol_type = other DNA
tgcctgtaatcccagcactt

SEQ ID NO: 10741 - DNA, 20 bp, synthetic construct
  misc_feature 1..20: note = CRISPR gRNA sequence
  source 1..20: mol_type = other DNA
gcctgtaatcccagcacttt

SEQ ID NO: 10742 - DNA, 20 bp, synthetic construct
  misc_feature 1..20: note = CRISPR gRNA sequence
  source 1..20: mol_type = other DNA
ctgtaatcccagcactttgg

SEQ ID NO: 10743 - DNA, 20 bp, synthetic construct
  misc_feature 1..20: note = CRISPR gRNA sequence
  source 1..20: mol_type = other DNA
tgtaatcccagcactttggg

SEQ ID NO: 10744 - DNA, 20 bp, synthetic construct
  misc_feature 1..20: note = CRISPR gRNA sequence
  source 1..20: mol_type = other DNA
tcccagcactttgggaggcc

SEQ ID NO: 10745 - DNA, 20 bp, synthetic construct
  misc_feature 1..20: note = CRISPR gRNA sequence
  source 1..20: mol_type = other DNA
cccagcactttgggaggccg

SEQ ID NO: 10746 - DNA, 20 bp, synthetic construct
  misc_feature 1..20: note = CRISPR gRNA sequence
  source 1..20: mol_type = other DNA
agcactttgggaggccgagg

SEQ ID NO: 10747 - DNA, 20 bp, synthetic construct
  misc_feature 1..20: note = CRISPR gRNA sequence
  source 1..20: mol_type = other DNA
gcactttgggaggccgaggc

SEQ ID NO: 10748 - DNA, 20 bp, synthetic construct
  misc_feature 1..20: note = CRISPR gRNA sequence
  source 1..20: mol_type = other DNA
ctttgggaggccgaggcagg

SEQ ID NO: 10749 - DNA, 20 bp, synthetic construct
  misc_feature 1..20: note = CRISPR gRNA sequence
  source 1..20: mol_type = other DNA
ggccgaggcaggtggatcac

SEQ ID NO: 10750 - DNA, 20 bp, synthetic construct
  misc_feature 1..20: note = CRISPR gRNA sequence
  source 1..20: mol_type = other DNA
gccgaggcaggtggatcaca

SEQ ID NO: 10751 - DNA, 20 bp, synthetic construct
  misc_feature 1..20: note = CRISPR gRNA sequence
  source 1..20: mol_type = other DNA
aggcaggtggatcacaaggc

SEQ ID NO: 10752 - DNA, 20 bp, synthetic construct
  misc_feature 1..20: note = CRISPR gRNA sequence
  source 1..20: mol_type = other DNA
ggcaggtggatcacaaggcc

SEQ ID NO: 10753 - DNA, 20 bp, synthetic construct
  misc_feature 1..20: note = CRISPR gRNA sequence
  source 1..20: mol_type = other DNA
caggtggatcacaaggccag

SEQ ID NO: 10754 - DNA, 20 bp, synthetic construct
  misc_feature 1..20: note = CRISPR gRNA sequence
  source 1..20: mol_type = other DNA
gatcacaaggccaggagttt

SEQ ID NO: 10755 - DNA, 20 bp, synthetic construct
  misc_feature 1..20: note = CRISPR gRNA sequence
  source 1..20: mol_type = other DNA
caaggccaggagtttgagac

SEQ ID NO: 10756 - DNA, 20 bp, synthetic construct
  misc_feature 1..20: note = CRISPR gRNA sequence
  source 1..20: mol_type = other DNA
ccaggagtttgagaccagcc

SEQ ID NO: 10757 - DNA, 20 bp, synthetic construct
  misc_feature 1..20: note = CRISPR gRNA sequence
  source 1..20: mol_type = other DNA
tgagaccagcctggccaaca

SEQ ID NO: 10758 - DNA, 20 bp, synthetic construct
  misc_feature 1..20: note = CRISPR gRNA sequence
  source 1..20: mol_type = other DNA
actaaatatacaaaacaaat

SEQ ID NO: 10759 - DNA, 20 bp, synthetic construct
  misc_feature 1..20: note = CRISPR gRNA sequence
  source 1..20: mol_type = other DNA
aatatacaaaacaaattagc

SEQ ID NO: 10760 - DNA, 20 bp, synthetic construct
  misc_feature 1..20: note = CRISPR gRNA sequence
  source 1..20: mol_type = other DNA
atatacaaaacaaattagct

SEQ ID NO: 10761 - DNA, 20 bp, synthetic construct
  misc_feature 1..20: note = CRISPR gRNA sequence
  source 1..20: mol_type = other DNA
caaaacaaattagctgggca

SEQ ID NO: 10762 - DNA, 20 bp, synthetic construct
  misc_feature 1..20: note = CRISPR gRNA sequence
  source 1..20: mol_type = other DNA
aacaaattagctgggcatgg

SEQ ID NO: 10763 - DNA, 20 bp, synthetic construct
  misc_feature 1..20: note = CRISPR gRNA sequence
  source 1..20: mol_type = other DNA
aaattagctgggcatggtgg

SEQ ID NO: 10764 - DNA, 20 bp, synthetic construct
  misc_feature 1..20: note = CRISPR gRNA sequence
  source 1..20: mol_type = other DNA
aattagctgggcatggtggc

SEQ ID NO: 10765 - DNA, 20 bp, synthetic construct
  misc_feature 1..20: note = CRISPR gRNA sequence
  source 1..20: mol_type = other DNA
ggcatggtggcaggtgcctg

SEQ ID NO: 10766 - DNA, 20 bp, synthetic construct
  misc_feature 1..20: note = CRISPR gRNA sequence
  source 1..20: mol_type = other DNA
gtggcaggtgcctgtagtca

SEQ ID NO: 10767 - DNA, 20 bp, synthetic construct
  misc_feature 1..20: note = CRISPR gRNA sequence
  source 1..20: mol_type = other DNA
tgcctgtagtcacagctact

SEQ ID NO: 10768 - DNA, 20 bp, synthetic construct
  misc_feature 1..20: note = CRISPR gRNA sequence
  source 1..20: mol_type = other DNA
gcctgtagtcacagctactt

SEQ ID NO: 10769 - DNA, 20 bp, synthetic construct
  misc_feature 1..20: note = CRISPR gRNA sequence
  source 1..20: mol_type = other DNA
ctgtagtcacagctacttgg

SEQ ID NO: 10770 - DNA, 20 bp, synthetic construct
  misc_feature 1..20: note = CRISPR gRNA sequence
  source 1..20: mol_type = other DNA
tgtagtcacagctacttggg

SEQ ID NO: 10771 - DNA, 20 bp, synthetic construct
  misc_feature 1..20: note = CRISPR gRNA sequence
  source 1..20: mol_type = other DNA
tcacagctacttgggaggct

SEQ ID NO: 10772 - DNA, 20 bp, synthetic construct
  misc_feature 1..20: note = CRISPR gRNA sequence
  source 1..20: mol_type = other DNA
cacagctacttgggaggctg

SEQ ID NO: 10773 - DNA, 20 bp, synthetic construct
  misc_feature 1..20: note = CRISPR gRNA sequence
  source 1..20: mol_type = other DNA
agctacttgggaggctgagg

SEQ ID NO: 10774 - DNA, 20 bp, synthetic construct
  misc_feature 1..20: note = CRISPR gRNA sequence
  source 1..20: mol_type = other DNA
gctacttgggaggctgaggc

SEQ ID NO: 10775 - DNA, 20 bp, synthetic construct
  misc_feature 1..20: note = CRISPR gRNA sequence
  source 1..20: mol_type = other DNA
tacttgggaggctgaggcag

SEQ ID NO: 10776 - DNA, 20 bp, synthetic construct
  misc_feature 1..20: note = CRISPR gRNA sequence
  source 1..20: mol_type = other DNA
gcaggagaatcatttgaaac

SEQ ID NO: 10777 - DNA, 20 bp, synthetic construct
  misc_feature 1..20: note = CRISPR gRNA sequence
  source 1..20: mol_type = other DNA
caggagaatcatttgaaacc

SEQ ID NO: 10778 - DNA, 20 bp, synthetic construct
  misc_feature 1..20: note = CRISPR gRNA sequence
  source 1..20: mol_type = other DNA
ggagaatcatttgaaaccgg

SEQ ID NO: 10779 - DNA, 20 bp, synthetic construct
  misc_feature 1..20: note = CRISPR gRNA sequence
  source 1..20: mol_type = other DNA
gagaatcatttgaaaccggg

SEQ ID NO: 10780 - DNA, 20 bp, synthetic construct
  misc_feature 1..20: note = CRISPR gRNA sequence
  source 1..20: mol_type = other DNA
aatcatttgaaaccgggagg

SEQ ID NO: 10781 - DNA, 20 bp, synthetic construct
  misc_feature 1..20: note = CRISPR gRNA sequence
  source 1..20: mol_type = other DNA
tcatttgaaaccgggaggcg

SEQ ID NO: 10782 - DNA, 20 bp, synthetic construct
  misc_feature 1..20: note = CRISPR gRNA sequence
  source 1..20: mol_type = other DNA
catttgaaaccgggaggcgg

SEQ ID NO: 10783 - DNA, 20 bp, synthetic construct
  misc_feature 1..20: note = CRISPR gRNA sequence
  source 1..20: mol_type = other DNA
aaaccgggaggcggaggttg

SEQ ID NO: 10784 - DNA, 20 bp, synthetic construct
  misc_feature 1..20: note = CRISPR gRNA sequence
  source 1..20: mol_type = other DNA
cgggaggcggaggttgcggt

SEQ ID NO: 10785 - DNA, 20 bp, synthetic construct
  misc_feature 1..20: note = CRISPR gRNA sequence
  source 1..20: mol_type = other DNA
ggcggaggttgcggtgagct

SEQ ID NO: 10786 - DNA, 20 bp, synthetic construct
  misc_feature 1..20: note = CRISPR gRNA sequence
  source 1..20: mol_type = other DNA
gagctgagatcacgccactg

SEQ ID NO: 10787 - DNA, 20 bp, synthetic construct
  misc_feature 1..20: note = CRISPR gRNA sequence
  source 1..20: mol_type = other DNA
gagatcacgccactgcagtc

SEQ ID NO: 10788 - DNA, 20 bp, synthetic construct
  misc_feature 1..20: note = CRISPR gRNA sequence
  source 1..20: mol_type = other DNA
cacgccactgcagtccagct

SEQ ID NO: 10789 - DNA, 20 bp, synthetic construct
  misc_feature 1..20: note = CRISPR gRNA sequence
  source 1..20: mol_type = other DNA
ctgcagtccagcttggatga

SEQ ID NO: 10790 - DNA, 20 bp, synthetic construct
  misc_feature 1..20: note = CRISPR gRNA sequence
  source 1..20: mol_type = other DNA
gcagtccagcttggatgaca

SEQ ID NO: 10791 - DNA, 20 bp, synthetic construct
  misc_feature 1..20: note = CRISPR gRNA sequence
  source 1..20: mol_type = other DNA
tccagcttggatgacagagt

SEQ ID NO: 10792 - DNA, 20 bp, synthetic construct
  misc_feature 1..20: note = CRISPR gRNA sequence
  source 1..20: mol_type = other DNA
taaataaataaataaataaa

SEQ ID NO: 10793 - DNA, 20 bp, synthetic construct
  misc_feature 1..20: note = CRISPR gRNA sequence
  source 1..20: mol_type = other DNA
atagaactccattcccctca

SEQ ID NO: 10794 - DNA, 20 bp, synthetic construct
  misc_feature 1..20: note = CRISPR gRNA sequence
  source 1..20: mol_type = other DNA
ttccatatgattcattgtct

SEQ ID NO: 10795 - DNA, 20 bp, synthetic construct
  misc_feature 1..20: note = CRISPR gRNA sequence
  source 1..20: mol_type = other DNA
tgattcattgtctcagacat

SEQ ID NO: 10796 - DNA, 20 bp, synthetic construct
  misc_feature 1..20: note = CRISPR gRNA sequence
  source 1..20: mol_type = other DNA
tatctgtctatcttcccccc

SEQ ID NO: 10797 - DNA, 20 bp, synthetic construct
  misc_feature 1..20: note = CRISPR gRNA sequence
  source 1..20: mol_type = other DNA
tatcttcccccctggaatgt

SEQ ID NO: 10798 - DNA, 20 bp, synthetic construct
  misc_feature 1..20: note = CRISPR gRNA sequence
  source 1..20: mol_type = other DNA
ccccctggaatgtcagcacc

SEQ ID NO: 10799 - DNA, 20 bp, synthetic construct
  misc_feature 1..20: note = CRISPR gRNA sequence
  source 1..20: mol_type = other DNA
cctggaatgtcagcacccag

SEQ ID NO: 10800 - DNA, 20 bp, synthetic construct
  misc_feature 1..20: note = CRISPR gRNA sequence
  source 1..20: mol_type = other DNA
ctggaatgtcagcacccaga

SEQ ID NO: 10801 - DNA, 20 bp, synthetic construct
  misc_feature 1..20: note = CRISPR gRNA sequence
  source 1..20: mol_type = other DNA
gaatgtcagcacccagaagg

SEQ ID NO: 10802 - DNA, 20 bp, synthetic construct
  misc_feature 1..20: note = CRISPR gRNA sequence
  source 1..20: mol_type = other DNA
aatgtcagcacccagaaggc

SEQ ID NO: 10803 - DNA, 20 bp, synthetic construct
  misc_feature 1..20: note = CRISPR gRNA sequence
  source 1..20: mol_type = other DNA
atgtcagcacccagaaggca

SEQ ID NO: 10804 - DNA, 20 bp, synthetic construct
  misc_feature 1..20: note = CRISPR gRNA sequence
  source 1..20: mol_type = other DNA
ggcagggattttcgtctgtt

SEQ ID NO: 10805 - DNA, 20 bp, synthetic construct
  misc_feature 1..20: note = CRISPR gRNA sequence
  source 1..20: mol_type = other DNA
tggcccacaactttcctccc

SEQ ID NO: 10806 - DNA, 20 bp, synthetic construct
  misc_feature 1..20: note = CRISPR gRNA sequence
  source 1..20: mol_type = other DNA
ggcccacaactttcctccct

SEQ ID NO: 10807 - DNA, 20 bp, synthetic construct
  misc_feature 1..20: note = CRISPR gRNA sequence
  source 1..20: mol_type = other DNA
acaactttcctccctgggcc

SEQ ID NO: 10808 - DNA, 20 bp, synthetic construct
  misc_feature 1..20: note = CRISPR gRNA sequence
  source 1..20: mol_type = other DNA
tcctccctgggcctggcaca

SEQ ID NO: 10809 - DNA, 20 bp, synthetic construct
  misc_feature 1..20: note = CRISPR gRNA sequence
  source 1..20: mol_type = other DNA
tccctgggcctggcacatag

SEQ ID NO: 10810 - DNA, 20 bp, synthetic construct
  misc_feature 1..20: note = CRISPR gRNA sequence
  source 1..20: mol_type = other DNA
ccctgggcctggcacatagt

SEQ ID NO: 10811 - DNA, 20 bp, synthetic construct
  misc_feature 1..20: note = CRISPR gRNA sequence
  source 1..20: mol_type = other DNA
gggcctggcacatagtaggc

SEQ ID NO: 10812 - DNA, 20 bp, synthetic construct
  misc_feature 1..20: note = CRISPR gRNA sequence
  source 1..20: mol_type = other DNA
cctggcacatagtaggcaag

SEQ ID NO: 10813 - DNA, 20 bp, synthetic construct
  misc_feature 1..20: note = CRISPR gRNA sequence
  source 1..20: mol_type = other DNA
aacaacgaatgccttaatcc

SEQ ID NO: 10814 - DNA, 20 bp, synthetic construct
  misc_feature 1..20: note = CRISPR gRNA sequence
  source 1..20: mol_type = other DNA
cttaatccaagaacccccat

SEQ ID NO: 10815 - DNA, 20 bp, synthetic construct
  misc_feature 1..20: note = CRISPR gRNA sequence
  source 1..20: mol_type = other DNA
tccaagaacccccataagat

SEQ ID NO: 10816 - DNA, 20 bp, synthetic construct
  misc_feature 1..20: note = CRISPR gRNA sequence
  source 1..20: mol_type = other DNA
ccaagaacccccataagatt

SEQ ID NO: 10817 - DNA, 20 bp, synthetic construct
  misc_feature 1..20: note = CRISPR gRNA sequence
  source 1..20: mol_type = other DNA
caagaacccccataagattg

SEQ ID NO: 10818 - DNA, 20 bp, synthetic construct
  misc_feature 1..20: note = CRISPR gRNA sequence
  source 1..20: mol_type = other DNA
aagattggggtgaaatattt

SEQ ID NO: 10819 - DNA, 20 bp, synthetic construct
  misc_feature 1..20: note = CRISPR gRNA sequence
  source 1..20: mol_type = other DNA
agattggggtgaaatatttg

SEQ ID NO: 10820 - DNA, 20 bp, synthetic construct
  misc_feature 1..20: note = CRISPR gRNA sequence
  source 1..20: mol_type = other DNA
attggggtgaaatatttgag

SEQ ID NO: 10821 - DNA, 20 bp, synthetic construct
  misc_feature 1..20: note = CRISPR gRNA sequence
  source 1..20: mol_type = other DNA
gtgaaatatttgaggagatc

SEQ ID NO: 10822 - DNA, 20 bp, synthetic construct
  misc_feature 1..20: note = CRISPR gRNA sequence
  source 1..20: mol_type = other DNA
atttgaggagatcaagactt

SEQ ID NO: 10823 - DNA, 20 bp, synthetic construct
  misc_feature 1..20: note = CRISPR gRNA sequence
  source 1..20: mol_type = other DNA
tttgaggagatcaagactta

SEQ ID NO: 10824 - DNA, 20 bp, synthetic construct
  misc_feature 1..20: note = CRISPR gRNA sequence
  source 1..20: mol_type = other DNA
ttgaggagatcaagacttaa

SEQ ID NO: 10825 - DNA, 20 bp, synthetic construct
  misc_feature 1..20: note = CRISPR gRNA sequence
  source 1..20: mol_type = other DNA
gagatcaagacttaagggtg

SEQ ID NO: 10826 - DNA, 20 bp, synthetic construct
  misc_feature 1..20: note = CRISPR gRNA sequence
  source 1..20: mol_type = other DNA
agatcaagacttaagggtga

SEQ ID NO: 10827 - DNA, 20 bp, synthetic construct
  misc_feature 1..20: note = CRISPR gRNA sequence
  source 1..20: mol_type = other DNA
gatcaagacttaagggtgaa

SEQ ID NO: 10828 - DNA, 20 bp, synthetic construct
  misc_feature 1..20: note = CRISPR gRNA sequence
  source 1..20: mol_type = other DNA
taagggtgaagggatttgcc

SEQ ID NO: 10829 - DNA, 20 bp, synthetic construct
  misc_feature 1..20: note = CRISPR gRNA sequence
  source 1..20: mol_type = other DNA
aagggtgaagggatttgcca

SEQ ID NO: 10830 - DNA, 20 bp, synthetic construct
  misc_feature 1..20: note = CRISPR gRNA sequence
  source 1..20: mol_type = other DNA
aagggatttgccaaggcctt

SEQ ID NO: 10831 - DNA, 20 bp, synthetic construct
  misc_feature 1..20: note = CRISPR gRNA sequence
  source 1..20: mol_type = other DNA
ggatttgccaaggcctttag

SEQ ID NO: 10832 - DNA, 20 bp, synthetic construct
  misc_feature 1..20: note = CRISPR gRNA sequence
  source 1..20: mol_type = other DNA
gatttgccaaggcctttagc

SEQ ID NO: 10833 - DNA, 20 bp, synthetic construct
  misc_feature 1..20: note = CRISPR gRNA sequence
  source 1..20: mol_type = other DNA
atttgccaaggcctttagca

SEQ ID NO: 10834 - DNA, 20 bp, synthetic construct
  misc_feature 1..20: note = CRISPR gRNA sequence
  source 1..20: mol_type = other DNA
ttgccaaggcctttagcagg

SEQ ID NO: 10835 - DNA, 20 bp, synthetic construct
  misc_feature 1..20: note = CRISPR gRNA sequence
  source 1..20: mol_type = other DNA
tttagcagggagccaaatgc

SEQ ID NO: 10836 - DNA, 20 bp, synthetic construct
  misc_feature 1..20: note = CRISPR gRNA sequence
  source 1..20: mol_type = other DNA
gggagccaaatgccagatcc

SEQ ID NO: 10837 - DNA, 20 bp, synthetic construct
  misc_feature 1..20: note = CRISPR gRNA sequence
  source 1..20: mol_type = other DNA
gagccaaatgccagatcctg

SEQ ID NO: 10838 - DNA, 20 bp, synthetic construct
  misc_feature 1..20: note = CRISPR gRNA sequence
  source 1..20: mol_type = other DNA
ggagtcaaactctgatcctg

SEQ ID NO: 10839 - DNA, 20 bp, synthetic construct
  misc_feature 1..20: note = CRISPR gRNA sequence
  source 1..20: mol_type = other DNA
tgatcctgtggccttttgct

SEQ ID NO: 10840 - DNA, 20 bp, synthetic construct
  misc_feature 1..20: note = CRISPR gRNA sequence
  source 1..20: mol_type = other DNA
gatcctgtggccttttgctg

SEQ ID NO: 10841 - DNA, 20 bp, synthetic construct
  misc_feature 1..20: note = CRISPR gRNA sequence
  source 1..20: mol_type = other DNA
ctgtggccttttgctgaggc

SEQ ID NO: 10842 - DNA, 20 bp, synthetic construct
  misc_feature 1..20: note = CRISPR gRNA sequence
  source 1..20: mol_type = other DNA
tttgctgaggccagtgttct

SEQ ID NO: 10843 - DNA, 20 bp, synthetic construct
  misc_feature 1..20: note = CRISPR gRNA sequence
  source 1..20: mol_type = other DNA
aggccagtgttctcagactt

SEQ ID NO: 10844 - DNA, 20 bp, synthetic construct
  misc_feature 1..20: note = CRISPR gRNA sequence
  source 1..20: mol_type = other DNA
ggccagtgttctcagacttc

SEQ ID NO: 10845 - DNA, 20 bp, synthetic construct
  misc_feature 1..20: note = CRISPR gRNA sequence
  source 1..20: mol_type = other DNA
gttctcagacttcaggattt

SEQ ID NO: 10846 - DNA, 20 bp, synthetic construct
  misc_feature 1..20: note = CRISPR gRNA sequence
  source 1..20: mol_type = other DNA
tctcagacttcaggatttca

SEQ ID NO: 10847 - DNA, 20 bp, synthetic construct
  misc_feature 1..20: note = CRISPR gRNA sequence
  source 1..20: mol_type = other DNA
ctcagacttcaggatttcag

SEQ ID NO: 10848 - DNA, 20 bp, synthetic construct
  misc_feature 1..20: note = CRISPR gRNA sequence
  source 1..20: mol_type = other DNA
acttcaggatttcagaggcc

SEQ ID NO: 10849 - DNA, 20 bp, synthetic construct
  misc_feature 1..20: note = CRISPR gRNA sequence
  source 1..20: mol_type = other DNA
ttcagaggccgagaacattt

SEQ ID NO: 10850 - DNA, 20 bp, synthetic construct
  misc_feature 1..20: note = CRISPR gRNA sequence
  source 1..20: mol_type = other DNA
gaacatttcggaatgaattc

SEQ ID NO: 10851 - DNA, 20 bp, synthetic construct
  misc_feature 1..20: note = CRISPR gRNA sequence
  source 1..20: mol_type = other DNA
tgaattcgagtgaccgtgcg

SEQ ID NO: 10852 - DNA, 20 bp, synthetic construct
  misc_feature 1..20: note = CRISPR gRNA sequence
  source 1..20: mol_type = other DNA
actgttttttaatgtttatc

SEQ ID NO: 10853 - DNA, 20 bp, synthetic construct
  misc_feature 1..20: note = CRISPR gRNA sequence
  source 1..20: mol_type = other DNA
ctgttttttaatgtttatca

SEQ ID NO: 10854 - DNA, 20 bp, synthetic construct
  misc_feature 1..20: note = CRISPR gRNA sequence
  source 1..20: mol_type = other DNA
aacaacaaaatacccactgc

SEQ ID NO: 10855 - DNA, 20 bp, synthetic construct
  misc_feature 1..20: note = CRISPR gRNA sequence
  source 1..20: mol_type = other DNA
ctggcaccataattttacca

SEQ ID NO: 10856 - DNA, 20 bp, synthetic construct
  misc_feature 1..20: note = CRISPR gRNA sequence
  source 1..20: mol_type = other DNA
tgatcattctaatattgaaa

SEQ ID NO: 10857 - DNA, 20 bp, synthetic construct
  misc_feature 1..20: note = CRISPR gRNA sequence
  source 1..20: mol_type = other DNA
tctaatattgaaaaagttca

SEQ ID NO: 10858 - DNA, 20 bp, synthetic construct
  misc_feature 1..20: note = CRISPR gRNA sequence
  source 1..20: mol_type = other DNA
ctaatattgaaaaagttcaa

SEQ ID NO: 10859 - DNA, 20 bp, synthetic construct
  misc_feature 1..20: note = CRISPR gRNA sequence
  source 1..20: mol_type = other DNA
aagttcaaaggacataattg

SEQ ID NO: 10860 - DNA, 20 bp, synthetic construct
  misc_feature 1..20: note = CRISPR gRNA sequence
  source 1..20: mol_type = other DNA
aggacataattgcagaataa

SEQ ID NO: 10861 - DNA, 20 bp, synthetic construct
  misc_feature 1..20: note = CRISPR gRNA sequence
  source 1..20: mol_type = other DNA
cataattgcagaataaaaga

SEQ ID NO: 10862 - DNA, 20 bp, synthetic construct
  misc_feature 1..20: note = CRISPR gRNA sequence
  source 1..20: mol_type = other DNA
ataaaagacagctctttata

SEQ ID NO: 10863 - DNA, 20 bp, synthetic construct
  misc_feature 1..20: note = CRISPR gRNA sequence
  source 1..20: mol_type = other DNA
aaccatatttttaaactaaa

SEQ ID NO: 10864 - DNA, 20 bp, synthetic construct
  misc_feature 1..20: note = CRISPR gRNA sequence
  source 1..20: mol_type = other DNA
ttatttttctcatccccttg

SEQ ID NO: 10865 - DNA, 20 bp, synthetic construct
  misc_feature 1..20: note = CRISPR gRNA sequence
  source 1..20: mol_type = other DNA
gtctgctctaaatgttgatc

SEQ ID NO: 10866 - DNA, 20 bp, synthetic construct
  misc_feature 1..20: note = CRISPR gRNA sequence
  source 1..20: mol_type = other DNA
tctgctctaaatgttgatcc

SEQ ID NO: 10867 - DNA, 20 bp, synthetic construct
  misc_feature 1..20: note = CRISPR gRNA sequence
  source 1..20: mol_type = other DNA
caggctgtgtgaccctgtgt

SEQ ID NO: 10868 - DNA, 20 bp, synthetic construct
  misc_feature 1..20: note = CRISPR gRNA sequence
  source 1..20: mol_type = other DNA
gtgtgagctatttgatcgcc

SEQ ID NO: 10869 - DNA, 20 bp, synthetic construct
  misc_feature 1..20: note = CRISPR gRNA sequence
  source 1..20: mol_type = other DNA
tatttgatcgcctagtgcct

SEQ ID NO: 10870 - DNA, 20 bp, synthetic construct
  misc_feature 1..20: note = CRISPR gRNA sequence
  source 1..20: mol_type = other DNA
cagtttccctatatgtaaaa

SEQ ID NO: 10871 - DNA, 20 bp, synthetic construct
  misc_feature 1..20: note = CRISPR gRNA sequence
  source 1..20: mol_type = other DNA
gtttccctatatgtaaaatg

SEQ ID NO: 10872 - DNA, 20 bp, synthetic construct
  misc_feature 1..20: note = CRISPR gRNA sequence
  source 1..20: mol_type = other DNA
cctatatgtaaaatggagat

SEQ ID NO: 10873 - DNA, 20 bp, synthetic construct
  misc_feature 1..20: note = CRISPR gRNA sequence
  source 1..20: mol_type = other DNA
tatatgtaaaatggagataa

SEQ ID NO: 10874 - DNA, 20 bp, synthetic construct
  misc_feature 1..20: note = CRISPR gRNA sequence
  source 1..20: mol_type = other DNA
aaaatggagataagagccca

SEQ ID NO: 10875 - DNA, 20 bp, synthetic construct
  misc_feature 1..20: note = CRISPR gRNA sequence
  source 1..20: mol_type = other DNA
ggagataagagcccatagct

SEQ ID NO: 10876 - DNA, 20 bp, synthetic construct
  misc_feature 1..20: note = CRISPR gRNA sequence
  source 1..20: mol_type = other DNA
agataagagcccatagctca

SEQ ID NO: 10877 - DNA, 20 bp, synthetic construct
  misc_feature 1..20: note = CRISPR gRNA sequence
  source 1..20: mol_type = other DNA
agcccatagctcagagtctt

SEQ ID NO: 10878 - DNA, 20 bp, synthetic construct
  misc_feature 1..20: note = CRISPR gRNA sequence
  source 1..20: mol_type = other DNA
gcccatagctcagagtcttg

SEQ ID NO: 10879 - DNA, 20 bp, synthetic construct
  misc_feature 1..20: note = CRISPR gRNA sequence
  source 1..20: mol_type = other DNA
ccatagctcagagtcttgag

SEQ ID NO: 10880 - DNA, 20 bp, synthetic construct
  misc_feature 1..20: note = CRISPR gRNA sequence
  source 1..20: mol_type = other DNA
cagagtcttgaggagtaaat

SEQ ID NO: 10881 - DNA, 20 bp, synthetic construct
  misc_feature 1..20: note = CRISPR gRNA sequence
  source 1..20: mol_type = other DNA
cttgaggagtaaatgagatc

SEQ ID NO: 10882 - DNA, 20 bp, synthetic construct
  misc_feature 1..20: note = CRISPR gRNA sequence
  source 1..20: mol_type = other DNA
ttgaggagtaaatgagatct

SEQ ID NO: 10883 - DNA, 20 bp, synthetic construct
  misc_feature 1..20: note = CRISPR gRNA sequence
  source 1..20: mol_type = other DNA
gagtaaatgagatctaggcc

SEQ ID NO: 10884 - DNA, 20 bp, synthetic construct
  misc_feature 1..20: note = CRISPR gRNA sequence
  source 1..20: mol_type = other DNA
agtaaatgagatctaggccg

SEQ ID NO: 10885 - DNA, 20 bp, synthetic construct
  misc_feature 1..20: note = CRISPR gRNA sequence
  source 1..20: mol_type = other DNA
gtaaatgagatctaggccga

SEQ ID NO: 10886 - DNA, 20 bp, synthetic construct
  misc_feature 1..20: note = CRISPR gRNA sequence
  source 1..20: mol_type = other DNA
aatgagatctaggccgaggg

SEQ ID NO: 10887 - DNA, 20 bp, synthetic construct
  misc_feature 1..20: note = CRISPR gRNA sequence
  source 1..20: mol_type = other DNA
atgagatctaggccgaggga

SEQ ID NO: 10888 - DNA, 20 bp, synthetic construct
  misc_feature 1..20: note = CRISPR gRNA sequence
  source 1..20: mol_type = other DNA
tgagatctaggccgagggaa

SEQ ID NO: 10889 - DNA, 20 bp, synthetic construct
  misc_feature 1..20: note = CRISPR gRNA sequence
  source 1..20: mol_type = other DNA
tctaggccgagggaagggcc

SEQ ID NO: 10890 - DNA, 20 bp, synthetic construct
  misc_feature 1..20: note = CRISPR gRNA sequence
  source 1..20: mol_type = other DNA
ggaagggcctagcatgcccc

SEQ ID NO: 10891 - DNA, 20 bp, synthetic construct
  misc_feature 1..20: note = CRISPR gRNA sequence
  source 1..20: mol_type = other DNA
tataataaatgctcaacaaa

SEQ ID NO: 10892 - DNA, 20 bp, synthetic construct
  misc_feature 1..20: note = CRISPR gRNA sequence
  source 1..20: mol_type = other DNA
ccttttgttattaaaatgca

SEQ ID NO: 10893 - DNA, 20 bp, synthetic construct
  misc_feature 1..20: note = CRISPR gRNA sequence
  source 1..20: mol_type = other DNA
cttttgttattaaaatgcaa

SEQ ID NO: 10894 - DNA, 20 bp, synthetic construct
  misc_feature 1..20: note = CRISPR gRNA sequence
  source 1..20: mol_type = other DNA
attaaaatgcaaaggcatat

SEQ ID NO: 10895 - DNA, 20 bp, synthetic construct
  misc_feature 1..20: note = CRISPR gRNA sequence
  source 1..20: mol_type = other DNA
aggcatattagtcaaccacc

SEQ ID NO: 10896 - DNA, 20 bp, synthetic construct
  misc_feature 1..20: note = CRISPR gRNA sequence
  source 1..20: mol_type = other DNA
tcaaccacctggtttaccac

SEQ ID NO: 10897 - DNA, 20 bp, synthetic construct
  misc_feature 1..20: note = CRISPR gRNA sequence
  source 1..20: mol_type = other DNA
accacctggtttaccactgg

SEQ ID NO: 10898 - DNA, 20 bp, synthetic construct
  misc_feature 1..20: note = CRISPR gRNA sequence
  source 1..20: mol_type = other DNA
acctggtttaccactggcag

SEQ ID NO: 10899 - DNA, 20 bp, synthetic construct
  misc_feature 1..20: note = CRISPR gRNA sequence
  source 1..20: mol_type = other DNA
ttaccactggcagtggtcgt

SEQ ID NO: 10900 - DNA, 20 bp, synthetic construct
  misc_feature 1..20: note = CRISPR gRNA sequence
  source 1..20: mol_type = other DNA
cactggcagtggtcgtcagc

SEQ ID NO: 10901 - DNA, 20 bp, synthetic construct
  misc_feature 1..20: note = CRISPR gRNA sequence
  source 1..20: mol_type = other DNA
gtggtcgtcagctggcattt

SEQ ID NO: 10902 - DNA, 20 bp, synthetic construct
  misc_feature 1..20: note = CRISPR gRNA sequence
  source 1..20: mol_type = other DNA
tggtcgtcagctggcatttc

SEQ ID NO: 10903 - DNA, 20 bp, synthetic construct
  misc_feature 1..20: note = CRISPR gRNA sequence
  source 1..20: mol_type = other DNA
gcatttcaggaccccttccc

SEQ ID NO: 10904 - DNA, 20 bp, synthetic construct
  misc_feature 1..20: note = CRISPR gRNA sequence
  source 1..20: mol_type = other DNA
catttcaggaccccttcccc

SEQ ID NO: 10905 - DNA, 20 bp, synthetic construct
  misc_feature 1..20: note = CRISPR gRNA sequence
  source 1..20: mol_type = other DNA
aggaccccttccccaggctg

SEQ ID NO: 10906 - DNA, 20 bp, synthetic construct
  misc_feature 1..20: note = CRISPR gRNA sequence
  source 1..20: mol_type = other DNA
accccttccccaggctgcgg

SEQ ID NO: 10907 - DNA, 20 bp, synthetic construct
  misc_feature 1..20: note = CRISPR gRNA sequence
  source 1..20: mol_type = other DNA
ccccttccccaggctgcggc

SEQ ID NO: 10908 - DNA, 20 bp, synthetic construct
  misc_feature 1..20: note = CRISPR gRNA sequence
  source 1..20: mol_type = other DNA
ccttccccaggctgcggcgg

SEQ ID NO: 10909 - DNA, 20 bp, synthetic construct
  misc_feature 1..20: note = CRISPR gRNA sequence
  source 1..20: mol_type = other DNA
tccccaggctgcggcgggag

SEQ ID NO: 10910 - DNA, 20 bp, synthetic construct
  misc_feature 1..20: note = CRISPR gRNA sequence
  source 1..20: mol_type = other DNA
ccccaggctgcggcgggaga

SEQ ID NO: 10911 - DNA, 20 bp, synthetic construct
  misc_feature 1..20: note = CRISPR gRNA sequence
  source 1..20: mol_type = other DNA
cccaggctgcggcgggagaa

SEQ ID NO: 10912 - DNA, 20 bp, synthetic construct
  misc_feature 1..20: note = CRISPR gRNA sequence
  source 1..20: mol_type = other DNA
cggcgggagaagggtatctg

SEQ ID NO: 10913 - DNA, 20 bp, synthetic construct
  misc_feature 1..20: note = CRISPR gRNA sequence
  source 1..20: mol_type = other DNA
agaagggtatctgtggatgt

SEQ ID NO: 10914 - DNA, 20 bp, synthetic construct
  misc_feature 1..20: note = CRISPR gRNA sequence
  source 1..20: mol_type = other DNA
gaagggtatctgtggatgtt

SEQ ID NO: 10915 - DNA, 20 bp, synthetic construct
  misc_feature 1..20: note = CRISPR gRNA sequence
  source 1..20: mol_type = other DNA
gggtatctgtggatgttggg

SEQ ID NO: 10916 - DNA, 20 bp, synthetic construct
  misc_feature 1..20: note = CRISPR gRNA sequence
  source 1..20: mol_type = other DNA
gtatctgtggatgttgggaa

SEQ ID NO: 10917 - DNA, 20 bp, synthetic construct
  misc_feature 1..20: note = CRISPR gRNA sequence
  source 1..20: mol_type = other DNA
ctgtggatgttgggaagagt

SEQ ID NO: 10918 - DNA, 20 bp, synthetic construct
  misc_feature 1..20: note = CRISPR gRNA sequence
  source 1..20: mol_type = other DNA
atgttgggaagagtaagaac

SEQ ID NO: 10919 - DNA, 20 bp, synthetic construct
  misc_feature 1..20: note = CRISPR gRNA sequence
  source 1..20: mol_type = other DNA
gtaagaactggctccctact

SEQ ID NO: 10920 - DNA, 20 bp, synthetic construct
  misc_feature 1..20: note = CRISPR gRNA sequence
  source 1..20: mol_type = other DNA
aagaactggctccctactta

SEQ ID NO: 10921 - DNA, 20 bp, synthetic construct
  misc_feature 1..20: note = CRISPR gRNA sequence
  source 1..20: mol_type = other DNA
ggctccctacttagagacaa

SEQ ID NO: 10922 - DNA, 20 bp, synthetic construct
  misc_feature 1..20: note = CRISPR gRNA sequence
  source 1..20: mol_type = other DNA
ccctacttagagacaaaagc

SEQ ID NO: 10923 - DNA, 20 bp, synthetic construct
  misc_feature 1..20: note = CRISPR gRNA sequence
  source 1..20: mol_type = other DNA
cctacttagagacaaaagct

SEQ ID NO: 10924 - DNA, 20 bp, synthetic construct
  misc_feature 1..20: note = CRISPR gRNA sequence
  source 1..20: mol_type = other DNA
ctacttagagacaaaagctg

SEQ ID NO: 10925 - DNA, 20 bp, synthetic construct
  misc_feature 1..20: note = CRISPR gRNA sequence
  source 1..20: mol_type = other DNA
acttagagacaaaagctggg

SEQ ID NO: 10926 - DNA, 20 bp, synthetic construct
  misc_feature 1..20: note = CRISPR gRNA sequence
  source 1..20: mol_type = other DNA
gacaaaagctggggagcccc

SEQ ID NO: 10927 - DNA, 20 bp, synthetic construct
  misc_feature 1..20: note = CRISPR gRNA sequence
  source 1..20: mol_type = other DNA
aaagctggggagccccaaga

SEQ ID NO: 10928 - DNA, 20 bp, synthetic construct
  misc_feature 1..20: note = CRISPR gRNA sequence
  source 1..20: mol_type = other DNA
aagctggggagccccaagat

SEQ ID NO: 10929 - DNA, 20 bp, synthetic construct
  misc_feature 1..20: note = CRISPR gRNA sequence
  source 1..20: mol_type = other DNA
gctggggagccccaagatgg

SEQ ID NO: 10930 - DNA, 20 bp, synthetic construct
  misc_feature 1..20: note = CRISPR gRNA sequence
  source 1..20: mol_type = other DNA
ttttgttttttttctttttt

SEQ ID NO: 10931 - DNA, 20 bp, synthetic construct
  misc_feature 1..20: note = CRISPR gRNA sequence
  source 1..20: mol_type = other DNA
gttttttttcttttttgaga

SEQ ID NO: 10932 - DNA, 20 bp, synthetic construct
  misc_feature 1..20: note = CRISPR gRNA sequence
  source 1..20: mol_type = other DNA
ttttttttcttttttgagac

SEQ ID NO: 10933 - DNA, 20 bp, synthetic construct
  misc_feature 1..20: note = CRISPR gRNA sequence
  source 1..20: mol_type = other DNA
tttttttcttttttgagaca

SEQ ID NO: 10934 - DNA, 20 bp, synthetic construct
  misc_feature 1..20: note = CRISPR gRNA sequence
  source 1..20: mol_type = other DNA
gacagggtctcgctcttacc

SEQ ID NO: 10935 - DNA, 20 bp, synthetic construct
  misc_feature 1..20: note = CRISPR gRNA sequence
  source 1..20: mol_type = other DNA
acagggtctcgctcttaccc

SEQ ID NO: 10936 - DNA, 20 bp, synthetic construct
  misc_feature 1..20: note = CRISPR gRNA sequence
  source 1..20: mol_type = other DNA
ggtctcgctcttacccaggc

SEQ ID NO: 10937 - DNA, 20 bp, synthetic construct
  misc_feature 1..20: note = CRISPR gRNA sequence
  source 1..20: mol_type = other DNA
tctcgctcttacccaggctg

SEQ ID NO: 10938 - DNA, 20 bp, synthetic construct
  misc_feature 1..20: note = CRISPR gRNA sequence
  source 1..20: mol_type = other DNA
ctcttacccaggctggagtg

SEQ ID NO: 10939 - DNA, 20 bp, synthetic construct
  misc_feature 1..20: note = CRISPR gRNA sequence
  source 1..20: mol_type = other DNA
ttacccaggctggagtgcag

SEQ ID NO: 10940 - DNA, 20 bp, synthetic construct
  misc_feature 1..20: note = CRISPR gRNA sequence
  source 1..20: mol_type = other DNA
ggagtgcagtggtgtgatca

SEQ ID NO: 10941 - DNA, 20 bp, synthetic construct
  misc_feature 1..20: note = CRISPR gRNA sequence
  source 1..20: mol_type = other DNA
tcactgcatcctccacctcc

SEQ ID NO: 10942 - DNA, 20 bp, synthetic construct
  misc_feature 1..20: note = CRISPR gRNA sequence
  source 1..20: mol_type = other DNA
cactgcatcctccacctcct

SEQ ID NO: 10943 - DNA, 20 bp, synthetic construct
  misc_feature 1..20: note = CRISPR gRNA sequence
  source 1..20: mol_type = other DNA
atcctccacctcctgggctc

SEQ ID NO: 10944 - DNA, 20 bp, synthetic construct
  misc_feature 1..20: note = CRISPR gRNA sequence
  source 1..20: mol_type = other DNA
ctcaagcgatgcttccacct

SEQ ID NO: 10945 - DNA, 20 bp, synthetic construct
  misc_feature 1..20: note = CRISPR gRNA sequence
  source 1..20: mol_type = other DNA
tgcttccacctcagcctcct

SEQ ID NO: 10946 - DNA, 20 bp, synthetic construct
  misc_feature 1..20: note = CRISPR gRNA sequence
  source 1..20: mol_type = other DNA
ttccacctcagcctcctaag

SEQ ID NO: 10947 - DNA, 20 bp, synthetic construct
  misc_feature 1..20: note = CRISPR gRNA sequence
  source 1..20: mol_type = other DNA
cctcagcctcctaagaagct

SEQ ID NO: 10948 - DNA, 20 bp, synthetic construct
  misc_feature 1..20: note = CRISPR gRNA sequence
  source 1..20: mol_type = other DNA
ctcctaagaagctgagacca

SEQ ID NO: 10949 - DNA, 20 bp, synthetic construct
  misc_feature 1..20: note = CRISPR gRNA sequence
  source 1..20: mol_type = other DNA
tcctaagaagctgagaccac

SEQ ID NO: 10950 - DNA, 20 bp, synthetic construct
  misc_feature 1..20: note = CRISPR gRNA sequence
  source 1..20: mol_type = other DNA
acaggacacaccaccacact

SEQ ID NO: 10951 - DNA, 20 bp, synthetic construct
  misc_feature 1..20: note = CRISPR gRNA sequence
  source 1..20: mol_type = other DNA
gctaattattgtgttttttg

SEQ ID NO: 10952 - DNA, 20 bp, synthetic construct
  misc_feature 1..20: note = CRISPR gRNA sequence
  source 1..20: mol_type = other DNA
taattattgtgttttttgta

SEQ ID NO: 10953 - DNA, 20 bp, synthetic construct
  misc_feature 1..20: note = CRISPR gRNA sequence
  source 1..20: mol_type = other DNA
ttgtgttttttgtagagact

SEQ ID NO: 10954 - DNA, 20 bp, synthetic construct
  misc_feature 1..20: note = CRISPR gRNA sequence
  source 1..20: mol_type = other DNA
tgagtctcactatgttgccc

SEQ ID NO: 10955 - DNA, 20 bp, synthetic construct
  misc_feature 1..20: note = CRISPR gRNA sequence
  source 1..20: mol_type = other DNA
tctcactatgttgcccaagc

SEQ ID NO: 10956 - DNA, 20 bp, synthetic construct
  misc_feature 1..20: note = CRISPR gRNA sequence
  source 1..20: mol_type = other DNA
ccaagctggtcttgaactcc

SEQ ID NO: 10957 - DNA, 20 bp, synthetic construct
  misc_feature 1..20: note = CRISPR gRNA sequence
  source 1..20: mol_type = other DNA
caagctggtcttgaactcct

SEQ ID NO: 10958 - DNA, 20 bp, synthetic construct
  misc_feature 1..20: note = CRISPR gRNA sequence
  source 1..20: mol_type = other DNA
ggtcttgaactcctgggctc

SEQ ID NO: 10959 - DNA, 20 bp, synthetic construct
  misc_feature 1..20: note = CRISPR gRNA sequence
  source 1..20: mol_type = other DNA
cttgaactcctgggctcaag

SEQ ID NO: 10960 - DNA, 20 bp, synthetic construct
  misc_feature 1..20: note = CRISPR gRNA sequence
  source 1..20: mol_type = other DNA
ctcaagcagtcctcttacct

SEQ ID NO: 10961 - DNA, 20 bp, synthetic construct
  misc_feature 1..20: note = CRISPR gRNA sequence
  source 1..20: mol_type = other DNA
accttggcctcccaaaatgc

SEQ ID NO: 10962 - DNA, 20 bp, synthetic construct
  misc_feature 1..20: note = CRISPR gRNA sequence
  source 1..20: mol_type = other DNA
ctcccaaaatgctggaatta

SEQ ID NO: 10963 - DNA, 20 bp, synthetic construct
  misc_feature 1..20: note = CRISPR gRNA sequence
  source 1..20: mol_type = other DNA
aatgctggaattacagacat

SEQ ID NO: 10964 - DNA, 20 bp, synthetic construct
  misc_feature 1..20: note = CRISPR gRNA sequence
  source 1..20: mol_type = other DNA
cagacatgagccactgttcc

SEQ ID NO: 10965 - DNA, 20 bp, synthetic construct
  misc_feature 1..20: note = CRISPR gRNA sequence
  source 1..20: mol_type = other DNA
ccactgttcccagcctcaac

SEQ ID NO: 10966 - DNA, 20 bp, synthetic construct
  misc_feature 1..20: note = CRISPR gRNA sequence
  source 1..20: mol_type = other DNA
cagcctcaactggcctctta

SEQ ID NO: 10967 - DNA, 20 bp, synthetic construct
  misc_feature 1..20: note = CRISPR gRNA sequence
  source 1..20: mol_type = other DNA
agcctcaactggcctcttat

SEQ ID NO: 10968 - DNA, 20 bp, synthetic construct
  misc_feature 1..20: note = CRISPR gRNA sequence
  source 1..20: mol_type = other DNA
gcctcaactggcctcttatg

SEQ ID NO: 10969 - DNA, 20 bp, synthetic construct
  misc_feature 1..20: note = CRISPR gRNA sequence
  source 1..20: mol_type = other DNA
cctcaactggcctcttatgg

SEQ ID NO: 10970 - DNA, 20 bp, synthetic construct
  misc_feature 1..20: note = CRISPR gRNA sequence
  source 1..20: mol_type = other DNA
ctcaactggcctcttatggg

SEQ ID NO: 10971 - DNA, 20 bp, synthetic construct
  misc_feature 1..20: note = CRISPR gRNA sequence
  source 1..20: mol_type = other DNA
ggggctatgaaatctacccc

SEQ ID NO: 10972 - DNA, 20 bp, synthetic construct
  misc_feature 1..20: note = CRISPR gRNA sequence
  source 1..20: mol_type = other DNA
gctatgaaatctaccccaag

SEQ ID NO: 10973 - DNA, 20 bp, synthetic construct
  misc_feature 1..20: note = CRISPR gRNA sequence
  source 1..20: mol_type = other DNA
gaaatctaccccaagcagaa

SEQ ID NO: 10974 - DNA, 20 bp, synthetic construct
  misc_feature 1..20: note = CRISPR gRNA sequence
  source 1..20: mol_type = other DNA
ctaccccaagcagaaaagat

SEQ ID NO: 10975 - DNA, 20 bp, synthetic construct
  misc_feature 1..20: note = CRISPR gRNA sequence
  source 1..20: mol_type = other DNA
taccccaagcagaaaagatt

SEQ ID NO: 10976 - DNA, 20 bp, synthetic construct
  misc_feature 1..20: note = CRISPR gRNA sequence
  source 1..20: mol_type = other DNA
accccaagcagaaaagattg

SEQ ID NO: 10977 - DNA, 20 bp, synthetic construct
  misc_feature 1..20: note = CRISPR gRNA sequence
  source 1..20: mol_type = other DNA
gaaaagattggggtcctacg

SEQ ID NO: 10978 - DNA, 20 bp, synthetic construct
  misc_feature 1..20: note = CRISPR gRNA sequence
  source 1..20: mol_type = other DNA
aagattggggtcctacgtgg

SEQ ID NO: 10979 - DNA, 20 bp, synthetic construct
  misc_feature 1..20: note = CRISPR gRNA sequence
  source 1..20: mol_type = other DNA
agattggggtcctacgtgga

SEQ ID NO: 10980 - DNA, 20 bp, synthetic construct
  misc_feature 1..20: note = CRISPR gRNA sequence
  source 1..20: mol_type = other DNA
gattggggtcctacgtggaa

SEQ ID NO: 10981 - DNA, 20 bp, synthetic construct
  misc_feature 1..20: note = CRISPR gRNA sequence
  source 1..20: mol_type = other DNA
ggtcctacgtggaagggttg

SEQ ID NO: 10982 - DNA, 20 bp, synthetic construct
  misc_feature 1..20: note = CRISPR gRNA sequence
  source 1..20: mol_type = other DNA
gtcctacgtggaagggttgc

SEQ ID NO: 10983 - DNA, 20 bp, synthetic construct
  misc_feature 1..20: note = CRISPR gRNA sequence
  source 1..20: mol_type = other DNA
tcctacgtggaagggttgca

SEQ ID NO: 10984 - DNA, 20 bp, synthetic construct
  misc_feature 1..20: note = CRISPR gRNA sequence
  source 1..20: mol_type = other DNA
tggaagggttgcagggacct

SEQ ID NO: 10985 - DNA, 20 bp, synthetic construct
  misc_feature 1..20: note = CRISPR gRNA sequence
  source 1..20: mol_type = other DNA
gaagggttgcagggacctaa

SEQ ID NO: 10986 - DNA, 20 bp, synthetic construct
  misc_feature 1..20: note = CRISPR gRNA sequence
  source 1..20: mol_type = other DNA
aagggttgcagggacctaag

SEQ ID NO: 10987 - DNA, 20 bp, synthetic construct
  misc_feature 1..20: note = CRISPR gRNA sequence
  source 1..20: mol_type = other DNA
gttgcagggacctaagaggc

SEQ ID NO: 10988 - DNA, 20 bp, synthetic construct
  misc_feature 1..20: note = CRISPR gRNA sequence
  source 1..20: mol_type = other DNA
ttgcagggacctaagaggct

SEQ ID NO: 10989 - DNA, 20 bp, synthetic construct
  misc_feature 1..20: note = CRISPR gRNA sequence
  source 1..20: mol_type = other DNA
tgcagggacctaagaggctg

SEQ ID NO: 10990 - DNA, 20 bp, synthetic construct
  misc_feature 1..20: note = CRISPR gRNA sequence
  source 1..20: mol_type = other DNA
agggacctaagaggctgggg

SEQ ID NO: 10991 - DNA, 20 bp, synthetic construct
  misc_feature 1..20: note = CRISPR gRNA sequence
  source 1..20: mol_type = other DNA
gacctaagaggctggggtgg

SEQ ID NO: 10992 - DNA, 20 bp, synthetic construct
  misc_feature 1..20: note = CRISPR gRNA sequence
  source 1..20: mol_type = other DNA
acctaagaggctggggtgga

SEQ ID NO: 10993 - DNA, 20 bp, synthetic construct
  misc_feature 1..20: note = CRISPR gRNA sequence
  source 1..20: mol_type = other DNA
cctaagaggctggggtggaa

SEQ ID NO: 10994 - DNA, 20 bp, synthetic construct
  misc_feature 1..20: note = CRISPR gRNA sequence
  source 1..20: mol_type = other DNA
aagaggctggggtggaaggg

SEQ ID NO: 10995 - DNA, 20 bp, synthetic construct
  misc_feature 1..20: note = CRISPR gRNA sequence
  source 1..20: mol_type = other DNA
gaggctggggtggaagggaa

SEQ ID NO: 10996 - DNA, 20 bp, synthetic construct
  misc_feature 1..20: note = CRISPR gRNA sequence
  source 1..20: mol_type = other DNA
aggctggggtggaagggaag

SEQ ID NO: 10997 - DNA, 20 bp, synthetic construct
  misc_feature 1..20: note = CRISPR gRNA sequence
  source 1..20: mol_type = other DNA
gctggggtggaagggaagag

SEQ ID NO: 10998 - DNA, 20 bp, synthetic construct
  misc_feature 1..20: note = CRISPR gRNA sequence
  source 1..20: mol_type = other DNA
ctggggtggaagggaagagg

SEQ ID NO: 10999 - DNA, 20 bp, synthetic construct
  misc_feature 1..20: note = CRISPR gRNA sequence
  source 1..20: mol_type = other DNA
tggggtggaagggaagagga

SEQ ID NO: 11000 - DNA, 20 bp, synthetic construct
  misc_feature 1..20: note = CRISPR gRNA sequence
  source 1..20: mol_type = other DNA
ggggtggaagggaagaggag

SEQ ID NO: 11001 - DNA, 20 bp, synthetic construct
  misc_feature 1..20: note = CRISPR gRNA sequence
  source 1..20: mol_type = other DNA
gaagggaagaggaggggcct

SEQ ID NO: 11002 - DNA, 20 bp, synthetic construct
  misc_feature 1..20: note = CRISPR gRNA sequence
  source 1..20: mol_type = other DNA
ggaagaggaggggcctcaga

SEQ ID NO: 11003 - DNA, 20 bp, synthetic construct
  misc_feature 1..20: note = CRISPR gRNA sequence
  source 1..20: mol_type = other DNA
gaagaggaggggcctcagac

SEQ ID NO: 11004 - DNA, 20 bp, synthetic construct
  misc_feature 1..20: note = CRISPR gRNA sequence
  source 1..20: mol_type = other DNA
gccttgtctctgccccaccc

SEQ ID NO: 11005 - DNA, 20 bp, synthetic construct
  misc_feature 1..20: note = CRISPR gRNA sequence
  source 1..20: mol_type = other DNA
ccttgtctctgccccaccct

SEQ ID NO: 11006 - DNA, 20 bp, synthetic construct
  misc_feature 1..20: note = CRISPR gRNA sequence
  source 1..20: mol_type = other DNA
cttgtctctgccccaccctg

SEQ ID NO: 11007 - DNA, 20 bp, synthetic construct
  misc_feature 1..20: note = CRISPR gRNA sequence
  source 1..20: mol_type = other DNA
gccccaccctggggctgaat

SEQ ID NO: 11008 - DNA, 20 bp, synthetic construct
  misc_feature 1..20: note = CRISPR gRNA sequence
  source 1..20: mol_type = other DNA
ccccaccctggggctgaatg

SEQ ID NO: 11009 - DNA, 20 bp, synthetic construct
  misc_feature 1..20: note = CRISPR gRNA sequence
  source 1..20: mol_type = other DNA
cccaccctggggctgaatga

SEQ ID NO: 11010 - DNA, 20 bp, synthetic construct
  misc_feature 1..20: note = CRISPR gRNA sequence
  source 1..20: mol_type = other DNA
ccaccctggggctgaatgag

SEQ ID NO: 11011 - DNA, 20 bp, synthetic construct
  misc_feature 1..20: note = CRISPR gRNA sequence
  source 1..20: mol_type = other DNA
tgaggggctgtgactgtgac

SEQ ID NO: 11012 - DNA, 20 bp, synthetic construct
  misc_feature 1..20: note = CRISPR gRNA sequence
  source 1..20: mol_type = other DNA
aggggctgtgactgtgactg

SEQ ID NO: 11013 - DNA, 20 bp, synthetic construct
  misc_feature 1..20: note = CRISPR gRNA sequence
  source 1..20: mol_type = other DNA
ggggctgtgactgtgactgg

SEQ ID NO: 11014 - DNA, 20 bp, synthetic construct
  misc_feature 1..20: note = CRISPR gRNA sequence
  source 1..20: mol_type = other DNA
tacccttgctctttgcctcc

SEQ ID NO: 11015 - DNA, 20 bp, synthetic construct
  misc_feature 1..20: note = CRISPR gRNA sequence
  source 1..20: mol_type = other DNA
acccttgctctttgcctcct

SEQ ID NO: 11016 - DNA, 20 bp, synthetic construct
  misc_feature 1..20: note = CRISPR gRNA sequence
  source 1..20: mol_type = other DNA
ttgctctttgcctcctaggc

SEQ ID NO: 11017 - DNA, 20 bp, synthetic construct
  misc_feature 1..20: note = CRISPR gRNA sequence
  source 1..20: mol_type = other DNA
tgctctttgcctcctaggct

SEQ ID NO: 11018 - DNA, 20 bp, synthetic construct
  misc_feature 1..20: note = CRISPR gRNA sequence
  source 1..20: mol_type = other DNA
tcctaggctgggccctgtct

SEQ ID NO: 11019 - DNA, 20 bp, synthetic construct
  misc_feature 1..20: note = CRISPR gRNA sequence
  source 1..20: mol_type = other DNA
cctaggctgggccctgtctc

SEQ ID NO: 11020 - DNA, 20 bp, synthetic construct
  misc_feature 1..20: note = CRISPR gRNA sequence
  source 1..20: mol_type = other DNA
tgggccctgtctcaggcccc

SEQ ID NO: 11021 - DNA, 20 bp, synthetic construct
  misc_feature 1..20: note = CRISPR gRNA sequence
  source 1..20: mol_type = other DNA
gggccctgtctcaggccccc

SEQ ID NO: 11022 - DNA, 20 bp, synthetic construct
  misc_feature 1..20: note = CRISPR gRNA sequence
  source 1..20: mol_type = other DNA
cccccaggctttccccaaac

SEQ ID NO: 11023 - DNA, 20 bp, synthetic construct
  misc_feature 1..20: note = CRISPR gRNA sequence
  source 1..20: mol_type = other DNA
aggctttccccaaactggtg

SEQ ID NO: 11024 - DNA, 20 bp, synthetic construct
  misc_feature 1..20: note = CRISPR gRNA sequence
  source 1..20: mol_type = other DNA
caaactggtgcggatcctca

SEQ ID NO: 11025 - DNA, 20 bp, synthetic construct
  misc_feature 1..20: note = CRISPR gRNA sequence
  source 1..20: mol_type = other DNA
tcacggccttttcctccctg

SEQ ID NO: 11026 - DNA, 20 bp, synthetic construct
  misc_feature 1..20: note = CRISPR gRNA sequence
  source 1..20: mol_type = other DNA
cttttcctccctgcagcatc

SEQ ID NO: 11027 - DNA, 20 bp, synthetic construct
  misc_feature 1..20: note = CRISPR gRNA sequence
  source 1..20: mol_type = other DNA
tttcctccctgcagcatctg

SEQ ID NO: 11028 - DNA, 20 bp, synthetic construct
  misc_feature 1..20: note = CRISPR gRNA sequence
  source 1..20: mol_type = other DNA
ctccctgcagcatctggagt

SEQ ID NO: 11029 - DNA, 20 bp, synthetic construct
  misc_feature 1..20: note = CRISPR gRNA sequence
  source 1..20: mol_type = other DNA
tgcagcatctggagtgagta

SEQ ID NO: 11030 - DNA, 20 bp, synthetic construct
  misc_feature 1..20: note = CRISPR gRNA sequence
  source 1..20: mol_type = other DNA
tctggagtgagtatagactc

SEQ ID NO: 11031 - DNA, 20 bp, synthetic construct
  misc_feature 1..20: note = CRISPR gRNA sequence
  source 1..20: mol_type = other DNA
ctggagtgagtatagactct

SEQ ID NO: 11032 - DNA, 20 bp, synthetic construct
  misc_feature 1..20: note = CRISPR gRNA sequence
  source 1..20: mol_type = other DNA
gaccccttcctctcaacatc

SEQ ID NO: 11033 - DNA, 20 bp, synthetic construct
  misc_feature 1..20: note = CRISPR gRNA sequence
  source 1..20: mol_type = other DNA
accccttcctctcaacatct

SEQ ID NO: 11034 - DNA, 20 bp, synthetic construct
  misc_feature 1..20: note = CRISPR gRNA sequence
  source 1..20: mol_type = other DNA
ttcctctcaacatctgggtg

SEQ ID NO: 11035 - DNA, 20 bp, synthetic construct
  misc_feature 1..20: note = CRISPR gRNA sequence
  source 1..20: mol_type = other DNA
tgggtgcagtgctgtgatca

SEQ ID NO: 11036 - DNA, 20 bp, synthetic construct
  misc_feature 1..20: note = CRISPR gRNA sequence
  source 1..20: mol_type = other DNA
gctgtgatcatagctcactg

SEQ ID NO: 11037 - DNA, 20 bp, synthetic construct
  misc_feature 1..20: note = CRISPR gRNA sequence
  source 1..20: mol_type = other DNA
tcactgcagcctcgaattcc

SEQ ID NO: 11038 - DNA, 20 bp, synthetic construct
  misc_feature 1..20: note = CRISPR gRNA sequence
  source 1..20: mol_type = other DNA
agcctcgaattcctggcctc

SEQ ID NO: 11039 - DNA, 20 bp, synthetic construct
  misc_feature 1..20: note = CRISPR gRNA sequence
  source 1..20: mol_type = other DNA
ctcgaattcctggcctcaag

SEQ ID NO: 11040 - DNA, 20 bp, synthetic construct
  misc_feature 1..20: note = CRISPR gRNA sequence
  source 1..20: mol_type = other DNA
ctcaagtagtcctcctgcct

SEQ ID NO: 11041 - DNA, 20 bp, synthetic construct
  misc_feature 1..20: note = CRISPR gRNA sequence
  source 1..20: mol_type = other DNA
tcctcctgcctcagcctcct

SEQ ID NO: 11042 - DNA, 20 bp, synthetic construct
  misc_feature 1..20: note = CRISPR gRNA sequence
  source 1..20: mol_type = other DNA
tcctgcctcagcctcctgag

SEQ ID NO: 11043 - DNA, 20 bp, synthetic construct
  misc_feature 1..20: note = CRISPR gRNA sequence
  source 1..20: mol_type = other DNA
gcctcagcctcctgagtagc

SEQ ID NO: 11044 - DNA, 20 bp, synthetic construct
  misc_feature 1..20: note = CRISPR gRNA sequence
  source 1..20: mol_type = other DNA
cctcagcctcctgagtagct

SEQ ID NO: 11045 - DNA, 20 bp, synthetic construct
  misc_feature 1..20: note = CRISPR gRNA sequence
  source 1..20: mol_type = other DNA
ctcctgagtagctgggacca

SEQ ID NO: 11046 - DNA, 20 bp, synthetic construct
  misc_feature 1..20: note = CRISPR gRNA sequence
  source 1..20: mol_type = other DNA
tcctgagtagctgggaccac

SEQ ID NO: 11047 - DNA, 20 bp, synthetic construct
  misc_feature 1..20: note = CRISPR gRNA sequence
  source 1..20: mol_type = other DNA
gggaccacaggtgcatgcta

SEQ ID NO: 11048 - DNA, 20 bp, synthetic construct
  misc_feature 1..20: note = CRISPR gRNA sequence
  source 1..20: mol_type = other DNA
caggtgcatgctacagtgcc

SEQ ID NO: 11049 - DNA, 20 bp, synthetic construct
  misc_feature 1..20: note = CRISPR gRNA sequence
  source 1..20: mol_type = other DNA
ctacagtgcccagcaacctc

SEQ ID NO: 11050 - DNA, 20 bp, synthetic construct
  misc_feature 1..20: note = CRISPR gRNA sequence
  source 1..20: mol_type = other DNA
tacagtgcccagcaacctct

SEQ ID NO: 11051 - DNA, 20 bp, synthetic construct
  misc_feature 1..20: note = CRISPR gRNA sequence
  source 1..20: mol_type = other DNA
caaccccaaatcctgccccc

SEQ ID NO: 11052 - DNA, 20 bp, synthetic construct
  misc_feature 1..20: note = CRISPR gRNA sequence
  source 1..20: mol_type = other DNA
aaccccaaatcctgccccca

SEQ ID NO: 11053 - DNA, 20 bp, synthetic construct
  misc_feature 1..20: note = CRISPR gRNA sequence
  source 1..20: mol_type = other DNA
tcctgcccccaaggcacctg

SEQ ID NO: 11054 - DNA, 20 bp, synthetic construct
  misc_feature 1..20: note = CRISPR gRNA sequence
  source 1..20: mol_type = other DNA
gcccccaaggcacctgcaga

SEQ ID NO: 11055 - DNA, 20 bp, synthetic construct
  misc_feature 1..20: note = CRISPR gRNA sequence
  source 1..20: mol_type = other DNA
caaggcacctgcagaaagaa

SEQ ID NO: 11056 - DNA, 20 bp, synthetic construct
  misc_feature 1..20: note = CRISPR gRNA sequence
  source 1..20: mol_type = other DNA
cgcctactgcatcctcaatg

SEQ ID NO: 11057 - DNA, 20 bp, synthetic construct
  misc_feature 1..20: note = CRISPR gRNA sequence
  source 1..20: mol_type = other DNA
tactgcatcctcaatgtggc

SEQ ID NO: 11058 - DNA, 20 bp, synthetic construct
  misc_feature 1..20: note = CRISPR gRNA sequence
  source 1..20: mol_type = other DNA
cctcaatgtggctggcacat

SEQ ID NO: 11059 - DNA, 20 bp, synthetic construct
  misc_feature 1..20: note = CRISPR gRNA sequence
  source 1..20: mol_type = other DNA
gtggctggcacatgagtgat

SEQ ID NO: 11060 - DNA, 20 bp, synthetic construct
  misc_feature 1..20: note = CRISPR gRNA sequence
  source 1..20: mol_type = other DNA
gtgatgagatgacgccacat

SEQ ID NO: 11061 - DNA, 20 bp, synthetic construct
  misc_feature 1..20: note = CRISPR gRNA sequence
  source 1..20: mol_type = other DNA
tgagatgacgccacatcaga

SEQ ID NO: 11062 - DNA, 20 bp, synthetic construct
  misc_feature 1..20: note = CRISPR gRNA sequence
  source 1..20: mol_type = other DNA
gagatgacgccacatcagat

SEQ ID NO: 11063 - DNA, 20 bp, synthetic construct
  misc_feature 1..20: note = CRISPR gRNA sequence
  source 1..20: mol_type = other DNA
ccacatcagatgggaatccc

SEQ ID NO: 11064 - DNA, 20 bp, synthetic construct
  misc_feature 1..20: note = CRISPR gRNA sequence
  source 1..20: mol_type = other DNA
ggaatccccagtgacaaaaa

SEQ ID NO: 11065 - DNA, 20 bp, synthetic construct
  misc_feature 1..20: note = CRISPR gRNA sequence
  source 1..20: mol_type = other DNA
cccagtgacaaaaaaagttg

SEQ ID NO: 11066 - DNA, 20 bp, synthetic construct
  misc_feature 1..20: note = CRISPR gRNA sequence
  source 1..20: mol_type = other DNA
acaacctcatttgctgctct

SEQ ID NO: 11067 - DNA, 20 bp, synthetic construct
  misc_feature 1..20: note = CRISPR gRNA sequence
  source 1..20: mol_type = other DNA
atttgctgctctcagcaatt

SEQ ID NO: 11068 - DNA, 20 bp, synthetic construct
  misc_feature 1..20: note = CRISPR gRNA sequence
  source 1..20: mol_type = other DNA
gctgctctcagcaattcagc

SEQ ID NO: 11069 - DNA, 20 bp, synthetic construct
  misc_feature 1..20: note = CRISPR gRNA sequence
  source 1..20: mol_type = other DNA
ctgctctcagcaattcagct

SEQ ID NO: 11070 - DNA, 20 bp, synthetic construct
  misc_feature 1..20: note = CRISPR gRNA sequence
  source 1..20: mol_type = other DNA
tgctctcagcaattcagctg

SEQ ID NO: 11071 - DNA, 20 bp, synthetic construct
  misc_feature 1..20: note = CRISPR gRNA sequence
  source 1..20: mol_type = other DNA
ctctcagcaattcagctggg

SEQ ID NO: 11072 - DNA, 20 bp, synthetic construct
  misc_feature 1..20: note = CRISPR gRNA sequence
  source 1..20: mol_type = other DNA
tctcagcaattcagctgggg

SEQ ID NO: 11073 - DNA, 20 bp, synthetic construct
  misc_feature 1..20: note = CRISPR gRNA sequence
  source 1..20: mol_type = other DNA
ctcagcaattcagctgggga

SEQ ID NO: 11074 - DNA, 20 bp, synthetic construct
  misc_feature 1..20: note = CRISPR gRNA sequence
  source 1..20: mol_type = other DNA
caattcagctggggagggat

SEQ ID NO: 11075 - DNA, 20 bp, synthetic construct
  misc_feature 1..20: note = CRISPR gRNA sequence
  source 1..20: mol_type = other DNA
aattcagctggggagggatt

SEQ ID NO: 11076 - DNA, 20 bp, synthetic construct
  misc_feature 1..20: note = CRISPR gRNA sequence
  source 1..20: mol_type = other DNA
attcagctggggagggattg

SEQ ID NO: 11077 - DNA, 20 bp, synthetic construct
  misc_feature 1..20: note = CRISPR gRNA sequence
  source 1..20: mol_type = other DNA
tcagctggggagggattggg

SEQ ID NO: 11078 - DNA, 20 bp, synthetic construct
  misc_feature 1..20: note = CRISPR gRNA sequence
  source 1..20: mol_type = other DNA
tggggagggattggggagca

SEQ ID NO: 11079 - DNA, 20 bp, synthetic construct
  misc_feature 1..20: note = CRISPR gRNA sequence
  source 1..20: mol_type = other DNA
gggagcatagtcctacttta

SEQ ID NO: 11080 - DNA, 20 bp, synthetic construct
  misc_feature 1..20: note = CRISPR gRNA sequence
  source 1..20: mol_type = other DNA
agcatagtcctactttacag

SEQ ID NO: 11081 - DNA, 20 bp, synthetic construct
  misc_feature 1..20: note = CRISPR gRNA sequence
  source 1..20: mol_type = other DNA
catagtcctactttacagtg

SEQ ID NO: 11082 - DNA, 20 bp, synthetic construct
  misc_feature 1..20: note = CRISPR gRNA sequence
  source 1..20: mol_type = other DNA
atagtcctactttacagtgg

SEQ ID NO: 11083 - DNA, 20 bp, synthetic construct
  misc_feature 1..20: note = CRISPR gRNA sequence
  source 1..20: mol_type = other DNA
cctactttacagtggaggtt

SEQ ID NO: 11084 - DNA, 20 bp, synthetic construct
  misc_feature 1..20: note = CRISPR gRNA sequence
  source 1..20: mol_type = other DNA
ctactttacagtggaggtta

SEQ ID NO: 11085 - DNA, 20 bp, synthetic construct
  misc_feature 1..20: note = CRISPR gRNA sequence
  source 1..20: mol_type = other DNA
ctttacagtggaggttaagg

SEQ ID NO: 11086 - DNA, 20 bp, synthetic construct
  misc_feature 1..20: note = CRISPR gRNA sequence
  source 1..20: mol_type = other DNA
tggaggttaaggaagttgcc

SEQ ID NO: 11087 - DNA, 20 bp, synthetic construct
  misc_feature 1..20: note = CRISPR gRNA sequence
  source 1..20: mol_type = other DNA
ttaaggaagttgccaagcct

SEQ ID NO: 11088 - DNA, 20 bp, synthetic construct
  misc_feature 1..20: note = CRISPR gRNA sequence
  source 1..20: mol_type = other DNA
taaggaagttgccaagcctc

SEQ ID NO: 11089 - DNA, 20 bp, synthetic construct
  misc_feature 1..20: note = CRISPR gRNA sequence
  source 1..20: mol_type = other DNA
aaggaagttgccaagcctca

SEQ ID NO: 11090 - DNA, 20 bp, synthetic construct
  misc_feature 1..20: note = CRISPR gRNA sequence
  source 1..20: mol_type = other DNA
aggaagttgccaagcctcag

SEQ ID NO: 11091 - DNA, 20 bp, synthetic construct
  misc_feature 1..20: note = CRISPR gRNA sequence
  source 1..20: mol_type = other DNA
gttgccaagcctcaggggct

SEQ ID NO: 11092 - DNA, 20 bp, synthetic construct
  misc_feature 1..20: note = CRISPR gRNA sequence
  source 1..20: mol_type = other DNA
gcctcaggggcttagttcct

SEQ ID NO: 11093 - DNA, 20 bp, synthetic construct
  misc_feature 1..20: note = CRISPR gRNA sequence
  source 1..20: mol_type = other DNA
tcaggggcttagttcctaag

SEQ ID NO: 11094 - DNA, 20 bp, synthetic construct
  misc_feature 1..20: note = CRISPR gRNA sequence
  source 1..20: mol_type = other DNA
ttagttcctaagaagctaaa

SEQ ID NO: 11095 - DNA, 20 bp, synthetic construct
  misc_feature 1..20: note = CRISPR gRNA sequence
  source 1..20: mol_type = other DNA
tagttcctaagaagctaaac

SEQ ID NO: 11096 - DNA, 20 bp, synthetic construct
  misc_feature 1..20: note = CRISPR gRNA sequence
  source 1..20: mol_type = other DNA
agttcctaagaagctaaaca

SEQ ID NO: 11097 - DNA, 20 bp, synthetic construct
  misc_feature 1..20: note = CRISPR gRNA sequence
  source 1..20: mol_type = other DNA
aagaagctaaacagggattc

SEQ ID NO: 11098 - DNA, 20 bp, synthetic construct
  misc_feature 1..20: note = CRISPR gRNA sequence
  source 1..20: mol_type = other DNA
cagggattcaagtccatcat

SEQ ID NO: 11099 - DNA, 20 bp, synthetic construct
  misc_feature 1..20: note = CRISPR gRNA sequence
  source 1..20: mol_type = other DNA
gattcaagtccatcatgagt

SEQ ID NO: 11100 - DNA, 20 bp, synthetic construct
  misc_feature 1..20: note = CRISPR gRNA sequence
  source 1..20: mol_type = other DNA
atgagttagactttgccctc

SEQ ID NO: 11101 - DNA, 20 bp, synthetic construct
  misc_feature 1..20: note = CRISPR gRNA sequence
  source 1..20: mol_type = other DNA
gactttgccctctggctgcc

SEQ ID NO: 11102 - DNA, 20 bp, synthetic construct
  misc_feature 1..20: note = CRISPR gRNA sequence
  source 1..20: mol_type = other DNA
ttgccctctggctgcctggt

SEQ ID NO: 11103 - DNA, 20 bp, synthetic construct
  misc_feature 1..20: note = CRISPR gRNA sequence
  source 1..20: mol_type = other DNA
gccctctggctgcctggttg

SEQ ID NO: 11104 - DNA, 20 bp, synthetic construct
  misc_feature 1..20: note = CRISPR gRNA sequence
  source 1..20: mol_type = other DNA
ggctgcctggttggagcccc

SEQ ID NO: 11105 - DNA, 20 bp, synthetic construct
  misc_feature 1..20: note = CRISPR gRNA sequence
  source 1..20: mol_type = other DNA
gctgcctggttggagccccc

SEQ ID NO: 11106 - DNA, 20 bp, synthetic construct
  misc_feature 1..20: note = CRISPR gRNA sequence
  source 1..20: mol_type = other DNA
gttggagcccccaggtgatg

SEQ ID NO: 11107 - DNA, 20 bp, synthetic construct
  misc_feature 1..20: note = CRISPR gRNA sequence
  source 1..20: mol_type = other DNA
tgatgaagtcctcgtctgaa

SEQ ID NO: 11108 - DNA, 20 bp, synthetic construct
  misc_feature 1..20: note = CRISPR gRNA sequence
  source 1..20: mol_type = other DNA
aagtcctcgtctgaaaagct

SEQ ID NO: 11109 - DNA, 20 bp, synthetic construct
  misc_feature 1..20: note = CRISPR gRNA sequence
  source 1..20: mol_type = other DNA
agtcctcgtctgaaaagctc

SEQ ID NO: 11110 - DNA, 20 bp, synthetic construct
  misc_feature 1..20: note = CRISPR gRNA sequence
  source 1..20: mol_type = other DNA
tgaaaagctcaggaatgtgc

SEQ ID NO: 11111 - DNA, 20 bp, synthetic construct
  misc_feature 1..20: note = CRISPR gRNA sequence
  source 1..20: mol_type = other DNA
aggaatgtgccggctgccta

SEQ ID NO: 11112 - DNA, 20 bp, synthetic construct
  misc_feature 1..20: note = CRISPR gRNA sequence
  source 1..20: mol_type = other DNA
gccggctgcctatggtgtat

SEQ ID NO: 11113 - DNA, 20 bp, synthetic construct
  misc_feature 1..20: note = CRISPR gRNA sequence
  source 1..20: mol_type = other DNA
cggctgcctatggtgtatta

SEQ ID NO: 11114 - DNA, 20 bp, synthetic construct
  misc_feature 1..20: note = CRISPR gRNA sequence
  source 1..20: mol_type = other DNA
tgcctatggtgtattagagc

SEQ ID NO: 11115 - DNA, 20 bp, synthetic construct
  misc_feature 1..20: note = CRISPR gRNA sequence
  source 1..20: mol_type = other DNA
gcctatggtgtattagagct

SEQ ID NO: 11116 - DNA, 20 bp, synthetic construct
  misc_feature 1..20: note = CRISPR gRNA sequence
  source 1..20: mol_type = other DNA
cctatggtgtattagagctg

SEQ ID NO: 11117 - DNA, 20 bp, synthetic construct
  misc_feature 1..20: note = CRISPR gRNA sequence
  source 1..20: mol_type = other DNA
ctatggtgtattagagctgg

SEQ ID NO: 11118 - DNA, 20 bp, synthetic construct
  misc_feature 1..20: note = CRISPR gRNA sequence
  source 1..20: mol_type = other DNA
tatggtgtattagagctggg

SEQ ID NO: 11119 - DNA, 20 bp, synthetic construct
  misc_feature 1..20: note = CRISPR gRNA sequence
  source 1..20: mol_type = other DNA
ggtgtattagagctgggggg

SEQ ID NO: 11120 - DNA, 20 bp, synthetic construct
  misc_feature 1..20: note = CRISPR gRNA sequence
  source 1..20: mol_type = other DNA
gtgtattagagctggggggt

SEQ ID NO: 11121 - DNA, 20 bp, synthetic construct
  misc_feature 1..20: note = CRISPR gRNA sequence
  source 1..20: mol_type = other DNA
tattagagctggggggtggg

SEQ ID NO: 11122 - DNA, 20 bp, synthetic construct
  misc_feature 1..20: note = CRISPR gRNA sequence
  source 1..20: mol_type = other DNA
attagagctggggggtggga

SEQ ID NO: 11123 - DNA, 20 bp, synthetic construct
  misc_feature 1..20: note = CRISPR gRNA sequence
  source 1..20: mol_type = other DNA
ttagagctggggggtgggaa

SEQ ID NO: 11124 - DNA, 20 bp, synthetic construct
  misc_feature 1..20: note = CRISPR gRNA sequence
  source 1..20: mol_type = other DNA
gagctggggggtgggaaggg

SEQ ID NO: 11125 - DNA, 20 bp, synthetic construct
  misc_feature 1..20: note = CRISPR gRNA sequence
  source 1..20: mol_type = other DNA
agctggggggtgggaagggc

SEQ ID NO: 11126 - DNA, 20 bp, synthetic construct
  misc_feature 1..20: note = CRISPR gRNA sequence
  source 1..20: mol_type = other DNA
ggggtgggaagggcaggtgc

SEQ ID NO: 11127 - DNA, 20 bp, synthetic construct
  misc_feature 1..20: note = CRISPR gRNA sequence
  source 1..20: mol_type = other DNA
gggtgggaagggcaggtgcc

SEQ ID NO: 11128 - DNA, 20 bp, synthetic construct
  misc_feature 1..20: note = CRISPR gRNA sequence
  source 1..20: mol_type = other DNA
ggtgggaagggcaggtgcca

SEQ ID NO: 11129 - DNA, 20 bp, synthetic construct
  misc_feature 1..20: note = CRISPR gRNA sequence
  source 1..20: mol_type = other DNA
gaagggcaggtgccagggct

SEQ ID NO: 11130 - DNA, 20 bp, synthetic construct
  misc_feature 1..20: note = CRISPR gRNA sequence
  source 1..20: mol_type = other DNA
aagggcaggtgccagggctg

SEQ ID NO: 11131 - DNA, 20 bp, synthetic construct
  misc_feature 1..20: note = CRISPR gRNA sequence
  source 1..20: mol_type = other DNA
gggcaggtgccagggctgag

SEQ ID NO: 11132 - DNA, 20 bp, synthetic construct
  misc_feature 1..20: note = CRISPR gRNA sequence
  source 1..20: mol_type = other DNA
ggcaggtgccagggctgagg

SEQ ID NO: 11133 - DNA, 20 bp, synthetic construct
  misc_feature 1..20: note = CRISPR gRNA sequence
  source 1..20: mol_type = other DNA
agggctgaggaggccctcac

SEQ ID NO: 11134 - DNA, 20 bp, synthetic construct
  misc_feature 1..20: note = CRISPR gRNA sequence
  source 1..20: mol_type = other DNA
gggctgaggaggccctcact

SEQ ID NO: 11135 - DNA, 20 bp, synthetic construct
  misc_feature 1..20: note = CRISPR gRNA sequence
  source 1..20: mol_type = other DNA
tgaggaggccctcactggga

SEQ ID NO: 11136 - DNA, 20 bp, synthetic construct
  misc_feature 1..20: note = CRISPR gRNA sequence
  source 1..20: mol_type = other DNA
gaggaggccctcactgggat

SEQ ID NO: 11137 - DNA, 20 bp, synthetic construct
  misc_feature 1..20: note = CRISPR gRNA sequence
  source 1..20: mol_type = other DNA
gaggccctcactgggatggg

SEQ ID NO: 11138 - DNA, 20 bp, synthetic construct
  misc_feature 1..20: note = CRISPR gRNA sequence
  source 1..20: mol_type = other DNA
aggccctcactgggatggga

SEQ ID NO: 11139 - DNA, 20 bp, synthetic construct
  misc_feature 1..20: note = CRISPR gRNA sequence
  source 1..20: mol_type = other DNA
ggccctcactgggatgggaa

SEQ ID NO: 11140 - DNA, 20 bp, synthetic construct
  misc_feature 1..20: note = CRISPR gRNA sequence
  source 1..20: mol_type = other DNA
ctcactgggatgggaagggt

SEQ ID NO: 11141 - DNA, 20 bp, synthetic construct
  misc_feature 1..20: note = CRISPR gRNA sequence
  source 1..20: mol_type = other DNA
ctgggatgggaagggtcaga

SEQ ID NO: 11142 - DNA, 20 bp, synthetic construct
  misc_feature 1..20: note = CRISPR gRNA sequence
  source 1..20: mol_type = other DNA
tgggaagggtcagatggccc

SEQ ID NO: 11143 - DNA, 20 bp, synthetic construct
  misc_feature 1..20: note = CRISPR gRNA sequence
  source 1..20: mol_type = other DNA
gggaagggtcagatggcccc

SEQ ID NO: 11144 - DNA, 20 bp, synthetic construct
  misc_feature 1..20: note = CRISPR gRNA sequence
  source 1..20: mol_type = other DNA
gtcagatggccccaggacgc

SEQ ID NO: 11145 - DNA, 20 bp, synthetic construct
  misc_feature 1..20: note = CRISPR gRNA sequence
  source 1..20: mol_type = other DNA
ggccccaggacgctagctga

SEQ ID NO: 11146 - DNA, 20 bp, synthetic construct
  misc_feature 1..20: note = CRISPR gRNA sequence
  source 1..20: mol_type = other DNA
cccccatctgattccacctg

SEQ ID NO: 11147 - DNA, 20 bp, synthetic construct
  misc_feature 1..20: note = CRISPR gRNA sequence
  source 1..20: mol_type = other DNA
atctgattccacctgcagcc

SEQ ID NO: 11148 - DNA, 20 bp, synthetic construct
  misc_feature 1..20: note = CRISPR gRNA sequence
  source 1..20: mol_type = other DNA
acctgcagcctggatgcgct

SEQ ID NO: 11149 - DNA, 20 bp, synthetic construct
  misc_feature 1..20: note = CRISPR gRNA sequence
  source 1..20: mol_type = other DNA
gcagcctggatgcgctgagt

SEQ ID NO: 11150 - DNA, 20 bp, synthetic construct
  misc_feature 1..20: note = CRISPR gRNA sequence
  source 1..20: mol_type = other DNA
tggatgcgctgagtgagaac

SEQ ID NO: 11151 - DNA, 20 bp, synthetic construct
  misc_feature 1..20: note = CRISPR gRNA sequence
  source 1..20: mol_type = other DNA
gcgctgagtgagaacaagat

SEQ ID NO: 11152 - DNA, 20 bp, synthetic construct
  misc_feature 1..20: note = CRISPR gRNA sequence
  source 1..20: mol_type = other DNA
cgctgagtgagaacaagatc

SEQ ID NO: 11153 - DNA, 20 bp, synthetic construct
  misc_feature 1..20: note = CRISPR gRNA sequence
  source 1..20: mol_type = other DNA
gctgagtgagaacaagatcg

SEQ ID NO: 11154 - DNA, 20 bp, synthetic construct
  misc_feature 1..20: note = CRISPR gRNA sequence
  source 1..20: mol_type = other DNA
gtgagaacaagatcggggac

SEQ ID NO: 11155 - DNA, 20 bp, synthetic construct
  misc_feature 1..20: note = CRISPR gRNA sequence
  source 1..20: mol_type = other DNA
tgagaacaagatcggggacg

SEQ ID NO: 11156 - DNA, 20 bp, synthetic construct
  misc_feature 1..20: note = CRISPR gRNA sequence
  source 1..20: mol_type = other DNA
gagaacaagatcggggacga

SEQ ID NO: 11157 - DNA, 20 bp, synthetic construct
  misc_feature 1..20: note = CRISPR gRNA sequence
  source 1..20: mol_type = other DNA
tcggggacgagggtgtctcg

SEQ ID NO: 11158 - DNA, 20 bp, synthetic construct
  misc_feature 1..20: note = CRISPR gRNA sequence
  source 1..20: mol_type = other DNA
cgagggtgtctcgcagctct

SEQ ID NO: 11159 - DNA, 20 bp, synthetic construct
  misc_feature 1..20: note = CRISPR gRNA sequence
  source 1..20: mol_type = other DNA
agctctcagccaccttcccc

SEQ ID NO: 11160 - DNA, 20 bp, synthetic construct
  misc_feature 1..20: note = CRISPR gRNA sequence
  source 1..20: mol_type = other DNA
cagccaccttcccccagctg

SEQ ID NO: 11161 - DNA, 20 bp, synthetic construct
  misc_feature 1..20: note = CRISPR gRNA sequence
  source 1..20: mol_type = other DNA
cttcccccagctgaagtcct

SEQ ID NO: 11162 - DNA, 20 bp, synthetic construct
  misc_feature 1..20: note = CRISPR gRNA sequence
  source 1..20: mol_type = other DNA
tgaagtccttggaaaccctc

SEQ ID NO: 11163 - DNA, 20 bp, synthetic construct
  misc_feature 1..20: note = CRISPR gRNA sequence
  source 1..20: mol_type = other DNA
gtccttggaaaccctcaagt

SEQ ID NO: 11164 - DNA, 20 bp, synthetic construct
  misc_feature 1..20: note = CRISPR gRNA sequence
  source 1..20: mol_type = other DNA
ttggaaaccctcaagtgagt

SEQ ID NO: 11165 - DNA, 20 bp, synthetic construct
  misc_feature 1..20: note = CRISPR gRNA sequence
  source 1..20: mol_type = other DNA
aaaccctcaagtgagtgagc

SEQ ID NO: 11166 - DNA, 20 bp, synthetic construct
  misc_feature 1..20: note = CRISPR gRNA sequence
  source 1..20: mol_type = other DNA
aaccctcaagtgagtgagct

SEQ ID NO: 11167 - DNA, 20 bp, synthetic construct
  misc_feature 1..20: note = CRISPR gRNA sequence
  source 1..20: mol_type = other DNA
gcctgcccttcctgctgaat

SEQ ID NO: 11168 - DNA, 20 bp, synthetic construct
  misc_feature 1..20: note = CRISPR gRNA sequence
  source 1..20: mol_type = other DNA
cctgcccttcctgctgaatc

SEQ ID NO: 11169 - DNA, 20 bp, synthetic construct
  misc_feature 1..20: note = CRISPR gRNA sequence
  source 1..20: mol_type = other DNA
cctgctgaatcgggccccca

SEQ ID NO: 11170 - DNA, 20 bp, synthetic construct
  misc_feature 1..20: note = CRISPR gRNA sequence
  source 1..20: mol_type = other DNA
tgaatcgggcccccaaagtc

SEQ ID NO: 11171 - DNA, 20 bp, synthetic construct
  misc_feature 1..20: note = CRISPR gRNA sequence
  source 1..20: mol_type = other DNA
ttaatttaaatttgtttttt

SEQ ID NO: 11172 - DNA, 20 bp, synthetic construct
  misc_feature 1..20: note = CRISPR gRNA sequence
  source 1..20: mol_type = other DNA
ttaaatttgtttttttagac

SEQ ID NO: 11173 - DNA, 20 bp, synthetic construct
  misc_feature 1..20: note = CRISPR gRNA sequence
  source 1..20: mol_type = other DNA
taaatttgtttttttagaca

SEQ ID NO: 11174 - DNA, 20 bp, synthetic construct
  misc_feature 1..20: note = CRISPR gRNA sequence
  source 1..20: mol_type = other DNA
aaatttgtttttttagacaa

SEQ ID NO: 11175 - DNA, 20 bp, synthetic construct
  misc_feature 1..20: note = CRISPR gRNA sequence
  source 1..20: mol_type = other DNA
caagggctcgctgtgtcacc

SEQ ID NO: 11176 - DNA, 20 bp, synthetic construct
  misc_feature 1..20: note = CRISPR gRNA sequence
  source 1..20: mol_type = other DNA
aagggctcgctgtgtcaccc

SEQ ID NO: 11177 - DNA, 20 bp, synthetic construct
  misc_feature 1..20: note = CRISPR gRNA sequence
  source 1..20: mol_type = other DNA
gctcgctgtgtcacccaggc

SEQ ID NO: 11178 - DNA, 20 bp, synthetic construct
  misc_feature 1..20: note = CRISPR gRNA sequence
  source 1..20: mol_type = other DNA
gtgtcacccaggctagaata

SEQ ID NO: 11179 - DNA, 20 bp, synthetic construct
  misc_feature 1..20: note = CRISPR gRNA sequence
  source 1..20: mol_type = other DNA
gtgctatgatcatacctctg

SEQ ID NO: 11180 - DNA, 20 bp, synthetic construct
  misc_feature 1..20: note = CRISPR gRNA sequence
  source 1..20: mol_type = other DNA
cctctgcagccttgaactcc

SEQ ID NO: 11181 - DNA, 20 bp, synthetic construct
  misc_feature 1..20: note = CRISPR gRNA sequence
  source 1..20: mol_type = other DNA
agccttgaactcctggcctc

SEQ ID NO: 11182 - DNA, 20 bp, synthetic construct
  misc_feature 1..20: note = CRISPR gRNA sequence
  source 1..20: mol_type = other DNA
gccttgaactcctggcctca

SEQ ID NO: 11183 - DNA, 20 bp, synthetic construct
  misc_feature 1..20: note = CRISPR gRNA sequence
  source 1..20: mol_type = other DNA
ctcctcacctccgcttccca

SEQ ID NO: 11184 - DNA, 20 bp, synthetic construct
  misc_feature 1..20: note = CRISPR gRNA sequence
  source 1..20: mol_type = other DNA
acctccgcttcccaaagtgc

SEQ ID NO: 11185 - DNA, 20 bp, synthetic construct
  misc_feature 1..20: note = CRISPR gRNA sequence
  source 1..20: mol_type = other DNA
cctccgcttcccaaagtgct

SEQ ID NO: 11186 - DNA, 20 bp, synthetic construct
  misc_feature 1..20: note = CRISPR gRNA sequence
  source 1..20: mol_type = other DNA
ttcccaaagtgctgggatta

SEQ ID NO: 11187 - DNA, 20 bp, synthetic construct
  misc_feature 1..20: note = CRISPR gRNA sequence
  source 1..20: mol_type = other DNA
tcccaaagtgctgggattat

SEQ ID NO: 11188 - DNA, 20 bp, synthetic construct
  misc_feature 1..20: note = CRISPR gRNA sequence
  source 1..20: mol_type = other DNA
taggtgtgacttaccatgcc

SEQ ID NO: 11189 - DNA, 20 bp, synthetic construct
  misc_feature 1..20: note = CRISPR gRNA sequence
  source 1..20: mol_type = other DNA
tgacttaccatgcccagccc

SEQ ID NO: 11190 - DNA, 20 bp, synthetic construct
  misc_feature 1..20: note = CRISPR gRNA sequence
  source 1..20: mol_type = other DNA
cttaccatgcccagccccag

SEQ ID NO: 11191 - DNA, 20 bp, synthetic construct
  misc_feature 1..20: note = CRISPR gRNA sequence
  source 1..20: mol_type = other DNA
cactcattcacctattcaat

SEQ ID NO: 11192 - DNA, 20 bp, synthetic construct
  misc_feature 1..20: note = CRISPR gRNA sequence
  source 1..20: mol_type = other DNA
gattcatccattcacttatg

SEQ ID NO: 11193 - DNA, 20 bp, synthetic construct
  misc_feature 1..20: note = CRISPR gRNA sequence
  source 1..20: mol_type = other DNA
aatttaatcaacaaatattt

SEQ ID NO: 11194 - DNA, 20 bp, synthetic construct
  misc_feature 1..20: note = CRISPR gRNA sequence
  source 1..20: mol_type = other DNA
atttaatcaacaaatattta

SEQ ID NO: 11195 - DNA, 20 bp, synthetic construct
  misc_feature 1..20: note = CRISPR gRNA sequence
  source 1..20: mol_type = other DNA
ttaatcaacaaatatttaag

SEQ ID NO: 11196 - DNA, 20 bp, synthetic construct
  misc_feature 1..20: note = CRISPR gRNA sequence
  source 1..20: mol_type = other DNA
taatcaacaaatatttaagg

SEQ ID NO: 11197 - DNA, 20 bp, synthetic construct
  misc_feature 1..20: note = CRISPR gRNA sequence
  source 1..20: mol_type = other DNA
taaggaggacctactatgtg

SEQ ID NO: 11198 - DNA, 20 bp, synthetic construct
  misc_feature 1..20: note = CRISPR gRNA sequence
  source 1..20: mol_type = other DNA
aaggaggacctactatgtgc

SEQ ID NO: 11199 - DNA, 20 bp, synthetic construct
  misc_feature 1..20: note = CRISPR gRNA sequence
  source 1..20: mol_type = other DNA
actatgtgcaggcacctttc

SEQ ID NO: 11200 - DNA, 20 bp, synthetic construct
  misc_feature 1..20: note = CRISPR gRNA sequence
  source 1..20: mol_type = other DNA
ctatgtgcaggcacctttct

SEQ ID NO: 11201 - DNA, 20 bp, synthetic construct
  misc_feature 1..20: note = CRISPR gRNA sequence
  source 1..20: mol_type = other DNA
gcaggcacctttctaggccc

SEQ ID NO: 11202 - DNA, 20 bp, synthetic construct
  misc_feature 1..20: note = CRISPR gRNA sequence
  source 1..20: mol_type = other DNA
aggcacctttctaggccctg

SEQ ID NO: 11203 - DNA, 20 bp, synthetic construct
  misc_feature 1..20: note = CRISPR gRNA sequence
  source 1..20: mol_type = other DNA
ctttctaggccctggagacc

SEQ ID NO: 11204 - DNA, 20 bp, synthetic construct
  misc_feature 1..20: note = CRISPR gRNA sequence
  source 1..20: mol_type = other DNA
acaaataaatcccctgacct

SEQ ID NO: 11205 - DNA, 20 bp, synthetic construct
  misc_feature 1..20: note = CRISPR gRNA sequence
  source 1..20: mol_type = other DNA
caaataaatcccctgacctc

SEQ ID NO: 11206 - DNA, 20 bp, synthetic construct
  misc_feature 1..20: note = CRISPR gRNA sequence
  source 1..20: mol_type = other DNA
acctcaggaatcttaaattc

SEQ ID NO: 11207 - DNA, 20 bp, synthetic construct
  misc_feature 1..20: note = CRISPR gRNA sequence
  source 1..20: mol_type = other DNA
caggaatcttaaattctagt

SEQ ID NO: 11208 - DNA, 20 bp, synthetic construct
  misc_feature 1..20: note = CRISPR gRNA sequence
  source 1..20: mol_type = other DNA
aggaatcttaaattctagtg

SEQ ID NO: 11209 - DNA, 20 bp, synthetic construct
  misc_feature 1..20: note = CRISPR gRNA sequence
  source 1..20: mol_type = other DNA
gaatcttaaattctagtgag

SEQ ID NO: 11210 - DNA, 20 bp, synthetic construct
  misc_feature 1..20: note = CRISPR gRNA sequence
  source 1..20: mol_type = other DNA
agtgaggagacacaatgaac

SEQ ID NO: 11211 - DNA, 20 bp, synthetic construct
  misc_feature 1..20: note = CRISPR gRNA sequence
  source 1..20: mol_type = other DNA
gacacaatgaacaagtaaac

SEQ ID NO: 11212 - DNA, 20 bp, synthetic construct
  misc_feature 1..20: note = CRISPR gRNA sequence
  source 1..20: mol_type = other DNA
caatgaacaagtaaacaagt

SEQ ID NO: 11213 - DNA, 20 bp, synthetic construct
  misc_feature 1..20: note = CRISPR gRNA sequence
  source 1..20: mol_type = other DNA
taaacaagtcggtaattata

SEQ ID NO: 11214 - DNA, 20 bp, synthetic construct
  misc_feature 1..20: note = CRISPR gRNA sequence
  source 1..20: mol_type = other DNA
gtcggtaattataaagtata

SEQ ID NO: 11215 - DNA, 20 bp, synthetic construct
  misc_feature 1..20: note = CRISPR gRNA sequence
  source 1..20: mol_type = other DNA
acagtaatgaaaataatgtt

SEQ ID NO: 11216 - DNA, 20 bp, synthetic construct
  misc_feature 1..20: note = CRISPR gRNA sequence
  source 1..20: mol_type = other DNA
atgaaaataatgtttggtga

SEQ ID NO: 11217 - DNA, 20 bp, synthetic construct
  misc_feature 1..20: note = CRISPR gRNA sequence
  source 1..20: mol_type = other DNA
ttggtgacagaaaattatac

SEQ ID NO: 11218 - DNA, 20 bp, synthetic construct
  misc_feature 1..20: note = CRISPR gRNA sequence
  source 1..20: mol_type = other DNA
tggtgacagaaaattatact

SEQ ID NO: 11219 - DNA, 20 bp, synthetic construct
  misc_feature 1..20: note = CRISPR gRNA sequence
  source 1..20: mol_type = other DNA
ggtgacagaaaattatactg

SEQ ID NO: 11220 - DNA, 20 bp, synthetic construct
  misc_feature 1..20: note = CRISPR gRNA sequence
  source 1..20: mol_type = other DNA
gtgacagaaaattatactgg

SEQ ID NO: 11221 - DNA, 20 bp, synthetic construct
  misc_feature 1..20: note = CRISPR gRNA sequence
  source 1..20: mol_type = other DNA
tgacagaaaattatactggg

SEQ ID NO: 11222 - DNA, 20 bp, synthetic construct
  misc_feature 1..20: note = CRISPR gRNA sequence
  source 1..20: mol_type = other DNA
aattatactggggggtgaaa

SEQ ID NO: 11223 - DNA, 20 bp, synthetic construct
  misc_feature 1..20: note = CRISPR gRNA sequence
  source 1..20: mol_type = other DNA
attatactggggggtgaaat

SEQ ID NO: 11224 - DNA, 20 bp, synthetic construct
  misc_feature 1..20: note = CRISPR gRNA sequence
  source 1..20: mol_type = other DNA
tatactggggggtgaaatag

SEQ ID NO: 11225 - DNA, 20 bp, synthetic construct
  misc_feature 1..20: note = CRISPR gRNA sequence
  source 1..20: mol_type = other DNA
tactggggggtgaaatagga

SEQ ID NO: 11226 - DNA, 20 bp, synthetic construct
  misc_feature 1..20: note = CRISPR gRNA sequence
  source 1..20: mol_type = other DNA
ggggggtgaaataggagaga

SEQ ID NO: 11227 - DNA, 20 bp, synthetic construct
  misc_feature 1..20: note = CRISPR gRNA sequence
  source 1..20: mol_type = other DNA
gtgaaataggagagatagat

SEQ ID NO: 11228 - DNA, 20 bp, synthetic construct
  misc_feature 1..20: note = CRISPR gRNA sequence
  source 1..20: mol_type = other DNA
tgaaataggagagatagatt

SEQ ID NO: 11229 - DNA, 20 bp, synthetic construct
  misc_feature 1..20: note = CRISPR gRNA sequence
  source 1..20: mol_type = other DNA
tagattaggatttatcaata

SEQ ID NO: 11230 - DNA, 20 bp, synthetic construct
  misc_feature 1..20: note = CRISPR gRNA sequence
  source 1..20: mol_type = other DNA
ataaagcattattatcaaaa

SEQ ID NO: 11231 - DNA, 20 bp, synthetic construct
  misc_feature 1..20: note = CRISPR gRNA sequence
  source 1..20: mol_type = other DNA
aaactttttaaaaactgttc

SEQ ID NO: 11232 - DNA, 20 bp, synthetic construct
  misc_feature 1..20: note = CRISPR gRNA sequence
  source 1..20: mol_type = other DNA
aactttttaaaaactgttct

SEQ ID NO: 11233 - DNA, 20 bp, synthetic construct
  misc_feature 1..20: note = CRISPR gRNA sequence
  source 1..20: mol_type = other DNA
ttaaaaactgttctgggctc

SEQ ID NO: 11234 - DNA, 20 bp, synthetic construct
  misc_feature 1..20: note = CRISPR gRNA sequence
  source 1..20: mol_type = other DNA
taaaaactgttctgggctct

SEQ ID NO: 11235 - DNA, 20 bp, synthetic construct
  misc_feature 1..20: note = CRISPR gRNA sequence
  source 1..20: mol_type = other DNA
aaactgttctgggctctggg

SEQ ID NO: 11236 - DNA, 20 bp, synthetic construct
  misc_feature 1..20: note = CRISPR gRNA sequence
  source 1..20: mol_type = other DNA
tgttctgggctctgggaagt

SEQ ID NO: 11237 - DNA, 20 bp, synthetic construct
  misc_feature 1..20: note = CRISPR gRNA sequence
  source 1..20: mol_type = other DNA
ttctgggctctgggaagttg

SEQ ID NO: 11238 - DNA, 20 bp, synthetic construct
  misc_feature 1..20: note = CRISPR gRNA sequence
  source 1..20: mol_type = other DNA
gggctctgggaagttggaga

SEQ ID NO: 11239 - DNA, 20 bp, synthetic construct
  misc_feature 1..20: note = CRISPR gRNA sequence
  source 1..20: mol_type = other DNA
ctgggaagttggagatggat

SEQ ID NO: 11240 - DNA, 20 bp, synthetic construct
  misc_feature 1..20: note = CRISPR gRNA sequence
  source 1..20: mol_type = other DNA
agttggagatggataagata

SEQ ID NO: 11241 - DNA, 20 bp, synthetic construct
  misc_feature 1..20: note = CRISPR gRNA sequence
  source 1..20: mol_type = other DNA
gttggagatggataagatac

SEQ ID NO: 11242 - DNA, 20 bp, synthetic construct
  misc_feature 1..20: note = CRISPR gRNA sequence
  source 1..20: mol_type = other DNA
tggagatggataagatacag

SEQ ID NO: 11243 - DNA, 20 bp, synthetic construct
  misc_feature 1..20: note = CRISPR gRNA sequence
  source 1..20: mol_type = other DNA
ggagatggataagatacagg

SEQ ID NO: 11244 - DNA, 20 bp, synthetic construct
  misc_feature 1..20: note = CRISPR gRNA sequence
  source 1..20: mol_type = other DNA
gtgattttttttcttttttt

SEQ ID NO: 11245 - DNA, 20 bp, synthetic construct
  misc_feature 1..20: note = CRISPR gRNA sequence
  source 1..20: mol_type = other DNA
tttttttctttttttcagac

SEQ ID NO: 11246 - DNA, 20 bp, synthetic construct
  misc_feature 1..20: note = CRISPR gRNA sequence
  source 1..20: mol_type = other DNA
ttttttctttttttcagaca

SEQ ID NO: 11247 - DNA, 20 bp, synthetic construct
  misc_feature 1..20: note = CRISPR gRNA sequence
  source 1..20: mol_type = other DNA
caaggtctcgctctgtcacc

SEQ ID NO: 11248 - DNA, 20 bp, synthetic construct
  misc_feature 1..20: note = CRISPR gRNA sequence
  source 1..20: mol_type = other DNA
aaggtctcgctctgtcaccc

SEQ ID NO: 11249 - DNA, 20 bp, synthetic construct
  misc_feature 1..20: note = CRISPR gRNA sequence
  source 1..20: mol_type = other DNA
aggtctcgctctgtcaccca

SEQ ID NO: 11250 - DNA, 20 bp, synthetic construct
  misc_feature 1..20: note = CRISPR gRNA sequence
  source 1..20: mol_type = other DNA
tctcgctctgtcacccaggg

SEQ ID NO: 11251 - DNA, 20 bp, synthetic construct
  misc_feature 1..20: note = CRISPR gRNA sequence
  source 1..20: mol_type = other DNA
tcgctctgtcacccagggtg

SEQ ID NO: 11252 - DNA, 20 bp, synthetic construct
  misc_feature 1..20: note = CRISPR gRNA sequence
  source 1..20: mol_type = other DNA
ctgtcacccagggtggagtg

SEQ ID NO: 11253 - DNA, 20 bp, synthetic construct
  misc_feature 1..20: note = CRISPR gRNA sequence
  source 1..20: mol_type = other DNA
tcacccagggtggagtgcag

SEQ ID NO: 11254 - DNA, 20 bp, synthetic construct
  misc_feature 1..20: note = CRISPR gRNA sequence
  source 1..20: mol_type = other DNA
ggagtgcagtggtgtaatca

SEQ ID NO: 11255 - DNA, 20 bp, synthetic construct
  misc_feature 1..20: note = CRISPR gRNA sequence
  source 1..20: mol_type = other DNA
ggtgtaatcatggctcactg

SEQ ID NO: 11256 - DNA, 20 bp, synthetic construct
  misc_feature 1..20: note = CRISPR gRNA sequence
  source 1..20: mol_type = other DNA
tcactgcagcctcaatctcc

SEQ ID NO: 11257 - DNA, 20 bp, synthetic construct
  misc_feature 1..20: note = CRISPR gRNA sequence
  source 1..20: mol_type = other DNA
cactgcagcctcaatctcct

SEQ ID NO: 11258 - DNA, 20 bp, synthetic construct
  misc_feature 1..20: note = CRISPR gRNA sequence
  source 1..20: mol_type = other DNA
agcctcaatctcctaggctc

SEQ ID NO: 11259 - DNA, 20 bp, synthetic construct
  misc_feature 1..20: note = CRISPR gRNA sequence
  source 1..20: mol_type = other DNA
tcctcccatctcaaccttct

SEQ ID NO: 11260 - DNA, 20 bp, synthetic construct
  misc_feature 1..20: note = CRISPR gRNA sequence
  source 1..20: mol_type = other DNA
tcccatctcaaccttctgag

SEQ ID NO: 11261 - DNA, 20 bp, synthetic construct
  misc_feature 1..20: note = CRISPR gRNA sequence
  source 1..20: mol_type = other DNA
atctcaaccttctgagtagc

SEQ ID NO: 11262 - DNA, 20 bp, synthetic construct
  misc_feature 1..20: note = CRISPR gRNA sequence
  source 1..20: mol_type = other DNA
tctcaaccttctgagtagct

SEQ ID NO: 11263 - DNA, 20 bp, synthetic construct
  misc_feature 1..20: note = CRISPR gRNA sequence
  source 1..20: mol_type = other DNA
aaccttctgagtagctggga

SEQ ID NO: 11264 - DNA, 20 bp, synthetic construct
  misc_feature 1..20: note = CRISPR gRNA sequence
  source 1..20: mol_type = other DNA
accttctgagtagctgggac

SEQ ID NO: 11265 - DNA, 20 bp, synthetic construct
  misc_feature 1..20: note = CRISPR gRNA sequence
  source 1..20: mol_type = other DNA
ctaatttttgtatttttttg

SEQ ID NO: 11266 - DNA, 20 bp, synthetic construct
  misc_feature 1..20: note = CRISPR gRNA sequence
  source 1..20: mol_type = other DNA
aatttttgtatttttttgta

SEQ ID NO: 11267 - DNA, 20 bp, synthetic construct
  misc_feature 1..20: note = CRISPR gRNA sequence
  source 1..20: mol_type = other DNA
tgtatttttttgtagagacg

SEQ ID NO: 11268 - DNA, 20 bp, synthetic construct
  misc_feature 1..20: note = CRISPR gRNA sequence
  source 1..20: mol_type = other DNA
cgtggtttcaccacgttgcc

SEQ ID NO: 11269 - DNA, 20 bp, synthetic construct
  misc_feature 1..20: note = CRISPR gRNA sequence
  source 1..20: mol_type = other DNA
gtggtttcaccacgttgccc

SEQ ID NO: 11270 - DNA, 20 bp, synthetic construct
  misc_feature 1..20: note = CRISPR gRNA sequence
  source 1..20: mol_type = other DNA
tttcaccacgttgcccaggc

SEQ ID NO: 11271 - DNA, 20 bp, synthetic construct
  misc_feature 1..20: note = CRISPR gRNA sequence
  source 1..20: mol_type = other DNA
caggctggtcttgaacttct

SEQ ID NO: 11272 - DNA, 20 bp, synthetic construct
  misc_feature 1..20: note = CRISPR gRNA sequence
  source 1..20: mol_type = other DNA
ggtcttgaacttctgagctc

SEQ ID NO: 11273 - DNA, 20 bp, synthetic construct
  misc_feature 1..20: note = CRISPR gRNA sequence
  source 1..20: mol_type = other DNA
cctcctgcctctgcctccca

SEQ ID NO: 11274 - DNA, 20 bp, synthetic construct
  misc_feature 1..20: note = CRISPR gRNA sequence
  source 1..20: mol_type = other DNA
gcctctgcctcccaaagtac

SEQ ID NO: 11275 - DNA, 20 bp, synthetic construct
  misc_feature 1..20: note = CRISPR gRNA sequence
  source 1..20: mol_type = other DNA
cctctgcctcccaaagtact

SEQ ID NO: 11276 - DNA, 20 bp, synthetic construct
  misc_feature 1..20: note = CRISPR gRNA sequence
  source 1..20: mol_type = other DNA
ctcccaaagtactgggatta

SEQ ID NO: 11277 - DNA, 20 bp, synthetic construct
  misc_feature 1..20: note = CRISPR gRNA sequence
  source 1..20: mol_type = other DNA
tcccaaagtactgggattac

SEQ ID NO: 11278 - DNA, 20 bp, synthetic construct
  misc_feature 1..20: note = CRISPR gRNA sequence
  source 1..20: mol_type = other DNA
agtactgggattacaggcat

SEQ ID NO: 11279 - DNA, 20 bp, synthetic construct
  misc_feature 1..20: note = CRISPR gRNA sequence
  source 1..20: mol_type = other DNA
caggcatgagtcactgtgcc

SEQ ID NO: 11280 - DNA, 20 bp, synthetic construct
  misc_feature 1..20: note = CRISPR gRNA sequence
  source 1..20: mol_type = other DNA
agtcactgtgcctggttcaa

SEQ ID NO: 11281 - DNA, 20 bp, synthetic construct
  misc_feature 1..20: note = CRISPR gRNA sequence
  source 1..20: mol_type = other DNA
gtcactgtgcctggttcaat

SEQ ID NO: 11282 - DNA, 20 bp, synthetic construct
  misc_feature 1..20: note = CRISPR gRNA sequence
  source 1..20: mol_type = other DNA
ttttttttttttttttgaca

SEQ ID NO: 11283 - DNA, 20 bp, synthetic construct
  misc_feature 1..20: note = CRISPR gRNA sequence
  source 1..20: mol_type = other DNA
ttttttttttttttgacacg

SEQ ID NO: 11284 - DNA, 20 bp, synthetic construct
  misc_feature 1..20: note = CRISPR gRNA sequence
  source 1..20: mol_type = other DNA
tgacacggagtctcgctctg

SEQ ID NO: 11285 - DNA, 20 bp, synthetic construct
  misc_feature 1..20: note = CRISPR gRNA sequence
  source 1..20: mol_type = other DNA
cggagtctcgctctgtagcc

SEQ ID NO: 11286 - DNA, 20 bp, synthetic construct
  misc_feature 1..20: note = CRISPR gRNA sequence
  source 1..20: mol_type = other DNA
ggagtctcgctctgtagccc

SEQ ID NO: 11287 - DNA, 20 bp, synthetic construct
  misc_feature 1..20: note = CRISPR gRNA sequence
  source 1..20: mol_type = other DNA
tctcgctctgtagcccaggc

SEQ ID NO: 11288 - DNA, 20 bp, synthetic construct
  misc_feature 1..20: note = CRISPR gRNA sequence
  source 1..20: mol_type = other DNA
tcgctctgtagcccaggctg

SEQ ID NO: 11289 - DNA, 20 bp, synthetic construct
  misc_feature 1..20: note = CRISPR gRNA sequence
  source 1..20: mol_type = other DNA
ctgtagcccaggctggagtg

SEQ ID NO: 11290 - DNA, 20 bp, synthetic construct
  misc_feature 1..20: note = CRISPR gRNA sequence
  source 1..20: mol_type = other DNA
tagcccaggctggagtgcag

SEQ ID NO: 11291 - DNA, 20 bp, synthetic construct
  misc_feature 1..20: note = CRISPR gRNA sequence
  source 1..20: mol_type = other DNA
ttattgcaaacttcacctcc

SEQ ID NO: 11292 - DNA, 20 bp, synthetic construct
  misc_feature 1..20: note = CRISPR gRNA sequence
  source 1..20: mol_type = other DNA
tattgcaaacttcacctcct

SEQ ID NO: 11293 - DNA, 20 bp, synthetic construct
  misc_feature 1..20: note = CRISPR gRNA sequence
  source 1..20: mol_type = other DNA
aaacttcacctcctgggttc

SEQ ID NO: 11294 - DNA, 20 bp, synthetic construct
  misc_feature 1..20: note = CRISPR gRNA sequence
  source 1..20: mol_type = other DNA
ttcaagcaattctcacacct

SEQ ID NO: 11295 - DNA, 20 bp, synthetic construct
  misc_feature 1..20: note = CRISPR gRNA sequence
  source 1..20: mol_type = other DNA
ttctcacacctcagcctccc

SEQ ID NO: 11296 - DNA, 20 bp, synthetic construct
  misc_feature 1..20: note = CRISPR gRNA sequence
  source 1..20: mol_type = other DNA
tcacacctcagcctcccaag

SEQ ID NO: 11297 - DNA, 20 bp, synthetic construct
  misc_feature 1..20: note = CRISPR gRNA sequence
  source 1..20: mol_type = other DNA
acctcagcctcccaagtagc

SEQ ID NO: 11298 - DNA, 20 bp, synthetic construct
  misc_feature 1..20: note = CRISPR gRNA sequence
  source 1..20: mol_type = other DNA
ctcccaagtagctggaatta

SEQ ID NO: 11299 - DNA, 20 bp, synthetic construct
  misc_feature 1..20: note = CRISPR gRNA sequence
  source 1..20: mol_type = other DNA
tcccaagtagctggaattac

SEQ ID NO: 11300 - DNA, 20 bp, synthetic construct
  misc_feature 1..20: note = CRISPR gRNA sequence
  source 1..20: mol_type = other DNA
ccaactaatttttgtatttt

SEQ ID NO: 11301 - DNA, 20 bp, synthetic construct
  misc_feature 1..20: note = CRISPR gRNA sequence
  source 1..20: mol_type = other DNA
actaatttttgtatttttag

SEQ ID NO: 11302 - DNA, 20 bp, synthetic construct
  misc_feature 1..20: note = CRISPR gRNA sequence
  source 1..20: mol_type = other DNA
taatttttgtatttttagta

SEQ ID NO: 11303 - DNA, 20 bp, synthetic construct
  misc_feature 1..20: note = CRISPR gRNA sequence
  source 1..20: mol_type = other DNA
ttttgtatttttagtagaga

SEQ ID NO: 11304 - DNA, 20 bp, synthetic construct
  misc_feature 1..20: note = CRISPR gRNA sequence
  source 1..20: mol_type = other DNA
tttgtatttttagtagagac

SEQ ID NO: 11305 - DNA, 20 bp, synthetic construct
  misc_feature 1..20: note = CRISPR gRNA sequence
  source 1..20: mol_type = other DNA
ttgtatttttagtagagacg

SEQ ID NO: 11306 - DNA, 20 bp, synthetic construct
  misc_feature 1..20: note = CRISPR gRNA sequence
  source 1..20: mol_type = other DNA
tagtagagacggggtttcac

SEQ ID NO: 11307 - DNA, 20 bp, synthetic construct
  misc_feature 1..20: note = CRISPR gRNA sequence
  source 1..20: mol_type = other DNA
agtagagacggggtttcacc

SEQ ID NO: 11308 - DNA, 20 bp, synthetic construct
  misc_feature 1..20: note = CRISPR gRNA sequence
  source 1..20: mol_type = other DNA
gagacggggtttcaccaggt

SEQ ID NO: 11309 - DNA, 20 bp, synthetic construct
  misc_feature 1..20: note = CRISPR gRNA sequence
  source 1..20: mol_type = other DNA
cggggtttcaccaggttggc

SEQ ID NO: 11310 - DNA, 20 bp, synthetic construct
  misc_feature 1..20: note = CRISPR gRNA sequence
  source 1..20: mol_type = other DNA
ggggtttcaccaggttggcc

SEQ ID NO: 11311 - DNA, 20 bp, synthetic construct
  misc_feature 1..20: note = CRISPR gRNA sequence
  source 1..20: mol_type = other DNA
tttcaccaggttggccaggc

SEQ ID NO: 11312 - DNA, 20 bp, synthetic construct
  misc_feature 1..20: note = CRISPR gRNA sequence
  source 1..20: mol_type = other DNA
ggtcttgaactcctgacctc

SEQ ID NO: 11313 - DNA, 20 bp, synthetic construct
  misc_feature 1..20: note = CRISPR gRNA sequence
  source 1..20: mol_type = other DNA
ctcaagtgatccgcccacct

SEQ ID NO: 11314 - DNA, 20 bp, synthetic construct
  misc_feature 1..20: note = CRISPR gRNA sequence
  source 1..20: mol_type = other DNA
ccgcccacctcagcctccca

SEQ ID NO: 11315 - DNA, 20 bp, synthetic construct
  misc_feature 1..20: note = CRISPR gRNA sequence
  source 1..20: mol_type = other DNA
acctcagcctcccaaagtgc

SEQ ID NO: 11316 - DNA, 20 bp, synthetic construct
  misc_feature 1..20: note = CRISPR gRNA sequence
  source 1..20: mol_type = other DNA
cctcagcctcccaaagtgct

SEQ ID NO: 11317 - DNA, 20 bp, synthetic construct
  misc_feature 1..20: note = CRISPR gRNA sequence
  source 1..20: mol_type = other DNA
tcccaaagtgctgggattac

SEQ ID NO: 11318 - DNA, 20 bp, synthetic construct
  misc_feature 1..20: note = CRISPR gRNA sequence
  source 1..20: mol_type = other DNA
agtgctgggattaccggcat

SEQ ID NO: 11319 - DNA, 20 bp, synthetic construct
  misc_feature 1..20: note = CRISPR gRNA sequence
  source 1..20: mol_type = other DNA
ccggcatgagccaccacgcc

SEQ ID NO: 11320 - DNA, 20 bp, synthetic construct
  misc_feature 1..20: note = CRISPR gRNA sequence
  source 1..20: mol_type = other DNA
acatgattttttactgaacc

SEQ ID NO: 11321 - DNA, 20 bp, synthetic construct
  misc_feature 1..20: note = CRISPR gRNA sequence
  source 1..20: mol_type = other DNA
atgattttttactgaaccta

SEQ ID NO: 11322 - DNA, 20 bp, synthetic construct
  misc_feature 1..20: note = CRISPR gRNA sequence
  source 1..20: mol_type = other DNA
tgattttttactgaacctag

SEQ ID NO: 11323 - DNA, 20 bp, synthetic construct
  misc_feature 1..20: note = CRISPR gRNA sequence
  source 1..20: mol_type = other DNA
ccacactccccctcacaacc

SEQ ID NO: 11324 - DNA, 20 bp, synthetic construct
  misc_feature 1..20: note = CRISPR gRNA sequence
  source 1..20: mol_type = other DNA
cacactccccctcacaacca

SEQ ID NO: 11325 - DNA, 20 bp, synthetic construct
  misc_feature 1..20: note = CRISPR gRNA sequence
  source 1..20: mol_type = other DNA
ccccctcacaaccaaggtct

SEQ ID NO: 11326 - DNA, 20 bp, synthetic construct
  misc_feature 1..20: note = CRISPR gRNA sequence
  source 1..20: mol_type = other DNA
cccctcacaaccaaggtctt

SEQ ID NO: 11327 - DNA, 20 bp, synthetic construct
  misc_feature 1..20: note = CRISPR gRNA sequence
  source 1..20: mol_type = other DNA
tcacaaccaaggtcttagga

SEQ ID NO: 11328 - DNA, 20 bp, synthetic construct
  misc_feature 1..20: note = CRISPR gRNA sequence
  source 1..20: mol_type = other DNA
aggatggccaaataatttac

SEQ ID NO: 11329 - DNA, 20 bp, synthetic construct
  misc_feature 1..20: note = CRISPR gRNA sequence
  source 1..20: mol_type = other DNA
ataatttaccggaatttact

SEQ ID NO: 11330 - DNA, 20 bp, synthetic construct
  misc_feature 1..20: note = CRISPR gRNA sequence
  source 1..20: mol_type = other DNA
cttagcaatttccttaattg

SEQ ID NO: 11331 - DNA, 20 bp, synthetic construct
  misc_feature 1..20: note = CRISPR gRNA sequence
  source 1..20: mol_type = other DNA
ttagcaatttccttaattgt

SEQ ID NO: 11332 - DNA, 20 bp, synthetic construct
  misc_feature 1..20: note = CRISPR gRNA sequence
  source 1..20: mol_type = other DNA
tttccttaattgtaggactg

SEQ ID NO: 11333 - DNA, 20 bp, synthetic construct
  misc_feature 1..20: note = CRISPR gRNA sequence
  source 1..20: mol_type = other DNA
ttccttaattgtaggactgt

SEQ ID NO: 11334 - DNA, 20 bp, synthetic construct
  misc_feature 1..20: note = CRISPR gRNA sequence
  source 1..20: mol_type = other DNA
gtaggactgtgggacttctc

SEQ ID NO: 11335 - DNA, 20 bp, synthetic construct
  misc_feature 1..20: note = CRISPR gRNA sequence
  source 1..20: mol_type = other DNA
gggacttctccagtaatttc

SEQ ID NO: 11336 - DNA, 20 bp, synthetic construct
  misc_feature 1..20: note = CRISPR gRNA sequence
  source 1..20: mol_type = other DNA
tccagtaatttctagtgtcc

SEQ ID NO: 11337 - DNA, 20 bp, synthetic construct
  misc_feature 1..20: note = CRISPR gRNA sequence
  source 1..20: mol_type = other DNA
ccagtaatttctagtgtcct

SEQ ID NO: 11338 - DNA, 20 bp, synthetic construct
  misc_feature 1..20: note = CRISPR gRNA sequence
  source 1..20: mol_type = other DNA
agtgtcctaggtaacactgt

SEQ ID NO: 11339 - DNA, 20 bp, synthetic construct
  misc_feature 1..20: note = CRISPR gRNA sequence
  source 1..20: mol_type = other DNA
tcctaggtaacactgtaagc

SEQ ID NO: 11340 - DNA, 20 bp, synthetic construct
  misc_feature 1..20: note = CRISPR gRNA sequence
  source 1..20: mol_type = other DNA
taagctagatttcttctcct

SEQ ID NO: 11341 - DNA, 20 bp, synthetic construct
  misc_feature 1..20: note = CRISPR gRNA sequence
  source 1..20: mol_type = other DNA
tcttacccgccaccccactt

SEQ ID NO: 11342 - DNA, 20 bp, synthetic construct
  misc_feature 1..20: note = CRISPR gRNA sequence
  source 1..20: mol_type = other DNA
accccacttaagtatttatt

SEQ ID NO: 11343 - DNA, 20 bp, synthetic construct
  misc_feature 1..20: note = CRISPR gRNA sequence
  source 1..20: mol_type = other DNA
ttgagcacctactatgtgcc

SEQ ID NO: 11344 - DNA, 20 bp, synthetic construct
  misc_feature 1..20: note = CRISPR gRNA sequence
  source 1..20: mol_type = other DNA
agcacctactatgtgcctgg

SEQ ID NO: 11345 - DNA, 20 bp, synthetic construct
  misc_feature 1..20: note = CRISPR gRNA sequence
  source 1..20: mol_type = other DNA
ctatgtgcctggcagtgctc

SEQ ID NO: 11346 - DNA, 20 bp, synthetic construct
  misc_feature 1..20: note = CRISPR gRNA sequence
  source 1..20: mol_type = other DNA
tatgtgcctggcagtgctct

SEQ ID NO: 11347 - DNA, 20 bp, synthetic construct
  misc_feature 1..20: note = CRISPR gRNA sequence
  source 1..20: mol_type = other DNA
gcctggcagtgctctaggca

SEQ ID NO: 11348 - DNA, 20 bp, synthetic construct
  misc_feature 1..20: note = CRISPR gRNA sequence
  source 1..20: mol_type = other DNA
cctggcagtgctctaggcac

SEQ ID NO: 11349 - DNA, 20 bp, synthetic construct
  misc_feature 1..20: note = CRISPR gRNA sequence
  source 1..20: mol_type = other DNA
ctggcagtgctctaggcaca

SEQ ID NO: 11350 - DNA, 20 bp, synthetic construct
  misc_feature 1..20: note = CRISPR gRNA sequence
  source 1..20: mol_type = other DNA
gtgctctaggcacagggata

SEQ ID NO: 11351 - DNA, 20 bp, synthetic construct
  misc_feature 1..20: note = CRISPR gRNA sequence
  source 1..20: mol_type = other DNA
aggcacagggatacagtaat

SEQ ID NO: 11352 - DNA, 20 bp, synthetic construct
  misc_feature 1..20: note = CRISPR gRNA sequence
  source 1..20: mol_type = other DNA
ggatacagtaatgagcaaaa

SEQ ID NO: 11353 - DNA, 20 bp, synthetic construct
  misc_feature 1..20: note = CRISPR gRNA sequence
  source 1..20: mol_type = other DNA
agtaatgagcaaaacagaca

SEQ ID NO: 11354 - DNA, 20 bp, synthetic construct
  misc_feature 1..20: note = CRISPR gRNA sequence
  source 1..20: mol_type = other DNA
acacagccctgctccatgtg

SEQ ID NO: 11355 - DNA, 20 bp, synthetic construct
  misc_feature 1..20: note = CRISPR gRNA sequence
  source 1..20: mol_type = other DNA
tccatgtgaagcccacaacc

SEQ ID NO: 11356 - DNA, 20 bp, synthetic construct
  misc_feature 1..20: note = CRISPR gRNA sequence
  source 1..20: mol_type = other DNA
atgtgaagcccacaacccgg

SEQ ID NO: 11357 - DNA, 20 bp, synthetic construct
  misc_feature 1..20: note = CRISPR gRNA sequence
  source 1..20: mol_type = other DNA
gaagcccacaacccggcaga

SEQ ID NO: 11358 - DNA, 20 bp, synthetic construct
  misc_feature 1..20: note = CRISPR gRNA sequence
  source 1..20: mol_type = other DNA
aagcccacaacccggcagaa

SEQ ID NO: 11359 - DNA, 20 bp, synthetic construct
  misc_feature 1..20: note = CRISPR gRNA sequence
  source 1..20: mol_type = other DNA
acccggcagaaaggattaca

SEQ ID NO: 11360 - DNA, 20 bp, synthetic construct
  misc_feature 1..20: note = CRISPR gRNA sequence
  source 1..20: mol_type = other DNA
tgccaacacttatttcatta

SEQ ID NO: 11361 - DNA, 20 bp, synthetic construct
  misc_feature 1..20: note = CRISPR gRNA sequence
  source 1..20: mol_type = other DNA
tatttcattatagtgctgaa

SEQ ID NO: 11362 - DNA, 20 bp, synthetic construct
  misc_feature 1..20: note = CRISPR gRNA sequence
  source 1..20: mol_type = other DNA
ttcattatagtgctgaaaag

SEQ ID NO: 11363 - DNA, 20 bp, synthetic construct
  misc_feature 1..20: note = CRISPR gRNA sequence
  source 1..20: mol_type = other DNA
tatagtgctgaaaagtggcg

SEQ ID NO: 11364 - DNA, 20 bp, synthetic construct
  misc_feature 1..20: note = CRISPR gRNA sequence
  source 1..20: mol_type = other DNA
tagtgctgaaaagtggcgca

SEQ ID NO: 11365 - DNA, 20 bp, synthetic construct
  misc_feature 1..20: note = CRISPR gRNA sequence
  source 1..20: mol_type = other DNA
agtgctgaaaagtggcgcag

SEQ ID NO: 11366 - DNA, 20 bp, synthetic construct
  misc_feature 1..20: note = CRISPR gRNA sequence
  source 1..20: mol_type = other DNA
gtgctgaaaagtggcgcaga

SEQ ID NO: 11367 - DNA, 20 bp, synthetic construct
  misc_feature 1..20: note = CRISPR gRNA sequence
  source 1..20: mol_type = other DNA
gaaaagtggcgcagagggaa

SEQ ID NO: 11368 - DNA, 20 bp, synthetic construct
  misc_feature 1..20: note = CRISPR gRNA sequence
  source 1..20: mol_type = other DNA
aaagtggcgcagagggaaaa

SEQ ID NO: 11369 - DNA, 20 bp, synthetic construct
  misc_feature 1..20: note = CRISPR gRNA sequence
  source 1..20: mol_type = other DNA
aagtggcgcagagggaaaag

SEQ ID NO: 11370 - DNA, 20 bp, synthetic construct
  misc_feature 1..20: note = CRISPR gRNA sequence
  source 1..20: mol_type = other DNA
agtggcgcagagggaaaaga

SEQ ID NO: 11371 - DNA, 20 bp, synthetic construct
  misc_feature 1..20: note = CRISPR gRNA sequence
  source 1..20: mol_type = other DNA
gtggcgcagagggaaaagag

SEQ ID NO: 11372 - DNA, 20 bp, synthetic construct
  misc_feature 1..20: note = CRISPR gRNA sequence
  source 1..20: mol_type = other DNA
ggaaaagaggggatgttgta

SEQ ID NO: 11373 - DNA, 20 bp, synthetic construct
  misc_feature 1..20: note = CRISPR gRNA sequence
  source 1..20: mol_type = other DNA
gaggggatgttgtaaagtca

SEQ ID NO: 11374 - DNA, 20 bp, synthetic construct
  misc_feature 1..20: note = CRISPR gRNA sequence
  source 1..20: mol_type = other DNA
aggggatgttgtaaagtcat

SEQ ID NO: 11375 - DNA, 20 bp, synthetic construct
  misc_feature 1..20: note = CRISPR gRNA sequence
  source 1..20: mol_type = other DNA
gatgttgtaaagtcatggga

SEQ ID NO: 11376 - DNA, 20 bp, synthetic construct
  misc_feature 1..20: note = CRISPR gRNA sequence
  source 1..20: mol_type = other DNA
atgttgtaaagtcatgggac

SEQ ID NO: 11377 - DNA, 20 bp, synthetic construct
  misc_feature 1..20: note = CRISPR gRNA sequence
  source 1..20: mol_type = other DNA
ttgtaaagtcatgggacagg

SEQ ID NO: 11378 - DNA, 20 bp, synthetic construct
  misc_feature 1..20: note = CRISPR gRNA sequence
  source 1..20: mol_type = other DNA
tgtaaagtcatgggacaggt

SEQ ID NO: 11379 - DNA, 20 bp, synthetic construct
  misc_feature 1..20: note = CRISPR gRNA sequence
  source 1..20: mol_type = other DNA
gtaaagtcatgggacaggtg

SEQ ID NO: 11380 - DNA, 20 bp, synthetic construct
  misc_feature 1..20: note = CRISPR gRNA sequence
  source 1..20: mol_type = other DNA
taaagtcatgggacaggtgg

SEQ ID NO: 11381 - DNA, 20 bp, synthetic construct
  misc_feature 1..20: note = CRISPR gRNA sequence
  source 1..20: mol_type = other DNA
agtcatgggacaggtggggg

SEQ ID NO: 11382 - DNA, 20 bp, synthetic construct
  misc_feature 1..20: note = CRISPR gRNA sequence
  source 1..20: mol_type = other DNA
gtcatgggacaggtgggggc

SEQ ID NO: 11383 - DNA, 20 bp, synthetic construct
  misc_feature 1..20: note = CRISPR gRNA sequence
  source 1..20: mol_type = other DNA
catgggacaggtgggggcag

SEQ ID NO: 11384 - DNA, 20 bp, synthetic construct
  misc_feature 1..20: note = CRISPR gRNA sequence
  source 1..20: mol_type = other DNA
atgggacaggtgggggcagg

SEQ ID NO: 11385 - DNA, 20 bp, synthetic construct
  misc_feature 1..20: note = CRISPR gRNA sequence
  source 1..20: mol_type = other DNA
tgggacaggtgggggcagga

SEQ ID NO: 11386 - DNA, 20 bp, synthetic construct
  misc_feature 1..20: note = CRISPR gRNA sequence
  source 1..20: mol_type = other DNA
ctcatccctgccctcccact

SEQ ID NO: 11387 - DNA, 20 bp, synthetic construct
  misc_feature 1..20: note = CRISPR gRNA sequence
  source 1..20: mol_type = other DNA
cctgccctcccacttggcca

SEQ ID NO: 11388 - DNA, 20 bp, synthetic construct
  misc_feature 1..20: note = CRISPR gRNA sequence
  source 1..20: mol_type = other DNA
ctgccctcccacttggccac

SEQ ID NO: 11389 - DNA, 20 bp, synthetic construct
  misc_feature 1..20: note = CRISPR gRNA sequence
  source 1..20: mol_type = other DNA
cacttggccacaggacctaa

SEQ ID NO: 11390 - DNA, 20 bp, synthetic construct
  misc_feature 1..20: note = CRISPR gRNA sequence
  source 1..20: mol_type = other DNA
acagtatcctcctatttacc

SEQ ID NO: 11391 - DNA, 20 bp, synthetic construct
  misc_feature 1..20: note = CRISPR gRNA sequence
  source 1..20: mol_type = other DNA
agtatcctcctatttaccga

SEQ ID NO: 11392 - DNA, 20 bp, synthetic construct
  misc_feature 1..20: note = CRISPR gRNA sequence
  source 1..20: mol_type = other DNA
gtatcctcctatttaccgag

SEQ ID NO: 11393 - DNA, 20 bp, synthetic construct
  misc_feature 1..20: note = CRISPR gRNA sequence
  source 1..20: mol_type = other DNA
tcctcctatttaccgagagg

SEQ ID NO: 11394 - DNA, 20 bp, synthetic construct
  misc_feature 1..20: note = CRISPR gRNA sequence
  source 1..20: mol_type = other DNA
tatttaccgagaggtagctt

SEQ ID NO: 11395 - DNA, 20 bp, synthetic construct
  misc_feature 1..20: note = CRISPR gRNA sequence
  source 1..20: mol_type = other DNA
aggtagcttaagtctgtcga

SEQ ID NO: 11396 - DNA, 20 bp, synthetic construct
  misc_feature 1..20: note = CRISPR gRNA sequence
  source 1..20: mol_type = other DNA
tctgtcgacagcgccattca

SEQ ID NO: 11397 - DNA, 20 bp, synthetic construct
  misc_feature 1..20: note = CRISPR gRNA sequence
  source 1..20: mol_type = other DNA
gccattcacagcctatgacc

SEQ ID NO: 11398 - DNA, 20 bp, synthetic construct
  misc_feature 1..20: note = CRISPR gRNA sequence
  source 1..20: mol_type = other DNA
tatgacccagaactctcctt

SEQ ID NO: 11399 - DNA, 20 bp, synthetic construct
  misc_feature 1..20: note = CRISPR gRNA sequence
  source 1..20: mol_type = other DNA
atgacccagaactctccttg

SEQ ID NO: 11400 - DNA, 20 bp, synthetic construct
  misc_feature 1..20: note = CRISPR gRNA sequence
  source 1..20: mol_type = other DNA
cagaactctccttgaggtca

SEQ ID NO: 11401 - DNA, 20 bp, synthetic construct
  misc_feature 1..20: note = CRISPR gRNA sequence
  source 1..20: mol_type = other DNA
actctccttgaggtcaaagt

SEQ ID NO: 11402 - DNA, 20 bp, synthetic construct
  misc_feature 1..20: note = CRISPR gRNA sequence
  source 1..20: mol_type = other DNA
ctctccttgaggtcaaagtg

SEQ ID NO: 11403 - DNA, 20 bp, synthetic construct
  misc_feature 1..20: note = CRISPR gRNA sequence
  source 1..20: mol_type = other DNA
gaggtcaaagtgaggcatgc

SEQ ID NO: 11404 - DNA, 20 bp, synthetic construct
  misc_feature 1..20: note = CRISPR gRNA sequence
  source 1..20: mol_type = other DNA
caaagtgaggcatgcaagtt

SEQ ID NO: 11405 - DNA, 20 bp, synthetic construct
  misc_feature 1..20: note = CRISPR gRNA sequence
  source 1..20: mol_type = other DNA
aggcatgcaagtttggtcct

SEQ ID NO: 11406 - DNA, 20 bp, synthetic construct
  misc_feature 1..20: note = CRISPR gRNA sequence
  source 1..20: mol_type = other DNA
tccccctcactgtgtccccg

SEQ ID NO: 11407 - DNA, 20 bp, synthetic construct
  misc_feature 1..20: note = CRISPR gRNA sequence
  source 1..20: mol_type = other DNA
tgtgtccccgcagtctgtcc

SEQ ID NO: 11408 - DNA, 20 bp, synthetic construct
  misc_feature 1..20: note = CRISPR gRNA sequence
  source 1..20: mol_type = other DNA
ccagaacaacatcactgacc

SEQ ID NO: 11409 - DNA, 20 bp, synthetic construct
  misc_feature 1..20: note = CRISPR gRNA sequence
  source 1..20: mol_type = other DNA
cagaacaacatcactgacct

SEQ ID NO: 11410 - DNA, 20 bp, synthetic construct
  misc_feature 1..20: note = CRISPR gRNA sequence
  source 1..20: mol_type = other DNA
tgggtgcctacaaactcgcc

SEQ ID NO: 11411 - DNA, 20 bp, synthetic construct
  misc_feature 1..20: note = CRISPR gRNA sequence
  source 1..20: mol_type = other DNA
gggtgcctacaaactcgccg

SEQ ID NO: 11412 - DNA, 20 bp, synthetic construct
  misc_feature 1..20: note = CRISPR gRNA sequence
  source 1..20: mol_type = other DNA
tcgctcgctgcatccctgct

SEQ ID NO: 11413 - DNA, 20 bp, synthetic construct
  misc_feature 1..20: note = CRISPR gRNA sequence
  source 1..20: mol_type = other DNA
cgctcgctgcatccctgctc

SEQ ID NO: 11414 - DNA, 20 bp, synthetic construct
  misc_feature 1..20: note = CRISPR gRNA sequence
  source 1..20: mol_type = other DNA
gctgcatccctgctcaggct

SEQ ID NO: 11415 - DNA, 20 bp, synthetic construct
  misc_feature 1..20: note = CRISPR gRNA sequence
  source 1..20: mol_type = other DNA
ctgcatccctgctcaggcta

SEQ ID NO: 11416 - DNA, 20 bp, synthetic construct
  misc_feature 1..20: note = CRISPR gRNA sequence
  source 1..20: mol_type = other DNA
atccctgctcaggctaaggt

SEQ ID NO: 11417 - DNA, 20 bp, synthetic construct
  misc_feature 1..20: note = CRISPR gRNA sequence
  source 1..20: mol_type = other DNA
cctgctcaggctaaggtgag

SEQ ID NO: 11418 - DNA, 20 bp, synthetic construct
  misc_feature 1..20: note = CRISPR gRNA sequence
  source 1..20: mol_type = other DNA
ctgctcaggctaaggtgagt

SEQ ID NO: 11419 - DNA, 20 bp, synthetic construct
  misc_feature 1..20: note = CRISPR gRNA sequence
  source 1..20: mol_type = other DNA
tgctcaggctaaggtgagtg

SEQ ID NO: 11420 - DNA, 20 bp, synthetic construct
  misc_feature 1..20: note = CRISPR gRNA sequence
  source 1..20: mol_type = other DNA
ggctaaggtgagtggggccc

SEQ ID NO: 11421 - DNA, 20 bp, synthetic construct
  misc_feature 1..20: note = CRISPR gRNA sequence
  source 1..20: mol_type = other DNA
gtgagtggggccccggatac

SEQ ID NO: 11422 - DNA, 20 bp, synthetic construct
  misc_feature 1..20: note = CRISPR gRNA sequence
  source 1..20: mol_type = other DNA
gtggggccccggataccggt

SEQ ID NO: 11423 - DNA, 20 bp, synthetic construct
  misc_feature 1..20: note = CRISPR gRNA sequence
  source 1..20: mol_type = other DNA
tggggccccggataccggtc

SEQ ID NO: 11424 - DNA, 20 bp, synthetic construct
  misc_feature 1..20: note = CRISPR gRNA sequence
  source 1..20: mol_type = other DNA
ccggataccggtcaggtgct

SEQ ID NO: 11425 - DNA, 20 bp, synthetic construct
  misc_feature 1..20: note = CRISPR gRNA sequence
  source 1..20: mol_type = other DNA
ataccggtcaggtgctgagc

SEQ ID NO: 11426 - DNA, 20 bp, synthetic construct
  misc_feature 1..20: note = CRISPR gRNA sequence
  source 1..20: mol_type = other DNA
taccggtcaggtgctgagct

SEQ ID NO: 11427 - DNA, 20 bp, synthetic construct
  misc_feature 1..20: note = CRISPR gRNA sequence
  source 1..20: mol_type = other DNA
accggtcaggtgctgagctg

SEQ ID NO: 11428 - DNA, 20 bp, synthetic construct
  misc_feature 1..20: note = CRISPR gRNA sequence
  source 1..20: mol_type = other DNA
ccggtcaggtgctgagctgg

SEQ ID NO: 11429 - DNA, 20 bp, synthetic construct
  misc_feature 1..20: note = CRISPR gRNA sequence
  source 1..20: mol_type = other DNA
cggtcaggtgctgagctggg

SEQ ID NO: 11430 - DNA, 20 bp, synthetic construct
  misc_feature 1..20: note = CRISPR gRNA sequence
  source 1..20: mol_type = other DNA
ggtgctgagctggggggctg

SEQ ID NO: 11431 - DNA, 20 bp, synthetic construct
  misc_feature 1..20: note = CRISPR gRNA sequence
  source 1..20: mol_type = other DNA
tgctgagctggggggctgca

SEQ ID NO: 11432 - DNA, 20 bp, synthetic construct
  misc_feature 1..20: note = CRISPR gRNA sequence
  source 1..20: mol_type = other DNA
agctggggggctgcagagcg

SEQ ID NO: 11433 - DNA, 20 bp, synthetic construct
  misc_feature 1..20: note = CRISPR gRNA sequence
  source 1..20: mol_type = other DNA
gctggggggctgcagagcgc

SEQ ID NO: 11434 - DNA, 20 bp, synthetic construct
  misc_feature 1..20: note = CRISPR gRNA sequence
  source 1..20: mol_type = other DNA
ctggggggctgcagagcgca

SEQ ID NO: 11435 - DNA, 20 bp, synthetic construct
  misc_feature 1..20: note = CRISPR gRNA sequence
  source 1..20: mol_type = other DNA
gcagggaacccacatcgtgc

SEQ ID NO: 11436 - DNA, 20 bp, synthetic construct
  misc_feature 1..20: note = CRISPR gRNA sequence
  source 1..20: mol_type = other DNA
aacccacatcgtgctggctg

SEQ ID NO: 11437 - DNA, 20 bp, synthetic construct
  misc_feature 1..20: note = CRISPR gRNA sequence
  source 1..20: mol_type = other DNA
acccacatcgtgctggctgc

SEQ ID NO: 11438 - DNA, 20 bp, synthetic construct
  misc_feature 1..20: note = CRISPR gRNA sequence
  source 1..20: mol_type = other DNA
cccacatcgtgctggctgca

SEQ ID NO: 11439 - DNA, 20 bp, synthetic construct
  misc_feature 1..20: note = CRISPR gRNA sequence
  source 1..20: mol_type = other DNA
ccacatcgtgctggctgcag

SEQ ID NO: 11440 - DNA, 20 bp, synthetic construct
  misc_feature 1..20: note = CRISPR gRNA sequence
  source 1..20: mol_type = other DNA
tgctggctgcaggggacact

SEQ ID NO: 11441 - DNA, 20 bp, synthetic construct
  misc_feature 1..20: note = CRISPR gRNA sequence
  source 1..20: mol_type = other DNA
tgcaggggacactgagaccc

SEQ ID NO: 11442 - DNA, 20 bp, synthetic construct
  misc_feature 1..20: note = CRISPR gRNA sequence
  source 1..20: mol_type = other DNA
aggggacactgagaccctag

SEQ ID NO: 11443 - DNA, 20 bp, synthetic construct
  misc_feature 1..20: note = CRISPR gRNA sequence
  source 1..20: mol_type = other DNA
gaccctagaagcaatcacca

SEQ ID NO: 11444 - DNA, 20 bp, synthetic construct
  misc_feature 1..20: note = CRISPR gRNA sequence
  source 1..20: mol_type = other DNA
atcaccacagccctgaacaa

SEQ ID NO: 11445 - DNA, 20 bp, synthetic construct
  misc_feature 1..20: note = CRISPR gRNA sequence
  source 1..20: mol_type = other DNA
tcaccacagccctgaacaaa

SEQ ID NO: 11446 - DNA, 20 bp, synthetic construct
  misc_feature 1..20: note = CRISPR gRNA sequence
  source 1..20: mol_type = other DNA
acagccctgaacaaaaggat

SEQ ID NO: 11447 - DNA, 20 bp, synthetic construct
  misc_feature 1..20: note = CRISPR gRNA sequence
  source 1..20: mol_type = other DNA
gccctgaacaaaaggattag

SEQ ID NO: 11448 - DNA, 20 bp, synthetic construct
  misc_feature 1..20: note = CRISPR gRNA sequence
  source 1..20: mol_type = other DNA
ccctgaacaaaaggattagc

SEQ ID NO: 11449 - DNA, 20 bp, synthetic construct
  misc_feature 1..20: note = CRISPR gRNA sequence
  source 1..20: mol_type = other DNA
acaaaaggattagcgggacg

SEQ ID NO: 11450 - DNA, 20 bp, synthetic construct
  misc_feature 1..20: note = CRISPR gRNA sequence
  source 1..20: mol_type = other DNA
ggattagcgggacgtggtga

SEQ ID NO: 11451 - DNA, 20 bp, synthetic construct
  misc_feature 1..20: note = CRISPR gRNA sequence
  source 1..20: mol_type = other DNA
gacgtggtgaaagaaactct

SEQ ID NO: 11452 - DNA, 20 bp, synthetic construct
  misc_feature 1..20: note = CRISPR gRNA sequence
  source 1..20: mol_type = other DNA
tggtgaaagaaactctgagc

SEQ ID NO: 11453 - DNA, 20 bp, synthetic construct
  misc_feature 1..20: note = CRISPR gRNA sequence
  source 1..20: mol_type = other DNA
gaaagaaactctgagcaagt

SEQ ID NO: 11454 - DNA, 20 bp, synthetic construct
  misc_feature 1..20: note = CRISPR gRNA sequence
  source 1..20: mol_type = other DNA
gcaagtcagttattcattcc

SEQ ID NO: 11455 - DNA, 20 bp, synthetic construct
  misc_feature 1..20: note = CRISPR gRNA sequence
  source 1..20: mol_type = other DNA
ctagccgctgttttcttacc

SEQ ID NO: 11456 - DNA, 20 bp, synthetic construct
  misc_feature 1..20: note = CRISPR gRNA sequence
  source 1..20: mol_type = other DNA
ctgttttcttacctggaaaa

SEQ ID NO: 11457 - DNA, 20 bp, synthetic construct
  misc_feature 1..20: note = CRISPR gRNA sequence
  source 1..20: mol_type = other DNA
tgttttcttacctggaaaat

SEQ ID NO: 11458 - DNA, 20 bp, synthetic construct
  misc_feature 1..20: note = CRISPR gRNA sequence
  source 1..20: mol_type = other DNA
gaaaatgggaaccatcctaa

SEQ ID NO: 11459 - DNA, 20 bp, synthetic construct
  misc_feature 1..20: note = CRISPR gRNA sequence
  source 1..20: mol_type = other DNA
accatcctaatggtctatgt

SEQ ID NO: 11460 - DNA, 20 bp, synthetic construct
  misc_feature 1..20: note = CRISPR gRNA sequence
  source 1..20: mol_type = other DNA
gtaagcacttgtcacaatgc

SEQ ID NO: 11461 - DNA, 20 bp, synthetic construct
  misc_feature 1..20: note = CRISPR gRNA sequence
  source 1..20: mol_type = other DNA
taagcacttgtcacaatgcc

SEQ ID NO: 11462 - DNA, 20 bp, synthetic construct
  misc_feature 1..20: note = CRISPR gRNA sequence
  source 1..20: mol_type = other DNA
aaatattgctccttttcccc

SEQ ID NO: 11463 - DNA, 20 bp, synthetic construct
  misc_feature 1..20: note = CRISPR gRNA sequence
  source 1..20: mol_type = other DNA
aatattgctccttttccccc

SEQ ID NO: 11464 - DNA, 20 bp, synthetic construct
  misc_feature 1..20: note = CRISPR gRNA sequence
  source 1..20: mol_type = other DNA
atattgctccttttccccca

SEQ ID NO: 11465 - DNA, 20 bp, synthetic construct
  misc_feature 1..20: note = CRISPR gRNA sequence
  source 1..20: mol_type = other DNA
tgctccttttcccccaggga

SEQ ID NO: 11466 - DNA, 20 bp, synthetic construct
  misc_feature 1..20: note = CRISPR gRNA sequence
  source 1..20: mol_type = other DNA
tccttttcccccagggatgg

SEQ ID NO: 11467 - DNA, 20 bp, synthetic construct
  misc_feature 1..20: note = CRISPR gRNA sequence
  source 1..20: mol_type = other DNA
ccttttcccccagggatggc

SEQ ID NO: 11468 - DNA, 20 bp, synthetic construct
  misc_feature 1..20: note = CRISPR gRNA sequence
  source 1..20: mol_type = other DNA
tcccccagggatggcgggac

SEQ ID NO: 11469 - DNA, 20 bp, synthetic construct
  misc_feature 1..20: note = CRISPR gRNA sequence
  source 1..20: mol_type = other DNA
cccccagggatggcgggacc

SEQ ID NO: 11470 - DNA, 20 bp, synthetic construct
  misc_feature 1..20: note = CRISPR gRNA sequence
  source 1..20: mol_type = other DNA
tggcgggaccaggctttttc

SEQ ID NO: 11471 - DNA, 20 bp, synthetic construct
  misc_feature 1..20: note = CRISPR gRNA sequence
  source 1..20: mol_type = other DNA
accaggctttttccggaacc

SEQ ID NO: 11472 - DNA, 20 bp, synthetic construct
  misc_feature 1..20: note = CRISPR gRNA sequence
  source 1..20: mol_type = other DNA
ccaggctttttccggaacct

SEQ ID NO: 11473 - DNA, 20 bp, synthetic construct
  misc_feature 1..20: note = CRISPR gRNA sequence
  source 1..20: mol_type = other DNA
caggctttttccggaaccta

SEQ ID NO: 11474 - DNA, 20 bp, synthetic construct
  misc_feature 1..20: note = CRISPR gRNA sequence
  source 1..20: mol_type = other DNA
aggctttttccggaacctag

SEQ ID NO: 11475 - DNA, 20 bp, synthetic construct
  misc_feature 1..20: note = CRISPR gRNA sequence
  source 1..20: mol_type = other DNA
ctttttccggaacctagggg

SEQ ID NO: 11476 - DNA, 20 bp, synthetic construct
  misc_feature 1..20: note = CRISPR gRNA sequence
  source 1..20: mol_type = other DNA
tttccggaacctaggggtgg

SEQ ID NO: 11477 - DNA, 20 bp, synthetic construct
  misc_feature 1..20: note = CRISPR gRNA sequence
  source 1..20: mol_type = other DNA
aacctaggggtggtggcttc

SEQ ID NO: 11478 - DNA, 20 bp, synthetic construct
  misc_feature 1..20: note = CRISPR gRNA sequence
  source 1..20: mol_type = other DNA
ctaggggtggtggcttctgg

SEQ ID NO: 11479 - DNA, 20 bp, synthetic construct
  misc_feature 1..20: note = CRISPR gRNA sequence
  source 1..20: mol_type = other DNA
taggggtggtggcttctgga

SEQ ID NO: 11480 - DNA, 20 bp, synthetic construct
  misc_feature 1..20: note = CRISPR gRNA sequence
  source 1..20: mol_type = other DNA
ggaaggctaaccacgtacgt

SEQ ID NO: 11481 - DNA, 20 bp, synthetic construct
  misc_feature 1..20: note = CRISPR gRNA sequence
  source 1..20: mol_type = other DNA
ccacgtacgtcagcttttgc

SEQ ID NO: 11482 - DNA, 20 bp, synthetic construct
  misc_feature 1..20: note = CRISPR gRNA sequence
  source 1..20: mol_type = other DNA
cggccttgtcacttacatgc

SEQ ID NO: 11483 - DNA, 20 bp, synthetic construct
  misc_feature 1..20: note = CRISPR gRNA sequence
  source 1..20: mol_type = other DNA
cttgtcacttacatgccggt

SEQ ID NO: 11484 - DNA, 20 bp, synthetic construct
  misc_feature 1..20: note = CRISPR gRNA sequence
  source 1..20: mol_type = other DNA
agtgtttcactgccaccttc

SEQ ID NO: 11485 - DNA, 20 bp, synthetic construct
  misc_feature 1..20: note = CRISPR gRNA sequence
  source 1..20: mol_type = other DNA
gtttcactgccaccttctgg

SEQ ID NO: 11486 - DNA, 20 bp, synthetic construct
  misc_feature 1..20: note = CRISPR gRNA sequence
  source 1..20: mol_type = other DNA
tttcactgccaccttctggt

SEQ ID NO: 11487 - DNA, 20 bp, synthetic construct
  misc_feature 1..20: note = CRISPR gRNA sequence
  source 1..20: mol_type = other DNA
tgccaccttctggtaggcct

SEQ ID NO: 11488 - DNA, 20 bp, synthetic construct
  misc_feature 1..20: note = CRISPR gRNA sequence
  source 1..20: mol_type = other DNA
ccttctggtaggccttggca

SEQ ID NO: 11489 - DNA, 20 bp, synthetic construct
  misc_feature 1..20: note = CRISPR gRNA sequence
  source 1..20: mol_type = other DNA
gcatagcacctcttgctttt

SEQ ID NO: 11490 - DNA, 20 bp, synthetic construct
  misc_feature 1..20: note = CRISPR gRNA sequence
  source 1..20: mol_type = other DNA
gcttttgagtgacttccatc

SEQ ID NO: 11491 - DNA, 20 bp, synthetic construct
  misc_feature 1..20: note = CRISPR gRNA sequence
  source 1..20: mol_type = other DNA
cttttgagtgacttccatcc

SEQ ID NO: 11492 - DNA, 20 bp, synthetic construct
  misc_feature 1..20: note = CRISPR gRNA sequence
  source 1..20: mol_type = other DNA
agtgacttccatccaggccc

SEQ ID NO: 11493 - DNA, 20 bp, synthetic construct
  misc_feature 1..20: note = CRISPR gRNA sequence
  source 1..20: mol_type = other DNA
cttccatccaggccctggtg

SEQ ID NO: 11494 - DNA, 20 bp, synthetic construct
  misc_feature 1..20: note = CRISPR gRNA sequence
  source 1..20: mol_type = other DNA
tccaggccctggtgtggtcc

SEQ ID NO: 11495 - DNA, 20 bp, synthetic construct
  misc_feature 1..20: note = CRISPR gRNA sequence
  source 1..20: mol_type = other DNA
caggccctggtgtggtccca

SEQ ID NO: 11496 - DNA, 20 bp, synthetic construct
  misc_feature 1..20: note = CRISPR gRNA sequence
  source 1..20: mol_type = other DNA
aggccctggtgtggtcccag

SEQ ID NO: 11497 - DNA, 20 bp, synthetic construct
  misc_feature 1..20: note = CRISPR gRNA sequence
  source 1..20: mol_type = other DNA
ggtgtggtcccagaggtaat

SEQ ID NO: 11498 - DNA, 20 bp, synthetic construct
  misc_feature 1..20: note = CRISPR gRNA sequence
  source 1..20: mol_type = other DNA
gtggtcccagaggtaatgag

SEQ ID NO: 11499 - DNA, 20 bp, synthetic construct
  misc_feature 1..20: note = CRISPR gRNA sequence
  source 1..20: mol_type = other DNA
ccagaggtaatgagcggact

SEQ ID NO: 11500 - DNA, 20 bp, synthetic construct
  misc_feature 1..20: note = CRISPR gRNA sequence
  source 1..20: mol_type = other DNA
ggtaatgagcggactgagct

SEQ ID NO: 11501 - DNA, 20 bp, synthetic construct
  misc_feature 1..20: note = CRISPR gRNA sequence
  source 1..20: mol_type = other DNA
tgagcggactgagcttggac

SEQ ID NO: 11502 - DNA, 20 bp, synthetic construct
  misc_feature 1..20: note = CRISPR gRNA sequence
  source 1..20: mol_type = other DNA
agcggactgagcttggacca

SEQ ID NO: 11503 - DNA, 20 bp, synthetic construct
  misc_feature 1..20: note = CRISPR gRNA sequence
  source 1..20: mol_type = other DNA
ctgagcttggaccagagccc

SEQ ID NO: 11504 - DNA, 20 bp, synthetic construct
  misc_feature 1..20: note = CRISPR gRNA sequence
  source 1..20: mol_type = other DNA
agagccccagtcatccaact

SEQ ID NO: 11505 - DNA, 20 bp, synthetic construct
  misc_feature 1..20: note = CRISPR gRNA sequence
  source 1..20: mol_type = other DNA
gtcatccaactcagcattac

SEQ ID NO: 11506 - DNA, 20 bp, synthetic construct
  misc_feature 1..20: note = CRISPR gRNA sequence
  source 1..20: mol_type = other DNA
taccagctcttcttactcgc

SEQ ID NO: 11507 - DNA, 20 bp, synthetic construct
  misc_feature 1..20: note = CRISPR gRNA sequence
  source 1..20: mol_type = other DNA
ctcttcttactcgccagact

SEQ ID NO: 11508 - DNA, 20 bp, synthetic construct
  misc_feature 1..20: note = CRISPR gRNA sequence
  source 1..20: mol_type = other DNA
cttcttactcgccagactga

SEQ ID NO: 11509 - DNA, 20 bp, synthetic construct
  misc_feature 1..20: note = CRISPR gRNA sequence
  source 1..20: mol_type = other DNA
gaaactgctctcctcttcgc

SEQ ID NO: 11510 - DNA, 20 bp, synthetic construct
  misc_feature 1..20: note = CRISPR gRNA sequence
  source 1..20: mol_type = other DNA
aactgctctcctcttcgcca

SEQ ID NO: 11511 - DNA, 20 bp, synthetic construct
  misc_feature 1..20: note = CRISPR gRNA sequence
  source 1..20: mol_type = other DNA
gccagagctcttcacttact

SEQ ID NO: 11512 - DNA, 20 bp, synthetic construct
  misc_feature 1..20: note = CRISPR gRNA sequence
  source 1..20: mol_type = other DNA
ccagagctcttcacttactg

SEQ ID NO: 11513 - DNA, 20 bp, synthetic construct
  misc_feature 1..20: note = CRISPR gRNA sequence
  source 1..20: mol_type = other DNA
cttcacttactgaggacaac

SEQ ID NO: 11514 - DNA, 20 bp, synthetic construct
  misc_feature 1..20: note = CRISPR gRNA sequence
  source 1..20: mol_type = other DNA
tcacttactgaggacaacca

SEQ ID NO: 11515 - DNA, 20 bp, synthetic construct
  misc_feature 1..20: note = CRISPR gRNA sequence
  source 1..20: mol_type = other DNA
ttactgaggacaaccagagt

SEQ ID NO: 11516 - DNA, 20 bp, synthetic construct
  misc_feature 1..20: note = CRISPR gRNA sequence
  source 1..20: mol_type = other DNA
gacaaccagagtcagattcc

SEQ ID NO: 11517 - DNA, 20 bp, synthetic construct
  misc_feature 1..20: note = CRISPR gRNA sequence
  source 1..20: mol_type = other DNA
acaaccagagtcagattccc

SEQ ID NO: 11518 - DNA, 20 bp, synthetic construct
  misc_feature 1..20: note = CRISPR gRNA sequence
  source 1..20: mol_type = other DNA
ccagagtcagattcccagga

SEQ ID NO: 11519 - DNA, 20 bp, synthetic construct
  misc_feature 1..20: note = CRISPR gRNA sequence
  source 1..20: mol_type = other DNA
agtcagattcccaggaaaga

SEQ ID NO: 11520 - DNA, 20 bp, synthetic construct
  misc_feature 1..20: note = CRISPR gRNA sequence
  source 1..20: mol_type = other DNA
ttcccaggaaagatggcatt

SEQ ID NO: 11521 - DNA, 20 bp, synthetic construct
  misc_feature 1..20: note = CRISPR gRNA sequence
  source 1..20: mol_type = other DNA
tttttttaatttctgttttt

SEQ ID NO: 11522 - DNA, 20 bp, synthetic construct
  misc_feature 1..20: note = CRISPR gRNA sequence
  source 1..20: mol_type = other DNA
tttaatttctgtttttgaga

SEQ ID NO: 11523 - DNA, 20 bp, synthetic construct
  misc_feature 1..20: note = CRISPR gRNA sequence
  source 1..20: mol_type = other DNA
taatttctgtttttgagatg

SEQ ID NO: 11524 - DNA, 20 bp, synthetic construct
  misc_feature 1..20: note = CRISPR gRNA sequence
  source 1..20: mol_type = other DNA
tggagtctcgctctgtcacc

SEQ ID NO: 11525 - DNA, 20 bp, synthetic construct
  misc_feature 1..20: note = CRISPR gRNA sequence
  source 1..20: mol_type = other DNA
ggagtctcgctctgtcaccc

SEQ ID NO: 11526 - DNA, 20 bp, synthetic construct
  misc_feature 1..20: note = CRISPR gRNA sequence
  source 1..20: mol_type = other DNA
tctcgctctgtcacccaggc

SEQ ID NO: 11527 - DNA, 20 bp, synthetic construct
  misc_feature 1..20: note = CRISPR gRNA sequence
  source 1..20: mol_type = other DNA
tcgctctgtcacccaggctg

SEQ ID NO: 11528 - DNA, 20 bp, synthetic construct
  misc_feature 1..20: note = CRISPR gRNA sequence
  source 1..20: mol_type = other DNA
ctgtcacccaggctggagtg

SEQ ID NO: 11529 - DNA, 20 bp, synthetic construct
  misc_feature 1..20: note = CRISPR gRNA sequence
  source 1..20: mol_type = other DNA
tcacccaggctggagtgaag

SEQ ID NO: 11530 - DNA, 20 bp, synthetic construct
  misc_feature 1..20: note = CRISPR gRNA sequence
  source 1..20: mol_type = other DNA
ggagtgaagtggtgtgatct

SEQ ID NO: 11531 - DNA, 20 bp, synthetic construct
  misc_feature 1..20: note = CRISPR gRNA sequence
  source 1..20: mol_type = other DNA
ctgcaacttctgcccccccc

SEQ ID NO: 11532 - DNA, 20 bp, synthetic construct
  misc_feature 1..20: note = CRISPR gRNA sequence
  source 1..20: mol_type = other DNA
tgcaacttctgccccccccc

SEQ ID NO: 11533 - DNA, 20 bp, synthetic construct
  misc_feature 1..20: note = CRISPR gRNA sequence
  source 1..20: mol_type = other DNA
ttctgcccccccccaggttc

SEQ ID NO: 11534 - DNA, 20 bp, synthetic construct
  misc_feature 1..20: note = CRISPR gRNA sequence
  source 1..20: mol_type = other DNA
ttcaagctattcgcctgcct

SEQ ID NO: 11535 - DNA, 20 bp, synthetic construct
  misc_feature 1..20: note = CRISPR gRNA sequence
  source 1..20: mol_type = other DNA
ttcgcctgcctcagtgctcc

SEQ ID NO: 11536 - DNA, 20 bp, synthetic construct
  misc_feature 1..20: note = CRISPR gRNA sequence
  source 1..20: mol_type = other DNA
gcctgcctcagtgctccgag

SEQ ID NO: 11537 - DNA, 20 bp, synthetic construct
  misc_feature 1..20: note = CRISPR gRNA sequence
  source 1..20: mol_type = other DNA
gcctcagtgctccgagtagc

SEQ ID NO: 11538 - DNA, 20 bp, synthetic construct
  misc_feature 1..20: note = CRISPR gRNA sequence
  source 1..20: mol_type = other DNA
cctcagtgctccgagtagct

SEQ ID NO: 11539 - DNA, 20 bp, synthetic construct
  misc_feature 1..20: note = CRISPR gRNA sequence
  source 1..20: mol_type = other DNA
gctccgagtagctgggatta

SEQ ID NO: 11540 - DNA, 20 bp, synthetic construct
  misc_feature 1..20: note = CRISPR gRNA sequence
  source 1..20: mol_type = other DNA
ctccgagtagctgggattat

SEQ ID NO: 11541 - DNA, 20 bp, synthetic construct
  misc_feature 1..20: note = CRISPR gRNA sequence
  source 1..20: mol_type = other DNA
taggcgcccaccaccacgtc

SEQ ID NO: 11542 - DNA, 20 bp, synthetic construct
  misc_feature 1..20: note = CRISPR gRNA sequence
  source 1..20: mol_type = other DNA
cgcccaccaccacgtccagc

SEQ ID NO: 11543 - DNA, 20 bp, synthetic construct
  misc_feature 1..20: note = CRISPR gRNA sequence
  source 1..20: mol_type = other DNA
ccagctagtttttatatttt

SEQ ID NO: 11544 - DNA, 20 bp, synthetic construct
  misc_feature 1..20: note = CRISPR gRNA sequence
  source 1..20: mol_type = other DNA
gctagtttttatatttttag

SEQ ID NO: 11545 - DNA, 20 bp, synthetic construct
  misc_feature 1..20: note = CRISPR gRNA sequence
  source 1..20: mol_type = other DNA
tagtttttatatttttagta

SEQ ID NO: 11546 - DNA, 20 bp, synthetic construct
  misc_feature 1..20: note = CRISPR gRNA sequence
  source 1..20: mol_type = other DNA
ttttatatttttagtagaga

SEQ ID NO: 11547 - DNA, 20 bp, synthetic construct
  misc_feature 1..20: note = CRISPR gRNA sequence
  source 1..20: mol_type = other DNA
tttatatttttagtagagac

SEQ ID NO: 11548 - DNA, 20 bp, synthetic construct
  misc_feature 1..20: note = CRISPR gRNA sequence
  source 1..20: mol_type = other DNA
ttatatttttagtagagaca

SEQ ID NO: 11549 - DNA, 20 bp, synthetic construct
  misc_feature 1..20: note = CRISPR gRNA sequence
  source 1..20: mol_type = other DNA
gagacagggtttcgccatgt

SEQ ID NO: 11550 - DNA, 20 bp, synthetic construct
  misc_feature 1..20: note = CRISPR gRNA sequence
  source 1..20: mol_type = other DNA
cagggtttcgccatgttggc

SEQ ID NO: 11551 - DNA, 20 bp, synthetic construct
  misc_feature 1..20: note = CRISPR gRNA sequence
  source 1..20: mol_type = other DNA
agggtttcgccatgttggcc

SEQ ID NO: 11552 - DNA, 20 bp, synthetic construct
  misc_feature 1..20: note = CRISPR gRNA sequence
  source 1..20: mol_type = other DNA
tttcgccatgttggccaggc

SEQ ID NO: 11553 - DNA, 20 bp, synthetic construct
  misc_feature 1..20: note = CRISPR gRNA sequence
  source 1..20: mol_type = other DNA
tggtctcaaactcctgatct

SEQ ID NO: 11554 - DNA, 20 bp, synthetic construct
  misc_feature 1..20: note = CRISPR gRNA sequence
  source 1..20: mol_type = other DNA
ggtctcaaactcctgatctc

SEQ ID NO: 11555 - DNA, 20 bp, synthetic construct
  misc_feature 1..20: note = CRISPR gRNA sequence
  source 1..20: mol_type = other DNA
ctcaggtgatccacctgcct

SEQ ID NO: 11556 - DNA, 20 bp, synthetic construct
  misc_feature 1..20: note = CRISPR gRNA sequence
  source 1..20: mol_type = other DNA
ccacctgcctcggcctccca

SEQ ID NO: 11557 - DNA, 20 bp, synthetic construct
  misc_feature 1..20: note = CRISPR gRNA sequence
  source 1..20: mol_type = other DNA
ctgcctcggcctcccaaagt

SEQ ID NO: 11558 - DNA, 20 bp, synthetic construct
  misc_feature 1..20: note = CRISPR gRNA sequence
  source 1..20: mol_type = other DNA
cggcctcccaaagtgagtac

SEQ ID NO: 11559 - DNA, 20 bp, synthetic construct
  misc_feature 1..20: note = CRISPR gRNA sequence
  source 1..20: mol_type = other DNA
ggcctcccaaagtgagtact

SEQ ID NO: 11560 - DNA, 20 bp, synthetic construct
  misc_feature 1..20: note = CRISPR gRNA sequence
  source 1..20: mol_type = other DNA
caaagtgagtactaggatta

SEQ ID NO: 11561 - DNA, 20 bp, synthetic construct
  misc_feature 1..20: note = CRISPR gRNA sequence
  source 1..20: mol_type = other DNA
aaagtgagtactaggattac

SEQ ID NO: 11562 - DNA, 20 bp, synthetic construct
  misc_feature 1..20: note = CRISPR gRNA sequence
  source 1..20: mol_type = other DNA
agtactaggattacaggcgt

SEQ ID NO: 11563 - DNA, 20 bp, synthetic construct
  misc_feature 1..20: note = CRISPR gRNA sequence
  source 1..20: mol_type = other DNA
caggcgtgagccaccatgcc

SEQ ID NO: 11564 - DNA, 20 bp, synthetic construct
  misc_feature 1..20: note = CRISPR gRNA sequence
  source 1..20: mol_type = other DNA
tatttatttatttatttatt

SEQ ID NO: 11565 - DNA, 20 bp, synthetic construct
  misc_feature 1..20: note = CRISPR gRNA sequence
  source 1..20: mol_type = other DNA
tttatttatttatttatttg

SEQ ID NO: 11566 - DNA, 20 bp, synthetic construct
  misc_feature 1..20: note = CRISPR gRNA sequence
  source 1..20: mol_type = other DNA
tttatttatttatttggaga

SEQ ID NO: 11567 - DNA, 20 bp, synthetic construct
  misc_feature 1..20: note = CRISPR gRNA sequence
  source 1..20: mol_type = other DNA
ttatttatttatttggagat

SEQ ID NO: 11568 - DNA, 20 bp, synthetic construct
  misc_feature 1..20: note = CRISPR gRNA sequence
  source 1..20: mol_type = other DNA
tatttatttatttggagatg

SEQ ID NO: 11569 - DNA, 20 bp, synthetic construct
  misc_feature 1..20: note = CRISPR gRNA sequence
  source 1..20: mol_type = other DNA
tttggagatggggtctcacc

SEQ ID NO: 11570 - DNA, 20 bp, synthetic construct
  misc_feature 1..20: note = CRISPR gRNA sequence
  source 1..20: mol_type = other DNA
ttggagatggggtctcaccc

SEQ ID NO: 11571 - DNA, 20 bp, synthetic construct
  misc_feature 1..20: note = CRISPR gRNA sequence
  source 1..20: mol_type = other DNA
atggggtctcacccaggttg

SEQ ID NO: 11572 - DNA, 20 bp, synthetic construct
  misc_feature 1..20: note = CRISPR gRNA sequence
  source 1..20: mol_type = other DNA
gtctcacccaggttgtagtg

SEQ ID NO: 11573 - DNA, 20 bp, synthetic construct
  misc_feature 1..20: note = CRISPR gRNA sequence
  source 1..20: mol_type = other DNA
tctcacccaggttgtagtgc

SEQ ID NO: 11574 - DNA, 20 bp, synthetic construct
  misc_feature 1..20: note = CRISPR gRNA sequence
  source 1..20: mol_type = other DNA
ctcacccaggttgtagtgca

SEQ ID NO: 11575 - DNA, 20 bp, synthetic construct
  misc_feature 1..20: note = CRISPR gRNA sequence
  source 1..20: mol_type = other DNA
tcacccaggttgtagtgcag

SEQ ID NO: 11576 - DNA, 20 bp, synthetic construct
  misc_feature 1..20: note = CRISPR gRNA sequence
  source 1..20: mol_type = other DNA
gtagtgcaggggtgcaatga

SEQ ID NO: 11577 - DNA, 20 bp, synthetic construct
  misc_feature 1..20: note = CRISPR gRNA sequence
  source 1..20: mol_type = other DNA
ggtgcaatgatggctcacta

SEQ ID NO: 11578 - DNA, 20 bp, synthetic construct
  misc_feature 1..20: note = CRISPR gRNA sequence
  source 1..20: mol_type = other DNA
tcactacagcctcgactacc

SEQ ID NO: 11579 - DNA, 20 bp, synthetic construct
  misc_feature 1..20: note = CRISPR gRNA sequence
  source 1..20: mol_type = other DNA
agcctcgactacctggactg

SEQ ID NO: 11580 - DNA, 20 bp, synthetic construct
  misc_feature 1..20: note = CRISPR gRNA sequence
  source 1..20: mol_type = other DNA
ctgaagcgaacctcccacct

SEQ ID NO: 11581 - DNA, 20 bp, synthetic construct
  misc_feature 1..20: note = CRISPR gRNA sequence
  source 1..20: mol_type = other DNA
acctcccacctcagccttcc

SEQ ID NO: 11582 - DNA, 20 bp, synthetic construct
  misc_feature 1..20: note = CRISPR gRNA sequence
  source 1..20: mol_type = other DNA
tcccacctcagccttccaag

SEQ ID NO: 11583 - DNA, 20 bp, synthetic construct
  misc_feature 1..20: note = CRISPR gRNA sequence
  source 1..20: mol_type = other DNA
acctcagccttccaagtagc

SEQ ID NO: 11584 - DNA, 20 bp, synthetic construct
  misc_feature 1..20: note = CRISPR gRNA sequence
  source 1..20: mol_type = other DNA
cctcagccttccaagtagct

SEQ ID NO: 11585 - DNA, 20 bp, synthetic construct
  misc_feature 1..20: note = CRISPR gRNA sequence
  source 1..20: mol_type = other DNA
gctgggtcctataccctcct

SEQ ID NO: 11586 - DNA, 20 bp, synthetic construct
  misc_feature 1..20: note = CRISPR gRNA sequence
  source 1..20: mol_type = other DNA
gagccttgttaatttcttcc

SEQ ID NO: 11587 - DNA, 20 bp, synthetic construct
  misc_feature 1..20: note = CRISPR gRNA sequence
  source 1..20: mol_type = other DNA
tttacaatattttatttatg

SEQ ID NO: 11588 - DNA, 20 bp, synthetic construct
  misc_feature 1..20: note = CRISPR gRNA sequence
  source 1..20: mol_type = other DNA
ttacaatattttatttatgt

SEQ ID NO: 11589 - DNA, 20 bp, synthetic construct
  misc_feature 1..20: note = CRISPR gRNA sequence
  source 1..20: mol_type = other DNA
tgcttacttcttgctatgca

SEQ ID NO: 11590 - DNA, 20 bp, synthetic construct
  misc_feature 1..20: note = CRISPR gRNA sequence
  source 1..20: mol_type = other DNA
tcttgctatgcaaagaaact

SEQ ID NO: 11591 - DNA, 20 bp, synthetic construct
  misc_feature 1..20: note = CRISPR gRNA sequence
  source 1..20: mol_type = other DNA
tgctatgcaaagaaactcag

SEQ ID NO: 11592 - DNA, 20 bp, synthetic construct
  misc_feature 1..20: note = CRISPR gRNA sequence
  source 1..20: mol_type = other DNA
aagaaactcagaagcaaaaa

SEQ ID NO: 11593 - DNA, 20 bp, synthetic construct
  misc_feature 1..20: note = CRISPR gRNA sequence
  source 1..20: mol_type = other DNA
aagcaaaaatagaatctgtc

SEQ ID NO: 11594 - DNA, 20 bp, synthetic construct
  misc_feature 1..20: note = CRISPR gRNA sequence
  source 1..20: mol_type = other DNA
ttcataattgtgctaaaaac

SEQ ID NO: 11595 - DNA, 20 bp, synthetic construct
  misc_feature 1..20: note = CRISPR gRNA sequence
  source 1..20: mol_type = other DNA
cataattgtgctaaaaacta

SEQ ID NO: 11596 - DNA, 20 bp, synthetic construct
  misc_feature 1..20: note = CRISPR gRNA sequence
  source 1..20: mol_type = other DNA
gtgctaaaaactagagatac

SEQ ID NO: 11597 - DNA, 20 bp, synthetic construct
  misc_feature 1..20: note = CRISPR gRNA sequence
  source 1..20: mol_type = other DNA
ctagagatacaagtatgaac

SEQ ID NO: 11598 - DNA, 20 bp, synthetic construct
  misc_feature 1..20: note = CRISPR gRNA sequence
  source 1..20: mol_type = other DNA
agatacaagtatgaactaga

SEQ ID NO: 11599 - DNA, 20 bp, synthetic construct
  misc_feature 1..20: note = CRISPR gRNA sequence
  source 1..20: mol_type = other DNA
cagatgtcgttcttgctttt

SEQ ID NO: 11600 - DNA, 20 bp, synthetic construct
  misc_feature 1..20: note = CRISPR gRNA sequence
  source 1..20: mol_type = other DNA
tgcttttgagtttctttgcg

SEQ ID NO: 11601 - DNA, 20 bp, synthetic construct
  misc_feature 1..20: note = CRISPR gRNA sequence
  source 1..20: mol_type = other DNA
ttttgagtttctttgcgtag

SEQ ID NO: 11602 - DNA, 20 bp, synthetic construct
  misc_feature 1..20: note = CRISPR gRNA sequence
  source 1..20: mol_type = other DNA
tttgagtttctttgcgtagt

SEQ ID NO: 11603 - DNA, 20 bp, synthetic construct
  misc_feature 1..20: note = CRISPR gRNA sequence
  source 1..20: mol_type = other DNA
tttctttgcgtagtaggaat

SEQ ID NO: 11604 - DNA, 20 bp, synthetic construct
  misc_feature 1..20: note = CRISPR gRNA sequence
  source 1..20: mol_type = other DNA
ttctttgcgtagtaggaatt

SEQ ID NO: 11605 - DNA, 20 bp, synthetic construct
  misc_feature 1..20: note = CRISPR gRNA sequence
  source 1..20: mol_type = other DNA
ataaataaaatattgtaaaa

SEQ ID NO: 11606 - DNA, 20 bp, synthetic construct
  misc_feature 1..20: note = CRISPR gRNA sequence
  source 1..20: mol_type = other DNA
tgtaaaacagtgattcatgc

SEQ ID NO: 11607 - DNA, 20 bp, synthetic construct
  misc_feature 1..20: note = CRISPR gRNA sequence
  source 1..20: mol_type = other DNA
gtaaaacagtgattcatgct

SEQ ID NO: 11608 - DNA, 20 bp, synthetic construct
  misc_feature 1..20: note = CRISPR gRNA sequence
  source 1..20: mol_type = other DNA
aaacagtgattcatgctggg

SEQ ID NO: 11609 - DNA, 20 bp, synthetic construct
  misc_feature 1..20: note = CRISPR gRNA sequence
  source 1..20: mol_type = other DNA
aacagtgattcatgctggga

SEQ ID NO: 11610 - DNA, 20 bp, synthetic construct
  misc_feature 1..20: note = CRISPR gRNA sequence
  source 1..20: mol_type = other DNA
atgctgggaaggaaactaac

SEQ ID NO: 11611 - DNA, 20 bp, synthetic construct
  misc_feature 1..20: note = CRISPR gRNA sequence
  source 1..20: mol_type = other DNA
ggaaggaaactaacaagccc

SEQ ID NO: 11612 - DNA, 20 bp, synthetic construct
  misc_feature 1..20: note = CRISPR gRNA sequence
  source 1..20: mol_type = other DNA
gaaggaaactaacaagcccc

SEQ ID NO: 11613 - DNA, 20 bp, synthetic construct
  misc_feature 1..20: note = CRISPR gRNA sequence
  source 1..20: mol_type = other DNA
aggaaactaacaagccccag

SEQ ID NO: 11614 - DNA, 20 bp, synthetic construct
  misc_feature 1..20: note = CRISPR gRNA sequence
  source 1..20: mol_type = other DNA
ggaaactaacaagccccagg

SEQ ID NO: 11615 - DNA, 20 bp, synthetic construct
  misc_feature 1..20: note = CRISPR gRNA sequence
  source 1..20: mol_type = other DNA
gaaactaacaagccccagga

SEQ ID NO: 11616 - DNA, 20 bp, synthetic construct
  misc_feature 1..20: note = CRISPR gRNA sequence
  source 1..20: mol_type = other DNA
taacaagccccaggagggta

SEQ ID NO: 11617 - DNA, 20 bp, synthetic construct
  misc_feature 1..20: note = CRISPR gRNA sequence
  source 1..20: mol_type = other DNA
aacaagccccaggagggtac

SEQ ID NO: 11618 - DNA, 20 bp, synthetic construct
  misc_feature 1..20: note = CRISPR gRNA sequence
  source 1..20: mol_type = other DNA
ccaggagggtacaggacttc

SEQ ID NO: 11619 - DNA, 20 bp, synthetic construct
  misc_feature 1..20: note = CRISPR gRNA sequence
  source 1..20: mol_type = other DNA
caggagggtacaggacttct

SEQ ID NO: 11620 - DNA, 20 bp, synthetic construct
  misc_feature 1..20: note = CRISPR gRNA sequence
  source 1..20: mol_type = other DNA
aggagggtacaggacttctg

SEQ ID NO: 11621 - DNA, 20 bp, synthetic construct
  misc_feature 1..20: note = CRISPR gRNA sequence
  source 1..20: mol_type = other DNA
gagggtacaggacttctggg

SEQ ID NO: 11622 - DNA, 20 bp, synthetic construct
  misc_feature 1..20: note = CRISPR gRNA sequence
  source 1..20: mol_type = other DNA
ctggggagatgattcttccg

SEQ ID NO: 11623 - DNA, 20 bp, synthetic construct
  misc_feature 1..20: note = CRISPR gRNA sequence
  source 1..20: mol_type = other DNA
tggggagatgattcttccgt

SEQ ID NO: 11624 - DNA, 20 bp, synthetic construct
  misc_feature 1..20: note = CRISPR gRNA sequence
  source 1..20: mol_type = other DNA
ggagatgattcttccgtggg

SEQ ID NO: 11625 - DNA, 20 bp, synthetic construct
  misc_feature 1..20: note = CRISPR gRNA sequence
  source 1..20: mol_type = other DNA
gattcttccgtgggaagctc

SEQ ID NO: 11626 - DNA, 20 bp, synthetic construct
  misc_feature 1..20: note = CRISPR gRNA sequence
  source 1..20: mol_type = other DNA
attcttccgtgggaagctct

SEQ ID NO: 11627 - DNA, 20 bp, synthetic construct
  misc_feature 1..20: note = CRISPR gRNA sequence
  source 1..20: mol_type = other DNA
ttcttccgtgggaagctcta

SEQ ID NO: 11628 - DNA, 20 bp, synthetic construct
  misc_feature 1..20: note = CRISPR gRNA sequence
  source 1..20: mol_type = other DNA
tcttccgtgggaagctctag

SEQ ID NO: 11629 - DNA, 20 bp, synthetic construct
  misc_feature 1..20: note = CRISPR gRNA sequence
  source 1..20: mol_type = other DNA
cgtgggaagctctaggggaa

SEQ ID NO: 11630 - DNA, 20 bp, synthetic construct
  misc_feature 1..20: note = CRISPR gRNA sequence
  source 1..20: mol_type = other DNA
gtgggaagctctaggggaaa

SEQ ID NO: 11631 - DNA, 20 bp, synthetic construct
  misc_feature 1..20: note = CRISPR gRNA sequence
  source 1..20: mol_type = other DNA
gctctaggggaaaaggactc

SEQ ID NO: 11632 - DNA, 20 bp, synthetic construct
  misc_feature 1..20: note = CRISPR gRNA sequence
  source 1..20: mol_type = other DNA
ctctaggggaaaaggactct

SEQ ID NO: 11633 - DNA, 20 bp, synthetic construct
  misc_feature 1..20: note = CRISPR gRNA sequence
  source 1..20: mol_type = other DNA
taggggaaaaggactctagg

SEQ ID NO: 11634 - DNA, 20 bp, synthetic construct
  misc_feature 1..20: note = CRISPR gRNA sequence
  source 1..20: mol_type = other DNA
ggaaaaggactctaggaaga

SEQ ID NO: 11635 - DNA, 20 bp, synthetic construct
  misc_feature 1..20: note = CRISPR gRNA sequence
  source 1..20: mol_type = other DNA
aggactctaggaagaaagaa

SEQ ID NO: 11636 - DNA, 20 bp, synthetic construct
  misc_feature 1..20: note = CRISPR gRNA sequence
  source 1..20: mol_type = other DNA
actctaggaagaaagaacag

SEQ ID NO: 11637 - DNA, 20 bp, synthetic construct
  misc_feature 1..20: note = CRISPR gRNA sequence
  source 1..20: mol_type = other DNA
ctctaggaagaaagaacagc

SEQ ID NO: 11638 - DNA, 20 bp, synthetic construct
  misc_feature 1..20: note = CRISPR gRNA sequence
  source 1..20: mol_type = other DNA
aagaaagaacagcaggtgca

SEQ ID NO: 11639 - DNA, 20 bp, synthetic construct
  misc_feature 1..20: note = CRISPR gRNA sequence
  source 1..20: mol_type = other DNA
agaaagaacagcaggtgcaa

SEQ ID NO: 11640 - DNA, 20 bp, synthetic construct
  misc_feature 1..20: note = CRISPR gRNA sequence
  source 1..20: mol_type = other DNA
acagcaggtgcaaaggccct

SEQ ID NO: 11641 - DNA, 20 bp, synthetic construct
  misc_feature 1..20: note = CRISPR gRNA sequence
  source 1..20: mol_type = other DNA
gcaggtgcaaaggccctaag

SEQ ID NO: 11642 - DNA, 20 bp, synthetic construct
  misc_feature 1..20: note = CRISPR gRNA sequence
  source 1..20: mol_type = other DNA
caggtgcaaaggccctaagt

SEQ ID NO: 11643 - DNA, 20 bp, synthetic construct
  misc_feature 1..20: note = CRISPR gRNA sequence
  source 1..20: mol_type = other DNA
gcaaaggccctaagtgggaa

SEQ ID NO: 11644 - DNA, 20 bp, synthetic construct
  misc_feature 1..20: note = CRISPR gRNA sequence
  source 1..20: mol_type = other DNA
caaaggccctaagtgggaaa

SEQ ID NO: 11645 - DNA, 20 bp, synthetic construct
  misc_feature 1..20: note = CRISPR gRNA sequence
  source 1..20: mol_type = other DNA
aaaggccctaagtgggaaaa

SEQ ID NO: 11646 - DNA, 20 bp, synthetic construct
  misc_feature 1..20: note = CRISPR gRNA sequence
  source 1..20: mol_type = other DNA
aaggccctaagtgggaaaag

SEQ ID NO: 11647 - DNA, 20 bp, synthetic construct
  misc_feature 1..20: note = CRISPR gRNA sequence
  source 1..20: mol_type = other DNA
gggaaaaggggctgtgtttt

SEQ ID NO: 11648 - DNA, 20 bp, synthetic construct
  misc_feature 1..20: note = CRISPR gRNA sequence
  source 1..20: mol_type = other DNA
ggaaaaggggctgtgtttta

SEQ ID NO: 11649 - DNA, 20 bp, synthetic construct
  misc_feature 1..20: note = CRISPR gRNA sequence
  source 1..20: mol_type = other DNA
gaaaaggggctgtgttttaa

SEQ ID NO: 11650 - DNA, 20 bp, synthetic construct
  misc_feature 1..20: note = CRISPR gRNA sequence
  source 1..20: mol_type = other DNA
aggggctgtgttttaagggt

SEQ ID NO: 11651 - DNA, 20 bp, synthetic construct
  misc_feature 1..20: note = CRISPR gRNA sequence
  source 1..20: mol_type = other DNA
ggctgtgttttaagggtcag

SEQ ID NO: 11652 - DNA, 20 bp, synthetic construct
  misc_feature 1..20: note = CRISPR gRNA sequence
  source 1..20: mol_type = other DNA
gctgtgttttaagggtcaga

SEQ ID NO: 11653 - DNA, 20 bp, synthetic construct
  misc_feature 1..20: note = CRISPR gRNA sequence
  source 1..20: mol_type = other DNA
ctgtgttttaagggtcagaa

SEQ ID NO: 11654 - DNA, 20 bp, synthetic construct
  misc_feature 1..20: note = CRISPR gRNA sequence
  source 1..20: mol_type = other DNA
aagggtcagaagggccactg

SEQ ID NO: 11655 - DNA, 20 bp, synthetic construct
  misc_feature 1..20: note = CRISPR gRNA sequence
  source 1..20: mol_type = other DNA
agggccactgtggctgtgtg

SEQ ID NO: 11656 - DNA, 20 bp, synthetic construct
  misc_feature 1..20: note = CRISPR gRNA sequence
  source 1..20: mol_type = other DNA
tgtggctgtgtgtagtgaat

SEQ ID NO: 11657 - DNA, 20 bp, synthetic construct
  misc_feature 1..20: note = CRISPR gRNA sequence
  source 1..20: mol_type = other DNA
gtggctgtgtgtagtgaatg

SEQ ID NO: 11658 - DNA, 20 bp, synthetic construct
  misc_feature 1..20: note = CRISPR gRNA sequence
  source 1..20: mol_type = other DNA
tggctgtgtgtagtgaatga

SEQ ID NO: 11659 - DNA, 20 bp, synthetic construct
  misc_feature 1..20: note = CRISPR gRNA sequence
  source 1..20: mol_type = other DNA
tgtgtgtagtgaatgaggga

SEQ ID NO: 11660 - DNA, 20 bp, synthetic construct
  misc_feature 1..20: note = CRISPR gRNA sequence
  source 1..20: mol_type = other DNA
tgtgtagtgaatgagggaca

SEQ ID NO: 11661 - DNA, 20 bp, synthetic construct
  misc_feature 1..20: note = CRISPR gRNA sequence
  source 1..20: mol_type = other DNA
gtgtagtgaatgagggacag

SEQ ID NO: 11662 - DNA, 20 bp, synthetic construct
  misc_feature 1..20: note = CRISPR gRNA sequence
  source 1..20: mol_type = other DNA
agtgaatgagggacagaggc

SEQ ID NO: 11663 - DNA, 20 bp, synthetic construct
  misc_feature 1..20: note = CRISPR gRNA sequence
  source 1..20: mol_type = other DNA
gtgaatgagggacagaggct

SEQ ID NO: 11664 - DNA, 20 bp, synthetic construct
  misc_feature 1..20: note = CRISPR gRNA sequence
  source 1..20: mol_type = other DNA
gagggacagaggctgggcaa

SEQ ID NO: 11665 - DNA, 20 bp, synthetic construct
  misc_feature 1..20: note = CRISPR gRNA sequence
  source 1..20: mol_type = other DNA
ggacagaggctgggcaatgg

SEQ ID NO: 11666 - DNA, 20 bp, synthetic construct
  misc_feature 1..20: note = CRISPR gRNA sequence
  source 1..20: mol_type = other DNA
cagaggctgggcaatggtgg

SEQ ID NO: 11667 - DNA, 20 bp, synthetic construct
  misc_feature 1..20: note = CRISPR gRNA sequence
  source 1..20: mol_type = other DNA
aggctgggcaatggtggaag

SEQ ID NO: 11668 - DNA, 20 bp, synthetic construct
  misc_feature 1..20: note = CRISPR gRNA sequence
  source 1..20: mol_type = other DNA
ggctgggcaatggtggaagt

SEQ ID NO: 11669 - DNA, 20 bp, synthetic construct
  misc_feature 1..20: note = CRISPR gRNA sequence
  source 1..20: mol_type = other DNA
gctgggcaatggtggaagta

SEQ ID NO: 11670 - DNA, 20 bp, synthetic construct
  misc_feature 1..20: note = CRISPR gRNA sequence
  source 1..20: mol_type = other DNA
ctgggcaatggtggaagtag

SEQ ID NO: 11671 - DNA, 20 bp, synthetic construct
  misc_feature 1..20: note = CRISPR gRNA sequence
  source 1..20: mol_type = other DNA
gggcaatggtggaagtaggg

SEQ ID NO: 11672 - DNA, 20 bp, synthetic construct
  misc_feature 1..20: note = CRISPR gRNA sequence
  source 1..20: mol_type = other DNA
ggcaatggtggaagtagggg

SEQ ID NO: 11673 - DNA, 20 bp, synthetic construct
  misc_feature 1..20: note = CRISPR gRNA sequence
  source 1..20: mol_type = other DNA
atggtggaagtaggggaggt

SEQ ID NO: 11674 - DNA, 20 bp, synthetic construct
  misc_feature 1..20: note = CRISPR gRNA sequence
  source 1..20: mol_type = other DNA
tggtggaagtaggggaggtc

SEQ ID NO: 11675 - DNA, 20 bp, synthetic construct
  misc_feature 1..20: note = CRISPR gRNA sequence
  source 1..20: mol_type = other DNA
ggtggaagtaggggaggtca

SEQ ID NO: 11676 - DNA, 20 bp, synthetic construct
  misc_feature 1..20: note = CRISPR gRNA sequence
  source 1..20: mol_type = other DNA
gtggaagtaggggaggtcag

SEQ ID NO: 11677 - DNA, 20 bp, synthetic construct
  misc_feature 1..20: note = CRISPR gRNA sequence
  source 1..20: mol_type = other DNA
taggggaggtcaggggaatc

SEQ ID NO: 11678 - DNA, 20 bp, synthetic construct
  misc_feature 1..20: note = CRISPR gRNA sequence
  source 1..20: mol_type = other DNA
tcaggggaatccagatcaca

SEQ ID NO: 11679 - DNA, 20 bp, synthetic construct
  misc_feature 1..20: note = CRISPR gRNA sequence
  source 1..20: mol_type = other DNA
caggggaatccagatcacac

SEQ ID NO: 11680 - DNA, 20 bp, synthetic construct
  misc_feature 1..20: note = CRISPR gRNA sequence
  source 1..20: mol_type = other DNA
aggggaatccagatcacaca

SEQ ID NO: 11681 - DNA, 20 bp, synthetic construct
  misc_feature 1..20: note = CRISPR gRNA sequence
  source 1..20: mol_type = other DNA
gggaatccagatcacacagg

SEQ ID NO: 11682 - DNA, 20 bp, synthetic construct
  misc_feature 1..20: note = CRISPR gRNA sequence
  source 1..20: mol_type = other DNA
ggaatccagatcacacaggg

SEQ ID NO: 11683 - DNA, 20 bp, synthetic construct
  misc_feature 1..20: note = CRISPR gRNA sequence
  source 1..20: mol_type = other DNA
atcacacagggaggcccttg

SEQ ID NO: 11684 - DNA, 20 bp, synthetic construct
  misc_feature 1..20: note = CRISPR gRNA sequence
  source 1..20: mol_type = other DNA
tcacacagggaggcccttgt

SEQ ID NO: 11685 - DNA, 20 bp, synthetic construct
  misc_feature 1..20: note = CRISPR gRNA sequence
  source 1..20: mol_type = other DNA
gggaggcccttgtgggtcac

SEQ ID NO: 11686 - DNA, 20 bp, synthetic construct
  misc_feature 1..20: note = CRISPR gRNA sequence
  source 1..20: mol_type = other DNA
gaggcccttgtgggtcacaa

SEQ ID NO: 11687 - DNA, 20 bp, synthetic construct
  misc_feature 1..20: note = CRISPR gRNA sequence
  source 1..20: mol_type = other DNA
aggcccttgtgggtcacaag

SEQ ID NO: 11688 - DNA, 20 bp, synthetic construct
  misc_feature 1..20: note = CRISPR gRNA sequence
  source 1..20: mol_type = other DNA
tgggtcacaagaggtatttg

SEQ ID NO: 11689 - DNA, 20 bp, synthetic construct
  misc_feature 1..20: note = CRISPR gRNA sequence
  source 1..20: mol_type = other DNA
aagaggtatttgcagttttt

SEQ ID NO: 11690 - DNA, 20 bp, synthetic construct
  misc_feature 1..20: note = CRISPR gRNA sequence
  source 1..20: mol_type = other DNA
ttgcagtttttcagtgtgaa

SEQ ID NO: 11691 - DNA, 20 bp, synthetic construct
  misc_feature 1..20: note = CRISPR gRNA sequence
  source 1..20: mol_type = other DNA
gtttttcagtgtgaatggaa

SEQ ID NO: 11692 - DNA, 20 bp, synthetic construct
  misc_feature 1..20: note = CRISPR gRNA sequence
  source 1..20: mol_type = other DNA
tttcagtgtgaatggaaaag

SEQ ID NO: 11693 - DNA, 20 bp, synthetic construct
  misc_feature 1..20: note = CRISPR gRNA sequence
  source 1..20: mol_type = other DNA
ttcagtgtgaatggaaaagt

SEQ ID NO: 11694 - DNA, 20 bp, synthetic construct
  misc_feature 1..20: note = CRISPR gRNA sequence
  source 1..20: mol_type = other DNA
agtgtgaatggaaaagtagg

SEQ ID NO: 11695 - DNA, 20 bp, synthetic construct
  misc_feature 1..20: note = CRISPR gRNA sequence
  source 1..20: mol_type = other DNA
gtgtgaatggaaaagtaggt

SEQ ID NO: 11696 - DNA, 20 bp, synthetic construct
  misc_feature 1..20: note = CRISPR gRNA sequence
  source 1..20: mol_type = other DNA
aatggaaaagtaggtgggcc

SEQ ID NO: 11697 - DNA, 20 bp, synthetic construct
  misc_feature 1..20: note = CRISPR gRNA sequence
  source 1..20: mol_type = other DNA
atggaaaagtaggtgggcct

SEQ ID NO: 11698 - DNA, 20 bp, synthetic construct
  misc_feature 1..20: note = CRISPR gRNA sequence
  source 1..20: mol_type = other DNA
gaaaagtaggtgggcctggg

SEQ ID NO: 11699 - DNA, 20 bp, synthetic construct
  misc_feature 1..20: note = CRISPR gRNA sequence
  source 1..20: mol_type = other DNA
aaaagtaggtgggcctggga

SEQ ID NO: 11700 - DNA, 20 bp, synthetic construct
  misc_feature 1..20: note = CRISPR gRNA sequence
  source 1..20: mol_type = other DNA
ttttcttttcttttcttttt

SEQ ID NO: 11701 - DNA, 20 bp, synthetic construct
  misc_feature 1..20: note = CRISPR gRNA sequence
  source 1..20: mol_type = other DNA
tttcttttctttttgagacc

SEQ ID NO: 11702 - DNA, 20 bp, synthetic construct
  misc_feature 1..20: note = CRISPR gRNA sequence
  source 1..20: mol_type = other DNA
ccaagtctcactttattgcc

SEQ ID NO: 11703 - DNA, 20 bp, synthetic construct
  misc_feature 1..20: note = CRISPR gRNA sequence
  source 1..20: mol_type = other DNA
caagtctcactttattgccc

SEQ ID NO: 11704 - DNA, 20 bp, synthetic construct
  misc_feature 1..20: note = CRISPR gRNA sequence
  source 1..20: mol_type = other DNA
ctcactttattgcccaggct

SEQ ID NO: 11705 - DNA, 20 bp, synthetic construct
  misc_feature 1..20: note = CRISPR gRNA sequence
  source 1..20: mol_type = other DNA
tcactttattgcccaggcta

SEQ ID NO: 11706 - DNA, 20 bp, synthetic construct
  misc_feature 1..20: note = CRISPR gRNA sequence
  source 1..20: mol_type = other DNA
ttattgcccaggctaaggtg

SEQ ID NO: 11707 - DNA, 20 bp, synthetic construct
  misc_feature 1..20: note = CRISPR gRNA sequence
  source 1..20: mol_type = other DNA
ttgcccaggctaaggtgcag

SEQ ID NO: 11708 - DNA, 20 bp, synthetic construct
  misc_feature 1..20: note = CRISPR gRNA sequence
  source 1..20: mol_type = other DNA
aaggtgcagtggcatgatct

SEQ ID NO: 11709 - DNA, 20 bp, synthetic construct
  misc_feature 1..20: note = CRISPR gRNA sequence
  source 1..20: mol_type = other DNA
gcatgatctcagctcactgc

SEQ ID NO: 11710 - DNA, 20 bp, synthetic construct
  misc_feature 1..20: note = CRISPR gRNA sequence
  source 1..20: mol_type = other DNA
tcactgcaagcactgcctcc

SEQ ID NO: 11711 - DNA, 20 bp, synthetic construct
  misc_feature 1..20: note = CRISPR gRNA sequence
  source 1..20: mol_type = other DNA
cactgcaagcactgcctcct

SEQ ID NO: 11712 - DNA, 20 bp, synthetic construct
  misc_feature 1..20: note = CRISPR gRNA sequence
  source 1..20: mol_type = other DNA
aagcactgcctcctgggttc

SEQ ID NO: 11713 - DNA, 20 bp, synthetic construct
  misc_feature 1..20: note = CRISPR gRNA sequence
  source 1..20: mol_type = other DNA
ttcaagtgattctcatgcct

SEQ ID NO: 11714 - DNA, 20 bp, synthetic construct
  misc_feature 1..20: note = CRISPR gRNA sequence
  source 1..20: mol_type = other DNA
ttctcatgcctcagcctccc

SEQ ID NO: 11715 - DNA, 20 bp, synthetic construct
  misc_feature 1..20: note = CRISPR gRNA sequence
  source 1..20: mol_type = other DNA
tcatgcctcagcctcccaag

SEQ ID NO: 11716 - DNA, 20 bp, synthetic construct
  misc_feature 1..20: note = CRISPR gRNA sequence
  source 1..20: mol_type = other DNA
gcctcagcctcccaagtagc

SEQ ID NO: 11717 - DNA, 20 bp, synthetic construct
  misc_feature 1..20: note = CRISPR gRNA sequence
  source 1..20: mol_type = other DNA
cctcagcctcccaagtagct

SEQ ID NO: 11718 - DNA, 20 bp, synthetic construct
  misc_feature 1..20: note = CRISPR gRNA sequence
  source 1..20: mol_type = other DNA
ctcccaagtagctgggatta

SEQ ID NO: 11719 - DNA, 20 bp, synthetic construct
  misc_feature 1..20: note = CRISPR gRNA sequence
  source 1..20: mol_type = other DNA
acagatgcccgccaccacac

SEQ ID NO: 11720 - DNA, 20 bp, synthetic construct
  misc_feature 1..20: note = CRISPR gRNA sequence
  source 1..20: mol_type = other DNA
cagatgcccgccaccacacc

SEQ ID NO: 11721 - DNA, 20 bp, synthetic construct
  misc_feature 1..20: note = CRISPR gRNA sequence
  source 1..20: mol_type = other DNA
ccaggctatttttgtgtttt

SEQ ID NO: 11722 - DNA, 20 bp, synthetic construct
  misc_feature 1..20: note = CRISPR gRNA sequence
  source 1..20: mol_type = other DNA
ggctatttttgtgttttcag

SEQ ID NO: 11723 - DNA, 20 bp, synthetic construct
  misc_feature 1..20: note = CRISPR gRNA sequence
  source 1..20: mol_type = other DNA
ctatttttgtgttttcagta

SEQ ID NO: 11724 - DNA, 20 bp, synthetic construct
  misc_feature 1..20: note = CRISPR gRNA sequence
  source 1..20: mol_type = other DNA
ttttgtgttttcagtagaga

SEQ ID NO: 11725 - DNA, 20 bp, synthetic construct
  misc_feature 1..20: note = CRISPR gRNA sequence
  source 1..20: mol_type = other DNA
tttgtgttttcagtagagac

SEQ ID NO: 11726 - DNA, 20 bp, synthetic construct
  misc_feature 1..20: note = CRISPR gRNA sequence
  source 1..20: mol_type = other DNA
ttgtgttttcagtagagaca

SEQ ID NO: 11727 - DNA, 20 bp, synthetic construct
  misc_feature 1..20: note = CRISPR gRNA sequence
  source 1..20: mol_type = other DNA
agagacagggcttcgccatg

SEQ ID NO: 11728 - DNA, 20 bp, synthetic construct
  misc_feature 1..20: note = CRISPR gRNA sequence
  source 1..20: mol_type = other DNA
cagggcttcgccatgtggcc

SEQ ID NO: 11729 - DNA, 20 bp, synthetic construct
  misc_feature 1..20: note = CRISPR gRNA sequence
  source 1..20: mol_type = other DNA
cttcgccatgtggcccagac

SEQ ID NO: 11730 - DNA, 20 bp, synthetic construct
  misc_feature 1..20: note = CRISPR gRNA sequence
  source 1..20: mol_type = other DNA
ccagactggtcttgaaatcc

SEQ ID NO: 11731 - DNA, 20 bp, synthetic construct
  misc_feature 1..20: note = CRISPR gRNA sequence
  source 1..20: mol_type = other DNA
cagactggtcttgaaatcct

SEQ ID NO: 11732 - DNA, 20 bp, synthetic construct
  misc_feature 1..20: note = CRISPR gRNA sequence
  source 1..20: mol_type = other DNA
ggtcttgaaatcctgggccc

SEQ ID NO: 11733 - DNA, 20 bp, synthetic construct
  misc_feature 1..20: note = CRISPR gRNA sequence
  source 1..20: mol_type = other DNA
cccaagcgatccacccacct

SEQ ID NO: 11734 - DNA, 20 bp, synthetic construct
  misc_feature 1..20: note = CRISPR gRNA sequence
  source 1..20: mol_type = other DNA
ccacccacctcagccttcca

SEQ ID NO: 11735 - DNA, 20 bp, synthetic construct
  misc_feature 1..20: note = CRISPR gRNA sequence
  source 1..20: mol_type = other DNA
acctcagccttccaaagtgc

SEQ ID NO: 11736 - DNA, 20 bp, synthetic construct
  misc_feature 1..20: note = CRISPR gRNA sequence
  source 1..20: mol_type = other DNA
cctcagccttccaaagtgct

SEQ ID NO: 11737 - DNA, 20 bp, synthetic construct
  misc_feature 1..20: note = CRISPR gRNA sequence
  source 1..20: mol_type = other DNA
cttccaaagtgctgggatta

SEQ ID NO: 11738 - DNA, 20 bp, synthetic construct
  misc_feature 1..20: note = CRISPR gRNA sequence
  source 1..20: mol_type = other DNA
ttccaaagtgctgggattac

SEQ ID NO: 11739 - DNA, 20 bp, synthetic construct
  misc_feature 1..20: note = CRISPR gRNA sequence
  source 1..20: mol_type = other DNA
agtgctgggattacgggtgt

SEQ ID NO: 11740 - DNA, 20 bp, synthetic construct
  misc_feature 1..20: note = CRISPR gRNA sequence
  source 1..20: mol_type = other DNA
cgggtgtgagccaccatgcc

SEQ ID NO: 11741 - DNA, 20 bp, synthetic construct
  misc_feature 1..20: note = CRISPR gRNA sequence
  source 1..20: mol_type = other DNA
cccagcctgatttacccttt

SEQ ID NO: 11742 - DNA, 20 bp, synthetic construct
  misc_feature 1..20: note = CRISPR gRNA sequence
  source 1..20: mol_type = other DNA
ttaagaaacatcatatttca

SEQ ID NO: 11743 - DNA, 20 bp, synthetic construct
  misc_feature 1..20: note = CRISPR gRNA sequence
  source 1..20: mol_type = other DNA
catcatatttcatggaatct

SEQ ID NO: 11744 - DNA, 20 bp, synthetic construct
  misc_feature 1..20: note = CRISPR gRNA sequence
  source 1..20: mol_type = other DNA
tctaagatgccatccattgt

SEQ ID NO: 11745 - DNA, 20 bp, synthetic construct
  misc_feature 1..20: note = CRISPR gRNA sequence
  source 1..20: mol_type = other DNA
ccattgtaagaccccaatat

SEQ ID NO: 11746 - DNA, 20 bp, synthetic construct
  misc_feature 1..20: note = CRISPR gRNA sequence
  source 1..20: mol_type = other DNA
cattgtaagaccccaatatg

SEQ ID NO: 11747 - DNA, 20 bp, synthetic construct
  misc_feature 1..20: note = CRISPR gRNA sequence
  source 1..20: mol_type = other DNA
tgcaaactgtgacacgctat

SEQ ID NO: 11748 - DNA, 20 bp, synthetic construct
  misc_feature 1..20: note = CRISPR gRNA sequence
  source 1..20: mol_type = other DNA
tgtgacacgctattggttat

SEQ ID NO: 11749 - DNA, 20 bp, synthetic construct
  misc_feature 1..20: note = CRISPR gRNA sequence
  source 1..20: mol_type = other DNA
tgatctcaatgatattcaaa

SEQ ID NO: 11750 - DNA, 20 bp, synthetic construct
  misc_feature 1..20: note = CRISPR gRNA sequence
  source 1..20: mol_type = other DNA
aaatggtgacatatatgtct

SEQ ID NO: 11751 - DNA, 20 bp, synthetic construct
  misc_feature 1..20: note = CRISPR gRNA sequence
  source 1..20: mol_type = other DNA
gtcttggcatcgatgaaata

SEQ ID NO: 11752 - DNA, 20 bp, synthetic construct
  misc_feature 1..20: note = CRISPR gRNA sequence
  source 1..20: mol_type = other DNA
tggcatcgatgaaatatggt

SEQ ID NO: 11753 - DNA, 20 bp, synthetic construct
  misc_feature 1..20: note = CRISPR gRNA sequence
  source 1..20: mol_type = other DNA
tggtcagattactctccctg

SEQ ID NO: 11754 - DNA, 20 bp, synthetic construct
  misc_feature 1..20: note = CRISPR gRNA sequence
  source 1..20: mol_type = other DNA
ggtcagattactctccctgt

SEQ ID NO: 11755 - DNA, 20 bp, synthetic construct
  misc_feature 1..20: note = CRISPR gRNA sequence
  source 1..20: mol_type = other DNA
gtcagattactctccctgtg

SEQ ID NO: 11756 - DNA, 20 bp, synthetic construct
  misc_feature 1..20: note = CRISPR gRNA sequence
  source 1..20: mol_type = other DNA
agattactctccctgtgggg

SEQ ID NO: 11757 - DNA, 20 bp, synthetic construct
  misc_feature 1..20: note = CRISPR gRNA sequence
  source 1..20: mol_type = other DNA
attactctccctgtggggtg

SEQ ID NO: 11758 - DNA, 20 bp, synthetic construct
  misc_feature 1..20: note = CRISPR gRNA sequence
  source 1..20: mol_type = other DNA
ttactctccctgtggggtgg

SEQ ID NO: 11759 - DNA, 20 bp, synthetic construct
  misc_feature 1..20: note = CRISPR gRNA sequence
  source 1..20: mol_type = other DNA
ctctccctgtggggtggagg

SEQ ID NO: 11760 - DNA, 20 bp, synthetic construct
  misc_feature 1..20: note = CRISPR gRNA sequence
  source 1..20: mol_type = other DNA
tctccctgtggggtggagga

SEQ ID NO: 11761 - DNA, 20 bp, synthetic construct
  misc_feature 1..20: note = CRISPR gRNA sequence
  source 1..20: mol_type = other DNA
ctccctgtggggtggaggaa

SEQ ID NO: 11762 - DNA, 20 bp, synthetic construct
  misc_feature 1..20: note = CRISPR gRNA sequence
  source 1..20: mol_type = other DNA
tggggtggaggaagggtctc

SEQ ID NO: 11763 - DNA, 20 bp, synthetic construct
  misc_feature 1..20: note = CRISPR gRNA sequence
  source 1..20: mol_type = other DNA
ggggtggaggaagggtctcc

SEQ ID NO: 11764 - DNA, 20 bp, synthetic construct
  misc_feature 1..20: note = CRISPR gRNA sequence
  source 1..20: mol_type = other DNA
gggtggaggaagggtctcca

SEQ ID NO: 11765 - DNA, 20 bp, synthetic construct
  misc_feature 1..20: note = CRISPR gRNA sequence
  source 1..20: mol_type = other DNA
gaggaagggtctccagggtt

SEQ ID NO: 11766 - DNA, 20 bp, synthetic construct
  misc_feature 1..20: note = CRISPR gRNA sequence
  source 1..20: mol_type = other DNA
ggaagggtctccagggttca

SEQ ID NO: 11767 - DNA, 20 bp, synthetic construct
  misc_feature 1..20: note = CRISPR gRNA sequence
  source 1..20: mol_type = other DNA
gagattgcaaaacccccatc

SEQ ID NO: 11768 - DNA, 20 bp, synthetic construct
  misc_feature 1..20: note = CRISPR gRNA sequence
  source 1..20: mol_type = other DNA
cccccatctagtttctgcac

SEQ ID NO: 11769 - DNA, 20 bp, synthetic construct
  misc_feature 1..20: note = CRISPR gRNA sequence
  source 1..20: mol_type = other DNA
tctagtttctgcactggtac

SEQ ID NO: 11770 - DNA, 20 bp, synthetic construct
  misc_feature 1..20: note = CRISPR gRNA sequence
  source 1..20: mol_type = other DNA
taccggccgacccgtgatgt

SEQ ID NO: 11771 - DNA, 20 bp, synthetic construct
  misc_feature 1..20: note = CRISPR gRNA sequence
  source 1..20: mol_type = other DNA
acccgtgatgtgagttgatt

SEQ ID NO: 11772 - DNA, 20 bp, synthetic construct
  misc_feature 1..20: note = CRISPR gRNA sequence
  source 1..20: mol_type = other DNA
tgatttagcctgaatccact

SEQ ID NO: 11773 - DNA, 20 bp, synthetic construct
  misc_feature 1..20: note = CRISPR gRNA sequence
  source 1..20: mol_type = other DNA
tttagcctgaatccacttgg

SEQ ID NO: 11774 - DNA, 20 bp, synthetic construct
  misc_feature 1..20: note = CRISPR gRNA sequence
  source 1..20: mol_type = other DNA
agcctgaatccacttggcag

SEQ ID NO: 11775 - DNA, 20 bp, synthetic construct
  misc_feature 1..20: note = CRISPR gRNA sequence
  source 1..20: mol_type = other DNA
tatttttttctttttttttc

SEQ ID NO: 11776 - DNA, 20 bp, synthetic construct
  misc_feature 1..20: note = CRISPR gRNA sequence
  source 1..20: mol_type = other DNA
tttttctttttttttcgaga

SEQ ID NO: 11777 - DNA, 20 bp, synthetic construct
  misc_feature 1..20: note = CRISPR gRNA sequence
  source 1..20: mol_type = other DNA
tttctttttttttcgagaca

SEQ ID NO: 11778 - DNA, 20 bp, synthetic construct
  misc_feature 1..20: note = CRISPR gRNA sequence
  source 1..20: mol_type = other DNA
agagtttcgctcttgttgcc

SEQ ID NO: 11779 - DNA, 20 bp, synthetic construct
  misc_feature 1..20: note = CRISPR gRNA sequence
  source 1..20: mol_type = other DNA
gagtttcgctcttgttgcca

SEQ ID NO: 11780 - DNA, 20 bp, synthetic construct
  misc_feature 1..20: note = CRISPR gRNA sequence
  source 1..20: mol_type = other DNA
ttcgctcttgttgccaaggc

SEQ ID NO: 11781 - DNA, 20 bp, synthetic construct
  misc_feature 1..20: note = CRISPR gRNA sequence
  source 1..20: mol_type = other DNA
cgctcttgttgccaaggctg

SEQ ID NO: 11782 - DNA, 20 bp, synthetic construct
  misc_feature 1..20: note = CRISPR gRNA sequence
  source 1..20: mol_type = other DNA
ttgttgccaaggctggagtg

SEQ ID NO: 11783 - DNA, 20 bp, synthetic construct
  misc_feature 1..20: note = CRISPR gRNA sequence
  source 1..20: mol_type = other DNA
ccaaggctggagtgcagtct

SEQ ID NO: 11784 - DNA, 20 bp, synthetic construct
  misc_feature 1..20: note = CRISPR gRNA sequence
  source 1..20: mol_type = other DNA
tcactgcaactccgcctccc

SEQ ID NO: 11785 - DNA, 20 bp, synthetic construct
  misc_feature 1..20: note = CRISPR gRNA sequence
  source 1..20: mol_type = other DNA
caactccgcctcccgagttc

SEQ ID NO: 11786 - DNA, 20 bp, synthetic construct
  misc_feature 1..20: note = CRISPR gRNA sequence
  source 1..20: mol_type = other DNA
ttcaagcaattctcctgcct

SEQ ID NO: 11787 - DNA, 20 bp, synthetic construct
  misc_feature 1..20: note = CRISPR gRNA sequence
  source 1..20: mol_type = other DNA
ttctcctgcctcagcctctc

SEQ ID NO: 11788 - DNA, 20 bp, synthetic construct
  misc_feature 1..20: note = CRISPR gRNA sequence
  source 1..20: mol_type = other DNA
tcctgcctcagcctctcaag

SEQ ID NO: 11789 - DNA, 20 bp, synthetic construct
  misc_feature 1..20: note = CRISPR gRNA sequence
  source 1..20: mol_type = other DNA
gcctcagcctctcaagtagc

SEQ ID NO: 11790 - DNA, 20 bp, synthetic construct
  misc_feature 1..20: note = CRISPR gRNA sequence
  source 1..20: mol_type = other DNA
cctcagcctctcaagtagct

SEQ ID NO: 11791 - DNA, 20 bp, synthetic construct
  misc_feature 1..20: note = CRISPR gRNA sequence
  source 1..20: mol_type = other DNA
tcagcctctcaagtagctgg

SEQ ID NO: 11792 - DNA, 20 bp, synthetic construct
  misc_feature 1..20: note = CRISPR gRNA sequence
  source 1..20: mol_type = other DNA
ctctcaagtagctgggagta

SEQ ID NO: 11793 - DNA, 20 bp, synthetic construct
  misc_feature 1..20: note = CRISPR gRNA sequence
  source 1..20: mol_type = other DNA
tctcaagtagctgggagtat

SEQ ID NO: 11794 - DNA, 20 bp, synthetic construct
  misc_feature 1..20: note = CRISPR gRNA sequence
  source 1..20: mol_type = other DNA
taggcatgtgccatcacacc

SEQ ID NO: 11795 - DNA, 20 bp, synthetic construct
  misc_feature 1..20: note = CRISPR gRNA sequence
  source 1..20: mol_type = other DNA
cccggctaattttgtatttt

SEQ ID NO: 11796 - DNA, 20 bp, synthetic construct
  misc_feature 1..20: note = CRISPR gRNA sequence
  source 1..20: mol_type = other DNA
ggctaattttgtatttttag

SEQ ID NO: 11797 - DNA, 20 bp, synthetic construct
  misc_feature 1..20: note = CRISPR gRNA sequence
  source 1..20: mol_type = other DNA
ctaattttgtatttttagta

SEQ ID NO: 11798 - DNA, 20 bp, synthetic construct
  misc_feature 1..20: note = CRISPR gRNA sequence
  source 1..20: mol_type = other DNA
ttttgtatttttagtagaga

SEQ ID NO: 11799 - DNA, 20 bp, synthetic construct
  misc_feature 1..20: note = CRISPR gRNA sequence
  source 1..20: mol_type = other DNA
tttgtatttttagtagagac

SEQ ID NO: 11800 - DNA, 20 bp, synthetic construct
  misc_feature 1..20: note = CRISPR gRNA sequence
  source 1..20: mol_type = other DNA
ttgtatttttagtagagacg

SEQ ID NO: 11801 - DNA, 20 bp, synthetic construct
  misc_feature 1..20: note = CRISPR gRNA sequence
  source 1..20: mol_type = other DNA
gagacggggtttctccatgt

SEQ ID NO: 11802 - DNA, 20 bp, synthetic construct
  misc_feature 1..20: note = CRISPR gRNA sequence
  source 1..20: mol_type = other DNA
cggggtttctccatgttggt

SEQ ID NO: 11803 - DNA, 20 bp, synthetic construct
  misc_feature 1..20: note = CRISPR gRNA sequence
  source 1..20: mol_type = other DNA
ggggtttctccatgttggtc

SEQ ID NO: 11804 - DNA, 20 bp, synthetic construct
  misc_feature 1..20: note = CRISPR gRNA sequence
  source 1..20: mol_type = other DNA
tttctccatgttggtcaggc

SEQ ID NO: 11805 - DNA, 20 bp, synthetic construct
  misc_feature 1..20: note = CRISPR gRNA sequence
  source 1..20: mol_type = other DNA
tggtctcaaactcccgacct

SEQ ID NO: 11806 - DNA, 20 bp, synthetic construct
  misc_feature 1..20: note = CRISPR gRNA sequence
  source 1..20: mol_type = other DNA
ggtctcaaactcccgacctt

SEQ ID NO: 11807 - DNA, 20 bp, synthetic construct
  misc_feature 1..20: note = CRISPR gRNA sequence
  source 1..20: mol_type = other DNA
cttaggtgatccacccgcct

SEQ ID NO: 11808 - DNA, 20 bp, synthetic construct
  misc_feature 1..20: note = CRISPR gRNA sequence
  source 1..20: mol_type = other DNA
tccacccgcctcggcctcca

SEQ ID NO: 11809 - DNA, 20 bp, synthetic construct
  misc_feature 1..20: note = CRISPR gRNA sequence
  source 1..20: mol_type = other DNA
cgcctcggcctccaaagtgt

SEQ ID NO: 11810 - DNA, 20 bp, synthetic construct
  misc_feature 1..20: note = CRISPR gRNA sequence
  source 1..20: mol_type = other DNA
gcctcggcctccaaagtgtt

SEQ ID NO: 11811 - DNA, 20 bp, synthetic construct
  misc_feature 1..20: note = CRISPR gRNA sequence
  source 1..20: mol_type = other DNA
cctccaaagtgttaggatta

SEQ ID NO: 11812 - DNA, 20 bp, synthetic construct
  misc_feature 1..20: note = CRISPR gRNA sequence
  source 1..20: mol_type = other DNA
ctccaaagtgttaggattac

SEQ ID NO: 11813 - DNA, 20 bp, synthetic construct
  misc_feature 1..20: note = CRISPR gRNA sequence
  source 1..20: mol_type = other DNA
agtgttaggattacaggcgt

SEQ ID NO: 11814 - DNA, 20 bp, synthetic construct
  misc_feature 1..20: note = CRISPR gRNA sequence
  source 1..20: mol_type = other DNA
gcacctgctgcttttatatg

SEQ ID NO: 11815 - DNA, 20 bp, synthetic construct
  misc_feature 1..20: note = CRISPR gRNA sequence
  source 1..20: mol_type = other DNA
gcttttatatgcagccctgc

SEQ ID NO: 11816 - DNA, 20 bp, synthetic construct
  misc_feature 1..20: note = CRISPR gRNA sequence
  source 1..20: mol_type = other DNA
cttttatatgcagccctgca

SEQ ID NO: 11817 - DNA, 20 bp, synthetic construct
  misc_feature 1..20: note = CRISPR gRNA sequence
  source 1..20: mol_type = other DNA
ttttatatgcagccctgcaa

SEQ ID NO: 11818 - DNA, 20 bp, synthetic construct
  misc_feature 1..20: note = CRISPR gRNA sequence
  source 1..20: mol_type = other DNA
ttatatgcagccctgcaagg

SEQ ID NO: 11819 - DNA, 20 bp, synthetic construct
  misc_feature 1..20: note = CRISPR gRNA sequence
  source 1..20: mol_type = other DNA
cagccctgcaagggagttct

SEQ ID NO: 11820 - DNA, 20 bp, synthetic construct
  misc_feature 1..20: note = CRISPR gRNA sequence
  source 1..20: mol_type = other DNA
agccctgcaagggagttctg

SEQ ID NO: 11821 - DNA, 20 bp, synthetic construct
  misc_feature 1..20: note = CRISPR gRNA sequence
  source 1..20: mol_type = other DNA
ggagttctgaggctgaatca

SEQ ID NO: 11822 - DNA, 20 bp, synthetic construct
  misc_feature 1..20: note = CRISPR gRNA sequence
  source 1..20: mol_type = other DNA
tctgaggctgaatcatggca

SEQ ID NO: 11823 - DNA, 20 bp, synthetic construct
  misc_feature 1..20: note = CRISPR gRNA sequence
  source 1..20: mol_type = other DNA
gctgaatcatggcaaagtca

SEQ ID NO: 11824 - DNA, 20 bp, synthetic construct
  misc_feature 1..20: note = CRISPR gRNA sequence
  source 1..20: mol_type = other DNA
tggccctgaaatcatacccg

SEQ ID NO: 11825 - DNA, 20 bp, synthetic construct
  misc_feature 1..20: note = CRISPR gRNA sequence
  source 1..20: mol_type = other DNA
ccctgaaatcatacccgcag

SEQ ID NO: 11826 - DNA, 20 bp, synthetic construct
  misc_feature 1..20: note = CRISPR gRNA sequence
  source 1..20: mol_type = other DNA
agcagcacctgacctgttaa

SEQ ID NO: 11827 - DNA, 20 bp, synthetic construct
  misc_feature 1..20: note = CRISPR gRNA sequence
  source 1..20: mol_type = other DNA
gcagcacctgacctgttaaa

SEQ ID NO: 11828 - DNA, 20 bp, synthetic construct
  misc_feature 1..20: note = CRISPR gRNA sequence
  source 1..20: mol_type = other DNA
tgacctgttaaaaggctgct

SEQ ID NO: 11829 - DNA, 20 bp, synthetic construct
  misc_feature 1..20: note = CRISPR gRNA sequence
  source 1..20: mol_type = other DNA
ttaaaaggctgcttggtgtc

SEQ ID NO: 11830 - DNA, 20 bp, synthetic construct
  misc_feature 1..20: note = CRISPR gRNA sequence
  source 1..20: mol_type = other DNA
gctgcttggtgtcgagtaaa

SEQ ID NO: 11831 - DNA, 20 bp, synthetic construct
  misc_feature 1..20: note = CRISPR gRNA sequence
  source 1..20: mol_type = other DNA
tggtgtcgagtaaacagctg

SEQ ID NO: 11832 - DNA, 20 bp, synthetic construct
  misc_feature 1..20: note = CRISPR gRNA sequence
  source 1..20: mol_type = other DNA
gtcgagtaaacagctgaagt

SEQ ID NO: 11833 - DNA, 20 bp, synthetic construct
  misc_feature 1..20: note = CRISPR gRNA sequence
  source 1..20: mol_type = other DNA
taaacagctgaagttggcat

SEQ ID NO: 11834 - DNA, 20 bp, synthetic construct
  misc_feature 1..20: note = CRISPR gRNA sequence
  source 1..20: mol_type = other DNA
attttcactgctactaatgc

SEQ ID NO: 11835 - DNA, 20 bp, synthetic construct
  misc_feature 1..20: note = CRISPR gRNA sequence
  source 1..20: mol_type = other DNA
tgctggttgtgaatatgctg

SEQ ID NO: 11836 - DNA, 20 bp, synthetic construct
  misc_feature 1..20: note = CRISPR gRNA sequence
  source 1..20: mol_type = other DNA
tgtgaatatgctgcagaaac

SEQ ID NO: 11837 - DNA, 20 bp, synthetic construct
  misc_feature 1..20: note = CRISPR gRNA sequence
  source 1..20: mol_type = other DNA
tgaatatgctgcagaaactg

SEQ ID NO: 11838 - DNA, 20 bp, synthetic construct
  misc_feature 1..20: note = CRISPR gRNA sequence
  source 1..20: mol_type = other DNA
tatgctgcagaaactggagc

SEQ ID NO: 11839 - DNA, 20 bp, synthetic construct
  misc_feature 1..20: note = CRISPR gRNA sequence
  source 1..20: mol_type = other DNA
tgcagaaactggagctggtc

SEQ ID NO: 11840 - DNA, 20 bp, synthetic construct
  misc_feature 1..20: note = CRISPR gRNA sequence
  source 1..20: mol_type = other DNA
actggagctggtccagtgac

SEQ ID NO: 11841 - DNA, 20 bp, synthetic construct
  misc_feature 1..20: note = CRISPR gRNA sequence
  source 1..20: mol_type = other DNA
gctttttctcttcctgcccc

SEQ ID NO: 11842 - DNA, 20 bp, synthetic construct
  misc_feature 1..20: note = CRISPR gRNA sequence
  source 1..20: mol_type = other DNA
tctcttcctgcccccagtgc

SEQ ID NO: 11843 - DNA, 20 bp, synthetic construct
  misc_feature 1..20: note = CRISPR gRNA sequence
  source 1..20: mol_type = other DNA
tcaccaatgttcctgtgatg

SEQ ID NO: 11844 - DNA, 20 bp, synthetic construct
  misc_feature 1..20: note = CRISPR gRNA sequence
  source 1..20: mol_type = other DNA
caatgttcctgtgatgtagt

SEQ ID NO: 11845 - DNA, 20 bp, synthetic construct
  misc_feature 1..20: note = CRISPR gRNA sequence
  source 1..20: mol_type = other DNA
ctgtgatgtagtcagaacca

SEQ ID NO: 11846 - DNA, 20 bp, synthetic construct
  misc_feature 1..20: note = CRISPR gRNA sequence
  source 1..20: mol_type = other DNA
tcagaaccatagctaacatt

SEQ ID NO: 11847 - DNA, 20 bp, synthetic construct
  misc_feature 1..20: note = CRISPR gRNA sequence
  source 1..20: mol_type = other DNA
agctaacatttagttcattc

SEQ ID NO: 11848 - DNA, 20 bp, synthetic construct
  misc_feature 1..20: note = CRISPR gRNA sequence
  source 1..20: mol_type = other DNA
gctaacatttagttcattct

SEQ ID NO: 11849 - DNA, 20 bp, synthetic construct
  misc_feature 1..20: note = CRISPR gRNA sequence
  source 1..20: mol_type = other DNA
tttagttcattctaggcacc

SEQ ID NO: 11850 - DNA, 20 bp, synthetic construct
  misc_feature 1..20: note = CRISPR gRNA sequence
  source 1..20: mol_type = other DNA
ttagttcattctaggcacca

SEQ ID NO: 11851 - DNA, 20 bp, synthetic construct
  misc_feature 1..20: note = CRISPR gRNA sequence
  source 1..20: mol_type = other DNA
gcatgttctaaatgttatat

SEQ ID NO: 11852 - DNA, 20 bp, synthetic construct
  misc_feature 1..20: note = CRISPR gRNA sequence
  source 1..20: mol_type = other DNA
actctatcatgcccatttta

SEQ ID NO: 11853 - DNA, 20 bp, synthetic construct
  misc_feature 1..20: note = CRISPR gRNA sequence
  source 1..20: mol_type = other DNA
tatcatgcccattttacaga

SEQ ID NO: 11854 - DNA, 20 bp, synthetic construct
  misc_feature 1..20: note = CRISPR gRNA sequence
  source 1..20: mol_type = other DNA
atcatgcccattttacagat

SEQ ID NO: 11855 - DNA, 20 bp, synthetic construct
  misc_feature 1..20: note = CRISPR gRNA sequence
  source 1..20: mol_type = other DNA
attttacagatgggcaaact

SEQ ID NO: 11856 - DNA, 20 bp, synthetic construct
  misc_feature 1..20: note = CRISPR gRNA sequence
  source 1..20: mol_type = other DNA
cagatgggcaaactgagtct

SEQ ID NO: 11857 - DNA, 20 bp, synthetic construct
  misc_feature 1..20: note = CRISPR gRNA sequence
  source 1..20: mol_type = other DNA
atgggcaaactgagtctcag

SEQ ID NO: 11858 - DNA, 20 bp, synthetic construct
  misc_feature 1..20: note = CRISPR gRNA sequence
  source 1..20: mol_type = other DNA
gggcaaactgagtctcagaa

SEQ ID NO: 11859 - DNA, 20 bp, synthetic construct
  misc_feature 1..20: note = CRISPR gRNA sequence
  source 1..20: mol_type = other DNA
aactgagtctcagaagagtt

SEQ ID NO: 11860 - DNA, 20 bp, synthetic construct
  misc_feature 1..20: note = CRISPR gRNA sequence
  source 1..20: mol_type = other DNA
tgagtctcagaagagttgag

SEQ ID NO: 11861 - DNA, 20 bp, synthetic construct
  misc_feature 1..20: note = CRISPR gRNA sequence
  source 1..20: mol_type = other DNA
aagagttgagtagcttgccc

SEQ ID NO: 11862 - DNA, 20 bp, synthetic construct
  misc_feature 1..20: note = CRISPR gRNA sequence
  source 1..20: mol_type = other DNA
agagttgagtagcttgccca

SEQ ID NO: 11863 - DNA, 20 bp, synthetic construct
  misc_feature 1..20: note = CRISPR gRNA sequence
  source 1..20: mol_type = other DNA
gtagcttgcccaaggtcaca

SEQ ID NO: 11864 - DNA, 20 bp, synthetic construct
  misc_feature 1..20: note = CRISPR gRNA sequence
  source 1..20: mol_type = other DNA
tagcttgcccaaggtcacat

SEQ ID NO: 11865 - DNA, 20 bp, synthetic construct
  misc_feature 1..20: note = CRISPR gRNA sequence
  source 1..20: mol_type = other DNA
cttgcccaaggtcacatagg

SEQ ID NO: 11866 - DNA, 20 bp, synthetic construct
  misc_feature 1..20: note = CRISPR gRNA sequence
  source 1..20: mol_type = other DNA
cccaaggtcacataggcagt

SEQ ID NO: 11867 - DNA, 20 bp, synthetic construct
  misc_feature 1..20: note = CRISPR gRNA sequence
  source 1..20: mol_type = other DNA
caaggtcacataggcagtaa

SEQ ID NO: 11868 - DNA, 20 bp, synthetic construct
  misc_feature 1..20: note = CRISPR gRNA sequence
  source 1..20: mol_type = other DNA
aaggtcacataggcagtaag

SEQ ID NO: 11869 - DNA, 20 bp, synthetic construct
  misc_feature 1..20: note = CRISPR gRNA sequence
  source 1..20: mol_type = other DNA
cacataggcagtaagaggca

SEQ ID NO: 11870 - DNA, 20 bp, synthetic construct
  misc_feature 1..20: note = CRISPR gRNA sequence
  source 1..20: mol_type = other DNA
taggcagtaagaggcatagc

SEQ ID NO: 11871 - DNA, 20 bp, synthetic construct
  misc_feature 1..20: note = CRISPR gRNA sequence
  source 1..20: mol_type = other DNA
aggcagtaagaggcatagct

SEQ ID NO: 11872 - DNA, 20 bp, synthetic construct
  misc_feature 1..20: note = CRISPR gRNA sequence
  source 1..20: mol_type = other DNA
gcatagctgggatttgaact

SEQ ID NO: 11873 - DNA, 20 bp, synthetic construct
  misc_feature 1..20: note = CRISPR gRNA sequence
  source 1..20: mol_type = other DNA
catagctgggatttgaactt

SEQ ID NO: 11874 - DNA, 20 bp, synthetic construct
  misc_feature 1..20: note = CRISPR gRNA sequence
  source 1..20: mol_type = other DNA
agctgggatttgaacttggg

SEQ ID NO: 11875 - DNA, 20 bp, synthetic construct
  misc_feature 1..20: note = CRISPR gRNA sequence
  source 1..20: mol_type = other DNA
aacttgggaagttgttctga

SEQ ID NO: 11876 - DNA, 20 bp, synthetic construct
  misc_feature 1..20: note = CRISPR gRNA sequence
  source 1..20: mol_type = other DNA
ttgttctgacagtttccaca

SEQ ID NO: 11877 - DNA, 20 bp, synthetic construct
  misc_feature 1..20: note = CRISPR gRNA sequence
  source 1..20: mol_type = other DNA
tctgacagtttccacacagt

SEQ ID NO: 11878 - DNA, 20 bp, synthetic construct
  misc_feature 1..20: note = CRISPR gRNA sequence
  source 1..20: mol_type = other DNA
ctgacagtttccacacagta

SEQ ID NO: 11879 - DNA, 20 bp, synthetic construct
  misc_feature 1..20: note = CRISPR gRNA sequence
  source 1..20: mol_type = other DNA
cagtttccacacagtaaggc

SEQ ID NO: 11880 - DNA, 20 bp, synthetic construct
  misc_feature 1..20: note = CRISPR gRNA sequence
  source 1..20: mol_type = other DNA
ggcaagaaatgacttccttt

SEQ ID NO: 11881 - DNA, 20 bp, synthetic construct
  misc_feature 1..20: note = CRISPR gRNA sequence
  source 1..20: mol_type = other DNA
ttttagtcctgctgttttcc

SEQ ID NO: 11882 - DNA, 20 bp, synthetic construct
  misc_feature 1..20: note = CRISPR gRNA sequence
  source 1..20: mol_type = other DNA
tttagtcctgctgttttcct

SEQ ID NO: 11883 - DNA, 20 bp, synthetic construct
  misc_feature 1..20: note = CRISPR gRNA sequence
  source 1..20: mol_type = other DNA
ctgggctcactgtttgacca

SEQ ID NO: 11884 - DNA, 20 bp, synthetic construct
  misc_feature 1..20: note = CRISPR gRNA sequence
  source 1..20: mol_type = other DNA
gggctcactgtttgaccaca

SEQ ID NO: 11885 - DNA, 20 bp, synthetic construct
  misc_feature 1..20: note = CRISPR gRNA sequence
  source 1..20: mol_type = other DNA
ctcactgtttgaccacagag

SEQ ID NO: 11886 - DNA, 20 bp, synthetic construct
  misc_feature 1..20: note = CRISPR gRNA sequence
  source 1..20: mol_type = other DNA
actgtttgaccacagagaag

SEQ ID NO: 11887 - DNA, 20 bp, synthetic construct
  misc_feature 1..20: note = CRISPR gRNA sequence
  source 1..20: mol_type = other DNA
gagaagtggtctcaactctc

SEQ ID NO: 11888 - DNA, 20 bp, synthetic construct
  misc_feature 1..20: note = CRISPR gRNA sequence
  source 1..20: mol_type = other DNA
agaagtggtctcaactctct

SEQ ID NO: 11889 - DNA, 20 bp, synthetic construct
  misc_feature 1..20: note = CRISPR gRNA sequence
  source 1..20: mol_type = other DNA
ggtctcaactctctgggtct

SEQ ID NO: 11890 - DNA, 20 bp, synthetic construct
  misc_feature 1..20: note = CRISPR gRNA sequence
  source 1..20: mol_type = other DNA
tggtttgcctgtctttaaaa

SEQ ID NO: 11891 - DNA, 20 bp, synthetic construct
  misc_feature 1..20: note = CRISPR gRNA sequence
  source 1..20: mol_type = other DNA
ggtttgcctgtctttaaaat

SEQ ID NO: 11892 - DNA, 20 bp, synthetic construct
  misc_feature 1..20: note = CRISPR gRNA sequence
  source 1..20: mol_type = other DNA
gtttgcctgtctttaaaatg

SEQ ID NO: 11893 - DNA, 20 bp, synthetic construct
  misc_feature 1..20: note = CRISPR gRNA sequence
  source 1..20: mol_type = other DNA
tgcctgtctttaaaatgggg

SEQ ID NO: 11894 - DNA, 20 bp, synthetic construct
  misc_feature 1..20: note = CRISPR gRNA sequence
  source 1..20: mol_type = other DNA
ttaaaatggggcagtaatcc

SEQ ID NO: 11895 - DNA, 20 bp, synthetic construct
  misc_feature 1..20: note = CRISPR gRNA sequence
  source 1..20: mol_type = other DNA
aaatggggcagtaatcccag

SEQ ID NO: 11896 - DNA, 20 bp, synthetic construct
  misc_feature 1..20: note = CRISPR gRNA sequence
  source 1..20: mol_type = other DNA
aatggggcagtaatcccagt

SEQ ID NO: 11897 - DNA, 20 bp, synthetic construct
  misc_feature 1..20: note = CRISPR gRNA sequence
  source 1..20: mol_type = other DNA
ggggcagtaatcccagtagg

SEQ ID NO: 11898 - DNA, 20 bp, synthetic construct
  misc_feature 1..20: note = CRISPR gRNA sequence
  source 1..20: mol_type = other DNA
ccagtaggtggtgactccca

SEQ ID NO: 11899 - DNA, 20 bp, synthetic construct
  misc_feature 1..20: note = CRISPR gRNA sequence
  source 1..20: mol_type = other DNA
cagtaggtggtgactcccac

SEQ ID NO: 11900 - DNA, 20 bp, synthetic construct
  misc_feature 1..20: note = CRISPR gRNA sequence
  source 1..20: mol_type = other DNA
agtaggtggtgactcccacg

SEQ ID NO: 11901 - DNA, 20 bp, synthetic construct
  misc_feature 1..20: note = CRISPR gRNA sequence
  source 1..20: mol_type = other DNA
actcccacggggctgacctc

SEQ ID NO: 11902 - DNA, 20 bp, synthetic construct
  misc_feature 1..20: note = CRISPR gRNA sequence
  source 1..20: mol_type = other DNA
ctcccacggggctgacctcc

SEQ ID NO: 11903 - DNA, 20 bp, synthetic construct
  misc_feature 1..20: note = CRISPR gRNA sequence
  source 1..20: mol_type = other DNA
cggggctgacctccaggctg

SEQ ID NO: 11904 - DNA, 20 bp, synthetic construct
  misc_feature 1..20: note = CRISPR gRNA sequence
  source 1..20: mol_type = other DNA
ggggctgacctccaggctgc

SEQ ID NO: 11905 - DNA, 20 bp, synthetic construct
  misc_feature 1..20: note = CRISPR gRNA sequence
  source 1..20: mol_type = other DNA
gggctgacctccaggctgca

SEQ ID NO: 11906 - DNA, 20 bp, synthetic construct
  misc_feature 1..20: note = CRISPR gRNA sequence
  source 1..20: mol_type = other DNA
ggctgacctccaggctgcag

SEQ ID NO: 11907 - DNA, 20 bp, synthetic construct
  misc_feature 1..20: note = CRISPR gRNA sequence
  source 1..20: mol_type = other DNA
tccaggctgcaggggacact

SEQ ID NO: 11908 - DNA, 20 bp, synthetic construct
  misc_feature 1..20: note = CRISPR gRNA sequence
  source 1..20: mol_type = other DNA
tgcaggggacactgagatcc

SEQ ID NO: 11909 - DNA, 20 bp, synthetic construct
  misc_feature 1..20: note = CRISPR gRNA sequence
  source 1..20: mol_type = other DNA
aggggacactgagatcctag

SEQ ID NO: 11910 - DNA, 20 bp, synthetic construct
  misc_feature 1..20: note = CRISPR gRNA sequence
  source 1..20: mol_type = other DNA
gatcctagaagcaatcacca

SEQ ID NO: 11911 - DNA, 20 bp, synthetic construct
  misc_feature 1..20: note = CRISPR gRNA sequence
  source 1..20: mol_type = other DNA
caatcaccacagccctgaac

SEQ ID NO: 11912 - DNA, 20 bp, synthetic construct
  misc_feature 1..20: note = CRISPR gRNA sequence
  source 1..20: mol_type = other DNA
atcaccacagccctgaacaa

SEQ ID NO: 11913 - DNA, 20 bp, synthetic construct
  misc_feature 1..20: note = CRISPR gRNA sequence
  source 1..20: mol_type = other DNA
acagccctgaacaagagaac

SEQ ID NO: 11914 - DNA, 20 bp, synthetic construct
  misc_feature 1..20: note = CRISPR gRNA sequence
  source 1..20: mol_type = other DNA
gccctgaacaagagaactag

SEQ ID NO: 11915 - DNA, 20 bp, synthetic construct
  misc_feature 1..20: note = CRISPR gRNA sequence
  source 1..20: mol_type = other DNA
ccctgaacaagagaactagt

SEQ ID NO: 11916 - DNA, 20 bp, synthetic construct
  misc_feature 1..20: note = CRISPR gRNA sequence
  source 1..20: mol_type = other DNA
acaagagaactagtgggacc

SEQ ID NO: 11917 - DNA, 20 bp, synthetic construct
  misc_feature 1..20: note = CRISPR gRNA sequence
  source 1..20: mol_type = other DNA
caagagaactagtgggacct

SEQ ID NO: 11918 - DNA, 20 bp, synthetic construct
  misc_feature 1..20: note = CRISPR gRNA sequence
  source 1..20: mol_type = other DNA
aagagaactagtgggacctg

SEQ ID NO: 11919 - DNA, 20 bp, synthetic construct
  misc_feature 1..20: note = CRISPR gRNA sequence
  source 1..20: mol_type = other DNA
gaactagtgggacctgggga

SEQ ID NO: 11920 - DNA, 20 bp, synthetic construct
  misc_feature 1..20: note = CRISPR gRNA sequence
  source 1..20: mol_type = other DNA
gacctggggacagaaacttt

SEQ ID NO: 11921 - DNA, 20 bp, synthetic construct
  misc_feature 1..20: note = CRISPR gRNA sequence
  source 1..20: mol_type = other DNA
tggggacagaaactttgagc

SEQ ID NO: 11922 - DNA, 20 bp, synthetic construct
  misc_feature 1..20: note = CRISPR gRNA sequence
  source 1..20: mol_type = other DNA
gcaagtcacttattcattcc

SEQ ID NO: 11923 - DNA, 20 bp, synthetic construct
  misc_feature 1..20: note = CRISPR gRNA sequence
  source 1..20: mol_type = other DNA
ctagcctctattttcatatc

SEQ ID NO: 11924 - DNA, 20 bp, synthetic construct
  misc_feature 1..20: note = CRISPR gRNA sequence
  source 1..20: mol_type = other DNA
ctattttcatatctagaaaa

SEQ ID NO: 11925 - DNA, 20 bp, synthetic construct
  misc_feature 1..20: note = CRISPR gRNA sequence
  source 1..20: mol_type = other DNA
tattttcatatctagaaaat

SEQ ID NO: 11926 - DNA, 20 bp, synthetic construct
  misc_feature 1..20: note = CRISPR gRNA sequence
  source 1..20: mol_type = other DNA
gaaaatgggaaccatcccaa

SEQ ID NO: 11927 - DNA, 20 bp, synthetic construct
  misc_feature 1..20: note = CRISPR gRNA sequence
  source 1..20: mol_type = other DNA
accatcccaatggcctatgt

SEQ ID NO: 11928 - DNA, 20 bp, synthetic construct
  misc_feature 1..20: note = CRISPR gRNA sequence
  source 1..20: mol_type = other DNA
caatggcctatgtaagtact

SEQ ID NO: 11929 - DNA, 20 bp, synthetic construct
  misc_feature 1..20: note = CRISPR gRNA sequence
  source 1..20: mol_type = other DNA
gtaagtacttggcacaatgc

SEQ ID NO: 11930 - DNA, 20 bp, synthetic construct
  misc_feature 1..20: note = CRISPR gRNA sequence
  source 1..20: mol_type = other DNA
taagtacttggcacaatgcc

SEQ ID NO: 11931 - DNA, 20 bp, synthetic construct
  misc_feature 1..20: note = CRISPR gRNA sequence
  source 1..20: mol_type = other DNA
taaatattgattccttcccc

SEQ ID NO: 11932 - DNA, 20 bp, synthetic construct
  misc_feature 1..20: note = CRISPR gRNA sequence
  source 1..20: mol_type = other DNA
aaatattgattccttccccc

SEQ ID NO: 11933 - DNA, 20 bp, synthetic construct
  misc_feature 1..20: note = CRISPR gRNA sequence
  source 1..20: mol_type = other DNA
aatattgattccttccccca

SEQ ID NO: 11934 - DNA, 20 bp, synthetic construct
  misc_feature 1..20: note = CRISPR gRNA sequence
  source 1..20: mol_type = other DNA
ttgattccttcccccaggga

SEQ ID NO: 11935 - DNA, 20 bp, synthetic construct
  misc_feature 1..20: note = CRISPR gRNA sequence
  source 1..20: mol_type = other DNA
attccttcccccagggatag

SEQ ID NO: 11936 - DNA, 20 bp, synthetic construct
  misc_feature 1..20: note = CRISPR gRNA sequence
  source 1..20: mol_type = other DNA
ttccttcccccagggatagt

SEQ ID NO: 11937 - DNA, 20 bp, synthetic construct
  misc_feature 1..20: note = CRISPR gRNA sequence
  source 1..20: mol_type = other DNA
tcccccagggatagtgggac

SEQ ID NO: 11938 - DNA, 20 bp, synthetic construct
  misc_feature 1..20: note = CRISPR gRNA sequence
  source 1..20: mol_type = other DNA
cccccagggatagtgggacc

SEQ ID NO: 11939 - DNA, 20 bp, synthetic construct
  misc_feature 1..20: note = CRISPR gRNA sequence
  source 1..20: mol_type = other DNA
tagtgggaccaggctttttc

SEQ ID NO: 11940 - DNA, 20 bp, synthetic construct
  misc_feature 1..20: note = CRISPR gRNA sequence
  source 1..20: mol_type = other DNA
accaggctttttctggaatc

SEQ ID NO: 11941 - DNA, 20 bp, synthetic construct
  misc_feature 1..20: note = CRISPR gRNA sequence
  source 1..20: mol_type = other DNA
ccaggctttttctggaatct

SEQ ID NO: 11942 - DNA, 20 bp, synthetic construct
  misc_feature 1..20: note = CRISPR gRNA sequence
  source 1..20: mol_type = other DNA
caggctttttctggaatcta

SEQ ID NO: 11943 - DNA, 20 bp, synthetic construct
  misc_feature 1..20: note = CRISPR gRNA sequence
  source 1..20: mol_type = other DNA
ctttttctggaatctaggga

SEQ ID NO: 11944 - DNA, 20 bp, synthetic construct
  misc_feature 1..20: note = CRISPR gRNA sequence
  source 1..20: mol_type = other DNA
tttctggaatctagggatgg

SEQ ID NO: 11945 - DNA, 20 bp, synthetic construct
  misc_feature 1..20: note = CRISPR gRNA sequence
  source 1..20: mol_type = other DNA
aatctagggatggtggcttc

SEQ ID NO: 11946 - DNA, 20 bp, synthetic construct
  misc_feature 1..20: note = CRISPR gRNA sequence
  source 1..20: mol_type = other DNA
ctagggatggtggcttctgg

SEQ ID NO: 11947 - DNA, 20 bp, synthetic construct
  misc_feature 1..20: note = CRISPR gRNA sequence
  source 1..20: mol_type = other DNA
tagggatggtggcttctgga

SEQ ID NO: 11948 - DNA, 20 bp, synthetic construct
  misc_feature 1..20: note = CRISPR gRNA sequence
  source 1..20: mol_type = other DNA
tctggaaggctgaccatgca

SEQ ID NO: 11949 - DNA, 20 bp, synthetic construct
  misc_feature 1..20: note = CRISPR gRNA sequence
  source 1..20: mol_type = other DNA
ctggaaggctgaccatgcac

SEQ ID NO: 11950 - DNA, 20 bp, synthetic construct
  misc_feature 1..20: note = CRISPR gRNA sequence
  source 1..20: mol_type = other DNA
aggcctccaatccctccccc

SEQ ID NO: 11951 - DNA, 20 bp, synthetic construct
  misc_feature 1..20: note = CRISPR gRNA sequence
  source 1..20: mol_type = other DNA
cccctggcctctgtttccga

SEQ ID NO: 11952 - DNA, 20 bp, synthetic construct
  misc_feature 1..20: note = CRISPR gRNA sequence
  source 1..20: mol_type = other DNA
caataactgcatctgcgacg

SEQ ID NO: 11953 - DNA, 20 bp, synthetic construct
  misc_feature 1..20: note = CRISPR gRNA sequence
  source 1..20: mol_type = other DNA
aataactgcatctgcgacgt

SEQ ID NO: 11954 - DNA, 20 bp, synthetic construct
  misc_feature 1..20: note = CRISPR gRNA sequence
  source 1..20: mol_type = other DNA
taactgcatctgcgacgtgg

SEQ ID NO: 11955 - DNA, 20 bp, synthetic construct
  misc_feature 1..20: note = CRISPR gRNA sequence
  source 1..20: mol_type = other DNA
gcatctgcgacgtgggagcc

SEQ ID NO: 11956 - DNA, 20 bp, synthetic construct
  misc_feature 1..20: note = CRISPR gRNA sequence
  source 1..20: mol_type = other DNA
atctgcgacgtgggagccga

SEQ ID NO: 11957 - DNA, 20 bp, synthetic construct
  misc_feature 1..20: note = CRISPR gRNA sequence
  source 1..20: mol_type = other DNA
cgacgtgggagccgagagct

SEQ ID NO: 11958 - DNA, 20 bp, synthetic construct
  misc_feature 1..20: note = CRISPR gRNA sequence
  source 1..20: mol_type = other DNA
gagcttggctcgtgtgcttc

SEQ ID NO: 11959 - DNA, 20 bp, synthetic construct
  misc_feature 1..20: note = CRISPR gRNA sequence
  source 1..20: mol_type = other DNA
ggctcgtgtgcttccggaca

SEQ ID NO: 11960 - DNA, 20 bp, synthetic construct
  misc_feature 1..20: note = CRISPR gRNA sequence
  source 1..20: mol_type = other DNA
ttccggacatggtgtccctc

SEQ ID NO: 11961 - DNA, 20 bp, synthetic construct
  misc_feature 1..20: note = CRISPR gRNA sequence
  source 1..20: mol_type = other DNA
tccggacatggtgtccctcc

SEQ ID NO: 11962 - DNA, 20 bp, synthetic construct
  misc_feature 1..20: note = CRISPR gRNA sequence
  source 1..20: mol_type = other DNA
catggtgtccctccgggtga

SEQ ID NO: 11963 - DNA, 20 bp, synthetic construct
  misc_feature 1..20: note = CRISPR gRNA sequence
  source 1..20: mol_type = other DNA
tggtgtccctccgggtgatg

SEQ ID NO: 11964 - DNA, 20 bp, synthetic construct
  misc_feature 1..20: note = CRISPR gRNA sequence
  source 1..20: mol_type = other DNA
gtccctccgggtgatggagt

SEQ ID NO: 11965 - DNA, 20 bp, synthetic construct
  misc_feature 1..20: note = CRISPR gRNA sequence
  source 1..20: mol_type = other DNA
tccgggtgatggagtgagtg

SEQ ID NO: 11966 - DNA, 20 bp, synthetic construct
  misc_feature 1..20: note = CRISPR gRNA sequence
  source 1..20: mol_type = other DNA
ccgggtgatggagtgagtgt

SEQ ID NO: 11967 - DNA, 20 bp, synthetic construct
  misc_feature 1..20: note = CRISPR gRNA sequence
  source 1..20: mol_type = other DNA
gggtgatggagtgagtgtgg

SEQ ID NO: 11968 - DNA, 20 bp, synthetic construct
  misc_feature 1..20: note = CRISPR gRNA sequence
  source 1..20: mol_type = other DNA
atggagtgagtgtgggagtc

SEQ ID NO: 11969 - DNA, 20 bp, synthetic construct
  misc_feature 1..20: note = CRISPR gRNA sequence
  source 1..20: mol_type = other DNA
tggagtgagtgtgggagtct

SEQ ID NO: 11970 - DNA, 20 bp, synthetic construct
  misc_feature 1..20: note = CRISPR gRNA sequence
  source 1..20: mol_type = other DNA
agtgagtgtgggagtctggg

SEQ ID NO: 11971 - DNA, 20 bp, synthetic construct
  misc_feature 1..20: note = CRISPR gRNA sequence
  source 1..20: mol_type = other DNA
gagtgtgggagtctgggcgg

SEQ ID NO: 11972 - DNA, 20 bp, synthetic construct
  misc_feature 1..20: note = CRISPR gRNA sequence
  source 1..20: mol_type = other DNA
agtgtgggagtctgggcggt

SEQ ID NO: 11973 - DNA, 20 bp, synthetic construct
  misc_feature 1..20: note = CRISPR gRNA sequence
  source 1..20: mol_type = other DNA
gtgggagtctgggcggtggg

SEQ ID NO: 11974 - DNA, 20 bp, synthetic construct
  misc_feature 1..20: note = CRISPR gRNA sequence
  source 1..20: mol_type = other DNA
agtctgggcggtgggtggct

SEQ ID NO: 11975 - DNA, 20 bp, synthetic construct
  misc_feature 1..20: note = CRISPR gRNA sequence
  source 1..20: mol_type = other DNA
gggcggtgggtggctcagcc

SEQ ID NO: 11976 - DNA, 20 bp, synthetic construct
  misc_feature 1..20: note = CRISPR gRNA sequence
  source 1..20: mol_type = other DNA
ggcggtgggtggctcagccc

SEQ ID NO: 11977 - DNA, 20 bp, synthetic construct
  misc_feature 1..20: note = CRISPR gRNA sequence
  source 1..20: mol_type = other DNA
gcggtgggtggctcagcccg

SEQ ID NO: 11978 - DNA, 20 bp, synthetic construct
  misc_feature 1..20: note = CRISPR gRNA sequence
  source 1..20: mol_type = other DNA
gtgggtggctcagcccgggg

SEQ ID NO: 11979 - DNA, 20 bp, synthetic construct
  misc_feature 1..20: note = CRISPR gRNA sequence
  source 1..20: mol_type = other DNA
tgggtggctcagcccggggt

SEQ ID NO: 11980 - DNA, 20 bp, synthetic construct
  misc_feature 1..20: note = CRISPR gRNA sequence
  source 1..20: mol_type = other DNA
ggtggctcagcccggggtgg

SEQ ID NO: 11981 - DNA, 20 bp, synthetic construct
  misc_feature 1..20: note = CRISPR gRNA sequence
  source 1..20: mol_type = other DNA
gcccggggtgggagacactg

SEQ ID NO: 11982 - DNA, 20 bp, synthetic construct
  misc_feature 1..20: note = CRISPR gRNA sequence
  source 1..20: mol_type = other DNA
gagacactgaagtctctccc

SEQ ID NO: 11983 - DNA, 20 bp, synthetic construct
  misc_feature 1..20: note = CRISPR gRNA sequence
  source 1..20: mol_type = other DNA
gaagtctctccctggtgtcc

SEQ ID NO: 11984 - DNA, 20 bp, synthetic construct
  misc_feature 1..20: note = CRISPR gRNA sequence
  source 1..20: mol_type = other DNA
gtctctccctggtgtcctgg

SEQ ID NO: 11985 - DNA, 20 bp, synthetic construct
  misc_feature 1..20: note = CRISPR gRNA sequence
  source 1..20: mol_type = other DNA
ctctccctggtgtcctggaa

SEQ ID NO: 11986 - DNA, 20 bp, synthetic construct
  misc_feature 1..20: note = CRISPR gRNA sequence
  source 1..20: mol_type = other DNA
ccctggtgtcctggaagagc

SEQ ID NO: 11987 - DNA, 20 bp, synthetic construct
  misc_feature 1..20: note = CRISPR gRNA sequence
  source 1..20: mol_type = other DNA
tgtcctggaagagctggatg

SEQ ID NO: 11988 - DNA, 20 bp, synthetic construct
  misc_feature 1..20: note = CRISPR gRNA sequence
  source 1..20: mol_type = other DNA
gtcctggaagagctggatgt

SEQ ID NO: 11989 - DNA, 20 bp, synthetic construct
  misc_feature 1..20: note = CRISPR gRNA sequence
  source 1..20: mol_type = other DNA
tcctggaagagctggatgtg

SEQ ID NO: 11990 - DNA, 20 bp, synthetic construct
  misc_feature 1..20: note = CRISPR gRNA sequence
  source 1..20: mol_type = other DNA
cctggaagagctggatgtgg

SEQ ID NO: 11991 - DNA, 20 bp, synthetic construct
  misc_feature 1..20: note = CRISPR gRNA sequence
  source 1..20: mol_type = other DNA
ggaagagctggatgtggggg

SEQ ID NO: 11992 - DNA, 20 bp, synthetic construct
  misc_feature 1..20: note = CRISPR gRNA sequence
  source 1..20: mol_type = other DNA
gctggatgtgggggtggcct

SEQ ID NO: 11993 - DNA, 20 bp, synthetic construct
  misc_feature 1..20: note = CRISPR gRNA sequence
  source 1..20: mol_type = other DNA
atgtgggggtggccttggtc

SEQ ID NO: 11994 - DNA, 20 bp, synthetic construct
  misc_feature 1..20: note = CRISPR gRNA sequence
  source 1..20: mol_type = other DNA
gtgggggtggccttggtctg

SEQ ID NO: 11995 - DNA, 20 bp, synthetic construct
  misc_feature 1..20: note = CRISPR gRNA sequence
  source 1..20: mol_type = other DNA
gggtggccttggtctggagc

SEQ ID NO: 11996 - DNA, 20 bp, synthetic construct
  misc_feature 1..20: note = CRISPR gRNA sequence
  source 1..20: mol_type = other DNA
ggtggccttggtctggagct

SEQ ID NO: 11997 - DNA, 20 bp, synthetic construct
  misc_feature 1..20: note = CRISPR gRNA sequence
  source 1..20: mol_type = other DNA
gtggccttggtctggagctg

SEQ ID NO: 11998 - DNA, 20 bp, synthetic construct
  misc_feature 1..20: note = CRISPR gRNA sequence
  source 1..20: mol_type = other DNA
ggccttggtctggagctggg

SEQ ID NO: 11999 - DNA, 20 bp, synthetic construct
  misc_feature 1..20: note = CRISPR gRNA sequence
  source 1..20: mol_type = other DNA
gtctggagctggggagtccc

SEQ ID NO: 12000 - DNA, 20 bp, synthetic construct
  misc_feature 1..20: note = CRISPR gRNA sequence
  source 1..20: mol_type = other DNA
tctggagctggggagtccca

SEQ ID NO: 12001 - DNA, 20 bp, synthetic construct
  misc_feature 1..20: note = CRISPR gRNA sequence
  source 1..20: mol_type = other DNA
ctggagctggggagtcccaa

SEQ ID NO: 12002 - DNA, 20 bp, synthetic construct
  misc_feature 1..20: note = CRISPR gRNA sequence
  source 1..20: mol_type = other DNA
agctggggagtcccaagggc

SEQ ID NO: 12003 - DNA, 20 bp, synthetic construct
  misc_feature 1..20: note = CRISPR gRNA sequence
  source 1..20: mol_type = other DNA
gctggggagtcccaagggcc

SEQ ID NO: 12004 - DNA, 20 bp, synthetic construct
  misc_feature 1..20: note = CRISPR gRNA sequence
  source 1..20: mol_type = other DNA
agtcccaagggccaggcccc

SEQ ID NO: 12005 - DNA, 20 bp, synthetic construct
  misc_feature 1..20: note = CRISPR gRNA sequence
  source 1..20: mol_type = other DNA
gtcccaagggccaggcccca

SEQ ID NO: 12006 - DNA, 20 bp, synthetic construct
  misc_feature 1..20: note = CRISPR gRNA sequence
  source 1..20: mol_type = other DNA
caagggccaggccccaaggt

SEQ ID NO: 12007 - DNA, 20 bp, synthetic construct
  misc_feature 1..20: note = CRISPR gRNA sequence
  source 1..20: mol_type = other DNA
ccaaggtgagtttctcttgc

SEQ ID NO: 12008 - DNA, 20 bp, synthetic construct
  misc_feature 1..20: note = CRISPR gRNA sequence
  source 1..20: mol_type = other DNA
gagtttctcttgccagcgtc

SEQ ID NO: 12009 - DNA, 20 bp, synthetic construct
  misc_feature 1..20: note = CRISPR gRNA sequence
  source 1..20: mol_type = other DNA
ttgccagcgtccagtacaac

SEQ ID NO: 12010 - DNA, 20 bp, synthetic construct
  misc_feature 1..20: note = CRISPR gRNA sequence
  source 1..20: mol_type = other DNA
cgtccagtacaacaagttca

SEQ ID NO: 12011 - DNA, 20 bp, synthetic construct
  misc_feature 1..20: note = CRISPR gRNA sequence
  source 1..20: mol_type = other DNA
tacaacaagttcacggctgc

SEQ ID NO: 12012 - DNA, 20 bp, synthetic construct
  misc_feature 1..20: note = CRISPR gRNA sequence
  source 1..20: mol_type = other DNA
acaacaagttcacggctgcc

SEQ ID NO: 12013 - DNA, 20 bp, synthetic construct
  misc_feature 1..20: note = CRISPR gRNA sequence
  source 1..20: mol_type = other DNA
caacaagttcacggctgccg

SEQ ID NO: 12014 - DNA, 20 bp, synthetic construct
  misc_feature 1..20: note = CRISPR gRNA sequence
  source 1..20: mol_type = other DNA
agttcacggctgccggggcc

SEQ ID NO: 12015 - DNA, 20 bp, synthetic construct
  misc_feature 1..20: note = CRISPR gRNA sequence
  source 1..20: mol_type = other DNA
tcacggctgccggggcccag

SEQ ID NO: 12016 - DNA, 20 bp, synthetic construct
  misc_feature 1..20: note = CRISPR gRNA sequence
  source 1..20: mol_type = other DNA
ggggcccagcagctcgctgc

SEQ ID NO: 12017 - DNA, 20 bp, synthetic construct
  misc_feature 1..20: note = CRISPR gRNA sequence
  source 1..20: mol_type = other DNA
agcagctcgctgccagcctt

SEQ ID NO: 12018 - DNA, 20 bp, synthetic construct
  misc_feature 1..20: note = CRISPR gRNA sequence
  source 1..20: mol_type = other DNA
cagctcgctgccagccttcg

SEQ ID NO: 12019 - DNA, 20 bp, synthetic construct
  misc_feature 1..20: note = CRISPR gRNA sequence
  source 1..20: mol_type = other DNA
agctcgctgccagccttcgg

SEQ ID NO: 12020 - DNA, 20 bp, synthetic construct
  misc_feature 1..20: note = CRISPR gRNA sequence
  source 1..20: mol_type = other DNA
ccttcggaggtgtcctcatg

SEQ ID NO: 12021 - DNA, 20 bp, synthetic construct
  misc_feature 1..20: note = CRISPR gRNA sequence
  source 1..20: mol_type = other DNA
ttcggaggtgtcctcatgtg

SEQ ID NO: 12022 - DNA, 20 bp, synthetic construct
  misc_feature 1..20: note = CRISPR gRNA sequence
  source 1..20: mol_type = other DNA
gtgtcctcatgtggagacgc

SEQ ID NO: 12023 - DNA, 20 bp, synthetic construct
  misc_feature 1..20: note = CRISPR gRNA sequence
  source 1..20: mol_type = other DNA
tcatgtggagacgctggcgt

SEQ ID NO: 12024 - DNA, 20 bp, synthetic construct
  misc_feature 1..20: note = CRISPR gRNA sequence
  source 1..20: mol_type = other DNA
tggagacgctggcgtaagtc

SEQ ID NO: 12025 - DNA, 20 bp, synthetic construct
  misc_feature 1..20: note = CRISPR gRNA sequence
  source 1..20: mol_type = other DNA
ggagacgctggcgtaagtcc

SEQ ID NO: 12026 - DNA, 20 bp, synthetic construct
  misc_feature 1..20: note = CRISPR gRNA sequence
  source 1..20: mol_type = other DNA
ggcgtaagtccaggcaaccc

SEQ ID NO: 12027 - DNA, 20 bp, synthetic construct
  misc_feature 1..20: note = CRISPR gRNA sequence
  source 1..20: mol_type = other DNA
gtaagtccaggcaaccctgg

SEQ ID NO: 12028 - DNA, 20 bp, synthetic construct
  misc_feature 1..20: note = CRISPR gRNA sequence
  source 1..20: mol_type = other DNA
taagtccaggcaaccctggt

SEQ ID NO: 12029 - DNA, 20 bp, synthetic construct
  misc_feature 1..20: note = CRISPR gRNA sequence
  source 1..20: mol_type = other DNA
gtccaggcaaccctggtggg

SEQ ID NO: 12030 - DNA, 20 bp, synthetic construct
  misc_feature 1..20: note = CRISPR gRNA sequence
  source 1..20: mol_type = other DNA
ccaggcaaccctggtgggtg

SEQ ID NO: 12031 - DNA, 20 bp, synthetic construct
  misc_feature 1..20: note = CRISPR gRNA sequence
  source 1..20: mol_type = other DNA
gtggagaacaactcactccc

SEQ ID NO: 12032 - DNA, 20 bp, synthetic construct
  misc_feature 1..20: note = CRISPR gRNA sequence
  source 1..20: mol_type = other DNA
tggagaacaactcactcccc

SEQ ID NO: 12033 - DNA, 20 bp, synthetic construct
  misc_feature 1..20: note = CRISPR gRNA sequence
  source 1..20: mol_type = other DNA
caactcactccccaggcgtg

SEQ ID NO: 12034 - DNA, 20 bp, synthetic construct
  misc_feature 1..20: note = CRISPR gRNA sequence
  source 1..20: mol_type = other DNA
cactccccaggcgtgtggcc

SEQ ID NO: 12035 - DNA, 20 bp, synthetic construct
  misc_feature 1..20: note = CRISPR gRNA sequence
  source 1..20: mol_type = other DNA
cgtgtggcccagtgtgaccc

SEQ ID NO: 12036 - DNA, 20 bp, synthetic construct
  misc_feature 1..20: note = CRISPR gRNA sequence
  source 1..20: mol_type = other DNA
tgtggcccagtgtgaccccg

SEQ ID NO: 12037 - DNA, 20 bp, synthetic construct
  misc_feature 1..20: note = CRISPR gRNA sequence
  source 1..20: mol_type = other DNA
ccttcaccaatctgcaaccc

SEQ ID NO: 12038 - DNA, 20 bp, synthetic construct
  misc_feature 1..20: note = CRISPR gRNA sequence
  source 1..20: mol_type = other DNA
cttcaccaatctgcaaccct

SEQ ID NO: 12039 - DNA, 20 bp, synthetic construct
  misc_feature 1..20: note = CRISPR gRNA sequence
  source 1..20: mol_type = other DNA
accaatctgcaaccctgggt

SEQ ID NO: 12040 - DNA, 20 bp, synthetic construct
  misc_feature 1..20: note = CRISPR gRNA sequence
  source 1..20: mol_type = other DNA
aatctgcaaccctgggtgag

SEQ ID NO: 12041 - DNA, 20 bp, synthetic construct
  misc_feature 1..20: note = CRISPR gRNA sequence
  source 1..20: mol_type = other DNA
tgagcagacacttccccctc

SEQ ID NO: 12042 - DNA, 20 bp, synthetic construct
  misc_feature 1..20: note = CRISPR gRNA sequence
  source 1..20: mol_type = other DNA
gacacttccccctctggctt

SEQ ID NO: 12043 - DNA, 20 bp, synthetic construct
  misc_feature 1..20: note = CRISPR gRNA sequence
  source 1..20: mol_type = other DNA
cttcagcttcttcatctgta

SEQ ID NO: 12044 - DNA, 20 bp, synthetic construct
  misc_feature 1..20: note = CRISPR gRNA sequence
  source 1..20: mol_type = other DNA
cagcttcttcatctgtaaag

SEQ ID NO: 12045 - DNA, 20 bp, synthetic construct
  misc_feature 1..20: note = CRISPR gRNA sequence
  source 1..20: mol_type = other DNA
agcttcttcatctgtaaagt

SEQ ID NO: 12046 - DNA, 20 bp, synthetic construct
  misc_feature 1..20: note = CRISPR gRNA sequence
  source 1..20: mol_type = other DNA
gcttcttcatctgtaaagtg

SEQ ID NO: 12047 - DNA, 20 bp, synthetic construct
  misc_feature 1..20: note = CRISPR gRNA sequence
  source 1..20: mol_type = other DNA
cttcatctgtaaagtgggga

SEQ ID NO: 12048 - DNA, 20 bp, synthetic construct
  misc_feature 1..20: note = CRISPR gRNA sequence
  source 1..20: mol_type = other DNA
gacagtaataatatccaccc

SEQ ID NO: 12049 - DNA, 20 bp, synthetic construct
  misc_feature 1..20: note = CRISPR gRNA sequence
  source 1..20: mol_type = other DNA
cagtaataatatccacccaa

SEQ ID NO: 12050 - DNA, 20 bp, synthetic construct
  misc_feature 1..20: note = CRISPR gRNA sequence
  source 1..20: mol_type = other DNA
agtaataatatccacccaag

SEQ ID NO: 12051 - DNA, 20 bp, synthetic construct
  misc_feature 1..20: note = CRISPR gRNA sequence
  source 1..20: mol_type = other DNA
atccacccaagaggttttgt

SEQ ID NO: 12052 - DNA, 20 bp, synthetic construct
  misc_feature 1..20: note = CRISPR gRNA sequence
  source 1..20: mol_type = other DNA
tccacccaagaggttttgtg

SEQ ID NO: 12053 - DNA, 20 bp, synthetic construct
  misc_feature 1..20: note = CRISPR gRNA sequence
  source 1..20: mol_type = other DNA
ttgtgaggcttaaactaatc

SEQ ID NO: 12054 - DNA, 20 bp, synthetic construct
  misc_feature 1..20: note = CRISPR gRNA sequence
  source 1..20: mol_type = other DNA
taaactaatcaagccctaca

SEQ ID NO: 12055 - DNA, 20 bp, synthetic construct
  misc_feature 1..20: note = CRISPR gRNA sequence
  source 1..20: mol_type = other DNA
ctacaaagctcttataacaa

SEQ ID NO: 12056 - DNA, 20 bp, synthetic construct
  misc_feature 1..20: note = CRISPR gRNA sequence
  source 1..20: mol_type = other DNA
caaagctcttataacaacag

SEQ ID NO: 12057 - DNA, 20 bp, synthetic construct
  misc_feature 1..20: note = CRISPR gRNA sequence
  source 1..20: mol_type = other DNA
gctcttataacaacagtagc

SEQ ID NO: 12058 - DNA, 20 bp, synthetic construct
  misc_feature 1..20: note = CRISPR gRNA sequence
  source 1..20: mol_type = other DNA
aatgccaataaatgctatat

SEQ ID NO: 12059 - DNA, 20 bp, synthetic construct
  misc_feature 1..20: note = CRISPR gRNA sequence
  source 1..20: mol_type = other DNA
atgccaataaatgctatatt

SEQ ID NO: 12060 - DNA, 20 bp, synthetic construct
  misc_feature 1..20: note = CRISPR gRNA sequence
  source 1..20: mol_type = other DNA
ccatttttgacctgtaaaat

SEQ ID NO: 12061 - DNA, 20 bp, synthetic construct
  misc_feature 1..20: note = CRISPR gRNA sequence
  source 1..20: mol_type = other DNA
gtaaaattggcaatttcata

SEQ ID NO: 12062 - DNA, 20 bp, synthetic construct
  misc_feature 1..20: note = CRISPR gRNA sequence
  source 1..20: mol_type = other DNA
attggcaatttcatatggtt

SEQ ID NO: 12063 - DNA, 20 bp, synthetic construct
  misc_feature 1..20: note = CRISPR gRNA sequence
  source 1..20: mol_type = other DNA
ttggcaatttcatatggttc

SEQ ID NO: 12064 - DNA, 20 bp, synthetic construct
  misc_feature 1..20: note = CRISPR gRNA sequence
  source 1..20: mol_type = other DNA
gttcaggtttatcttttatt

SEQ ID NO: 12065 - DNA, 20 bp, synthetic construct
  misc_feature 1..20: note = CRISPR gRNA sequence
  source 1..20: mol_type = other DNA
gtcaccatgatgtccaatac

SEQ ID NO: 12066 - DNA, 20 bp, synthetic construct
  misc_feature 1..20: note = CRISPR gRNA sequence
  source 1..20: mol_type = other DNA
ggttactttatattctttca

SEQ ID NO: 12067 - DNA, 20 bp, synthetic construct
  misc_feature 1..20: note = CRISPR gRNA sequence
  source 1..20: mol_type = other DNA
cacaatcactcacctcttct

SEQ ID NO: 12068 - DNA, 20 bp, synthetic construct
  misc_feature 1..20: note = CRISPR gRNA sequence
  source 1..20: mol_type = other DNA
ctcacctcttctaagacgca

SEQ ID NO: 12069 - DNA, 20 bp, synthetic construct
  misc_feature 1..20: note = CRISPR gRNA sequence
  source 1..20: mol_type = other DNA
tcacctcttctaagacgcac

SEQ ID NO: 12070 - DNA, 20 bp, synthetic construct
  misc_feature 1..20: note = CRISPR gRNA sequence
  source 1..20: mol_type = other DNA
cacctcttctaagacgcaca

SEQ ID NO: 12071 - DNA, 20 bp, synthetic construct
  misc_feature 1..20: note = CRISPR gRNA sequence
  source 1..20: mol_type = other DNA
ctcttctaagacgcacaggg

SEQ ID NO: 12072 - DNA, 20 bp, synthetic construct
  misc_feature 1..20: note = CRISPR gRNA sequence
  source 1..20: mol_type = other DNA
tcttctaagacgcacagggt

SEQ ID NO: 12073 - DNA, 20 bp, synthetic construct
  misc_feature 1..20: note = CRISPR gRNA sequence
  source 1..20: mol_type = other DNA
acgcacagggtgggtcttac

SEQ ID NO: 12074 - DNA, 20 bp, synthetic construct
  misc_feature 1..20: note = CRISPR gRNA sequence
  source 1..20: mol_type = other DNA
gtcttacaagacccatttta

SEQ ID NO: 12075 - DNA, 20 bp, synthetic construct
  misc_feature 1..20: note = CRISPR gRNA sequence
  source 1..20: mol_type = other DNA
acaagacccattttacagat

SEQ ID NO: 12076 - DNA, 20 bp, synthetic construct
  misc_feature 1..20: note = CRISPR gRNA sequence
  source 1..20: mol_type = other DNA
caagacccattttacagatg

SEQ ID NO: 12077 - DNA, 20 bp, synthetic construct
  misc_feature 1..20: note = CRISPR gRNA sequence
  source 1..20: mol_type = other DNA
ttttacagatgaggaaaata

SEQ ID NO: 12078 - DNA, 20 bp, synthetic construct
  misc_feature 1..20: note = CRISPR gRNA sequence
  source 1..20: mol_type = other DNA
cagatgaggaaaataaagca

SEQ ID NO: 12079 - DNA, 20 bp, synthetic construct
  misc_feature 1..20: note = CRISPR gRNA sequence
  source 1..20: mol_type = other DNA
gatgaggaaaataaagcaca

SEQ ID NO: 12080 - DNA, 20 bp, synthetic construct
  misc_feature 1..20: note = CRISPR gRNA sequence
  source 1..20: mol_type = other DNA
gaggaaaataaagcacagag

SEQ ID NO: 12081 - DNA, 20 bp, synthetic construct
  misc_feature 1..20: note = CRISPR gRNA sequence
  source 1..20: mol_type = other DNA
gagcagttaactaacctttc

SEQ ID NO: 12082 - DNA, 20 bp, synthetic construct
  misc_feature 1..20: note = CRISPR gRNA sequence
  source 1..20: mol_type = other DNA
agcagttaactaacctttct

SEQ ID NO: 12083 - DNA, 20 bp, synthetic construct
  misc_feature 1..20: note = CRISPR gRNA sequence
  source 1..20: mol_type = other DNA
gcagttaactaacctttctg

SEQ ID NO: 12084 - DNA, 20 bp, synthetic construct
  misc_feature 1..20: note = CRISPR gRNA sequence
  source 1..20: mol_type = other DNA
ctaacctttctggggtcaca

SEQ ID NO: 12085 - DNA, 20 bp, synthetic construct
  misc_feature 1..20: note = CRISPR gRNA sequence
  source 1..20: mol_type = other DNA
cctttctggggtcacacagc

SEQ ID NO: 12086 - DNA, 20 bp, synthetic construct
  misc_feature 1..20: note = CRISPR gRNA sequence
  source 1..20: mol_type = other DNA
tctggggtcacacagcaagt

SEQ ID NO: 12087 - DNA, 20 bp, synthetic construct
  misc_feature 1..20: note = CRISPR gRNA sequence
  source 1..20: mol_type = other DNA
gtcacacagcaagtcagctg

SEQ ID NO: 12088 - DNA, 20 bp, synthetic construct
  misc_feature 1..20: note = CRISPR gRNA sequence
  source 1..20: mol_type = other DNA
aagtcagctgcagaaccata

SEQ ID NO: 12089 - DNA, 20 bp, synthetic construct
  misc_feature 1..20: note = CRISPR gRNA sequence
  source 1..20: mol_type = other DNA
agtcagctgcagaaccataa

SEQ ID NO: 12090 - DNA, 20 bp, synthetic construct
  misc_feature 1..20: note = CRISPR gRNA sequence
  source 1..20: mol_type = other DNA
gcagaaccataaaggaatct

SEQ ID NO: 12091 - DNA, 20 bp, synthetic construct
  misc_feature 1..20: note = CRISPR gRNA sequence
  source 1..20: mol_type = other DNA
cagaaccataaaggaatctc

SEQ ID NO: 12092 - DNA, 20 bp, synthetic construct
  misc_feature 1..20: note = CRISPR gRNA sequence
  source 1..20: mol_type = other DNA
taaaggaatctcgggcctcc

SEQ ID NO: 12093 - DNA, 20 bp, synthetic construct
  misc_feature 1..20: note = CRISPR gRNA sequence
  source 1..20: mol_type = other DNA
aaaggaatctcgggcctcct

SEQ ID NO: 12094 - DNA, 20 bp, synthetic construct
  misc_feature 1..20: note = CRISPR gRNA sequence
  source 1..20: mol_type = other DNA
cttttccccatgacccacac

SEQ ID NO: 12095 - DNA, 20 bp, synthetic construct
  misc_feature 1..20: note = CRISPR gRNA sequence
  source 1..20: mol_type = other DNA
tccccatgacccacaccggt

SEQ ID NO: 12096 - DNA, 20 bp, synthetic construct
  misc_feature 1..20: note = CRISPR gRNA sequence
  source 1..20: mol_type = other DNA
cacaccggtcggtatcttgc

SEQ ID NO: 12097 - DNA, 20 bp, synthetic construct
  misc_feature 1..20: note = CRISPR gRNA sequence
  source 1..20: mol_type = other DNA
acaccggtcggtatcttgcc

SEQ ID NO: 12098 - DNA, 20 bp, synthetic construct
  misc_feature 1..20: note = CRISPR gRNA sequence
  source 1..20: mol_type = other DNA
caccggtcggtatcttgcca

SEQ ID NO: 12099 - DNA, 20 bp, synthetic construct
  misc_feature 1..20: note = CRISPR gRNA sequence
  source 1..20: mol_type = other DNA
accggtcggtatcttgccag

SEQ ID NO: 12100 - DNA, 20 bp, synthetic construct
  misc_feature 1..20: note = CRISPR gRNA sequence
  source 1..20: mol_type = other DNA
tcggtatcttgccaggggaa

SEQ ID NO: 12101 - DNA, 20 bp, synthetic construct
  misc_feature 1..20: note = CRISPR gRNA sequence
  source 1..20: mol_type = other DNA
gggaaaagtccccaacgttc

SEQ ID NO: 12102 - DNA, 20 bp, synthetic construct
  misc_feature 1..20: note = CRISPR gRNA sequence
  source 1..20: mol_type = other DNA
ggaaaagtccccaacgttct

SEQ ID NO: 12103 - DNA, 20 bp, synthetic construct
  misc_feature 1..20: note = CRISPR gRNA sequence
  source 1..20: mol_type = other DNA
aagtccccaacgttctaggc

SEQ ID NO: 12104 - DNA, 20 bp, synthetic construct
  misc_feature 1..20: note = CRISPR gRNA sequence
  source 1..20: mol_type = other DNA
agtccccaacgttctaggct

SEQ ID NO: 12105 - DNA, 20 bp, synthetic construct
  misc_feature 1..20: note = CRISPR gRNA sequence
  source 1..20: mol_type = other DNA
ccccaacgttctaggctggg

SEQ ID NO: 12106 - DNA, 20 bp, synthetic construct
  misc_feature 1..20: note = CRISPR gRNA sequence
  source 1..20: mol_type = other DNA
caacgttctaggctgggtgg

SEQ ID NO: 12107 - DNA, 20 bp, synthetic construct
  misc_feature 1..20: note = CRISPR gRNA sequence
  source 1..20: mol_type = other DNA
aacgttctaggctgggtgga

SEQ ID NO: 12108 - DNA, 20 bp, synthetic construct
  misc_feature 1..20: note = CRISPR gRNA sequence
  source 1..20: mol_type = other DNA
cgttctaggctgggtggaag

SEQ ID NO: 12109 - DNA, 20 bp, synthetic construct
  misc_feature 1..20: note = CRISPR gRNA sequence
  source 1..20: mol_type = other DNA
gttctaggctgggtggaagg

SEQ ID NO: 12110 - DNA, 20 bp, synthetic construct
  misc_feature 1..20: note = CRISPR gRNA sequence
  source 1..20: mol_type = other DNA
ttctaggctgggtggaagga

SEQ ID NO: 12111 - DNA, 20 bp, synthetic construct
  misc_feature 1..20: note = CRISPR gRNA sequence
  source 1..20: mol_type = other DNA
gctgggtggaaggagggatt

SEQ ID NO: 12112 - DNA, 20 bp, synthetic construct
  misc_feature 1..20: note = CRISPR gRNA sequence
  source 1..20: mol_type = other DNA
ctgggtggaaggagggattt

SEQ ID NO: 12113 - DNA, 20 bp, synthetic construct
  misc_feature 1..20: note = CRISPR gRNA sequence
  source 1..20: mol_type = other DNA
tgggtggaaggagggatttg

SEQ ID NO: 12114 - DNA, 20 bp, synthetic construct
  misc_feature 1..20: note = CRISPR gRNA sequence
  source 1..20: mol_type = other DNA
gggtggaaggagggatttgg

SEQ ID NO: 12115 - DNA, 20 bp, synthetic construct
  misc_feature 1..20: note = CRISPR gRNA sequence
  source 1..20: mol_type = other DNA
tggaaggagggatttggggg

SEQ ID NO: 12116 - DNA, 20 bp, synthetic construct
  misc_feature 1..20: note = CRISPR gRNA sequence
  source 1..20: mol_type = other DNA
gatttgggggcagctgtcac

SEQ ID NO: 12117 - DNA, 20 bp, synthetic construct
  misc_feature 1..20: note = CRISPR gRNA sequence
  source 1..20: mol_type = other DNA
atttgggggcagctgtcact

SEQ ID NO: 12118 - DNA, 20 bp, synthetic construct
  misc_feature 1..20: note = CRISPR gRNA sequence
  source 1..20: mol_type = other DNA
tttgggggcagctgtcactg

SEQ ID NO: 12119 - DNA, 20 bp, synthetic construct
  misc_feature 1..20: note = CRISPR gRNA sequence
  source 1..20: mol_type = other DNA
ggcagctgtcactggggccc

SEQ ID NO: 12120 - DNA, 20 bp, synthetic construct
  misc_feature 1..20: note = CRISPR gRNA sequence
  source 1..20: mol_type = other DNA
gcagctgtcactggggcccc

SEQ ID NO: 12121 - DNA, 20 bp, synthetic construct
  misc_feature 1..20: note = CRISPR gRNA sequence
  source 1..20: mol_type = other DNA
ccgccctctctcctctaacc

SEQ ID NO: 12122 - DNA, 20 bp, synthetic construct
  misc_feature 1..20: note = CRISPR gRNA sequence
  source 1..20: mol_type = other DNA
ctctcctctaacctggctct

SEQ ID NO: 12123 - DNA, 20 bp, synthetic construct
  misc_feature 1..20: note = CRISPR gRNA sequence
  source 1..20: mol_type = other DNA
ctgagtcccatccccccttg

SEQ ID NO: 12124 - DNA, 20 bp, synthetic construct
  misc_feature 1..20: note = CRISPR gRNA sequence
  source 1..20: mol_type = other DNA
tgagtcccatccccccttgc

SEQ ID NO: 12125 - DNA, 20 bp, synthetic construct
  misc_feature 1..20: note = CRISPR gRNA sequence
  source 1..20: mol_type = other DNA
ccatccccccttgcaggatg

SEQ ID NO: 12126 - DNA, 20 bp, synthetic construct
  misc_feature 1..20: note = CRISPR gRNA sequence
  source 1..20: mol_type = other DNA
tggacgcccaccatcccatt

SEQ ID NO: 12127 - DNA, 20 bp, synthetic construct
  misc_feature 1..20: note = CRISPR gRNA sequence
  source 1..20: mol_type = other DNA
ccaccatcccattcagtgtc

SEQ ID NO: 12128 - DNA, 20 bp, synthetic construct
  misc_feature 1..20: note = CRISPR gRNA sequence
  source 1..20: mol_type = other DNA
caccatcccattcagtgtcc

SEQ ID NO: 12129 - DNA, 20 bp, synthetic construct
  misc_feature 1..20: note = CRISPR gRNA sequence
  source 1..20: mol_type = other DNA
tccaggaacacctgcaacaa

SEQ ID NO: 12130 - DNA, 20 bp, synthetic construct
  misc_feature 1..20: note = CRISPR gRNA sequence
  source 1..20: mol_type = other DNA
ccaggaacacctgcaacaac

SEQ ID NO: 12131 - DNA, 20 bp, synthetic construct
  misc_feature 1..20: note = CRISPR gRNA sequence
  source 1..20: mol_type = other DNA
acctgcaacaacaggattca

SEQ ID NO: 12132 - DNA, 20 bp, synthetic construct
  misc_feature 1..20: note = CRISPR gRNA sequence
  source 1..20: mol_type = other DNA
caacaacaggattcacggat

SEQ ID NO: 12133 - DNA, 20 bp, synthetic construct
  misc_feature 1..20: note = CRISPR gRNA sequence
  source 1..20: mol_type = other DNA
caggattcacggatcagcct

SEQ ID NO: 12134 - DNA, 20 bp, synthetic construct
  misc_feature 1..20: note = CRISPR gRNA sequence
  source 1..20: mol_type = other DNA
ggatcagcctgagatgatcc

SEQ ID NO: 12135 - DNA, 20 bp, synthetic construct
  misc_feature 1..20: note = CRISPR gRNA sequence
  source 1..20: mol_type = other DNA
agatgatcccagctgtgctc

SEQ ID NO: 12136 - DNA, 20 bp, synthetic construct
  misc_feature 1..20: note = CRISPR gRNA sequence
  source 1..20: mol_type = other DNA
gatcccagctgtgctctgga

SEQ ID NO: 12137 - DNA, 20 bp, synthetic construct
  misc_feature 1..20: note = CRISPR gRNA sequence
  source 1..20: mol_type = other DNA
atcccagctgtgctctggac

SEQ ID NO: 12138 - DNA, 20 bp, synthetic construct
  misc_feature 1..20: note = CRISPR gRNA sequence
  source 1..20: mol_type = other DNA
tcccagctgtgctctggaca

SEQ ID NO: 12139 - DNA, 20 bp, synthetic construct
  misc_feature 1..20: note = CRISPR gRNA sequence
  source 1..20: mol_type = other DNA
tgtgctctggacagggtaac

SEQ ID NO: 12140 - DNA, 20 bp, synthetic construct
  misc_feature 1..20: note = CRISPR gRNA sequence
  source 1..20: mol_type = other DNA
gtgctctggacagggtaacc

SEQ ID NO: 12141 - DNA, 20 bp, synthetic construct
  misc_feature 1..20: note = CRISPR gRNA sequence
  source 1..20: mol_type = other DNA
tgctctggacagggtaacca

SEQ ID NO: 12142 - DNA, 20 bp, synthetic construct
  misc_feature 1..20: note = CRISPR gRNA sequence
  source 1..20: mol_type = other DNA
tctggacagggtaaccaggg

SEQ ID NO: 12143 - DNA, 20 bp, synthetic construct
  misc_feature 1..20: note = CRISPR gRNA sequence
  source 1..20: mol_type = other DNA
ctggacagggtaaccagggt

SEQ ID NO: 12144 - DNA, 20 bp, synthetic construct
  misc_feature 1..20: note = CRISPR gRNA sequence
  source 1..20: mol_type = other DNA
cagggtaaccagggtgggct

SEQ ID NO: 12145 - DNA, 20 bp, synthetic construct
  misc_feature 1..20: note = CRISPR gRNA sequence
  source 1..20: mol_type = other DNA
agggtaaccagggtgggctt

SEQ ID NO: 12146 - DNA, 20 bp, synthetic construct
  misc_feature 1..20: note = CRISPR gRNA sequence
  source 1..20: mol_type = other DNA
ggtaaccagggtgggcttgg

SEQ ID NO: 12147 - DNA, 20 bp, synthetic construct
  misc_feature 1..20: note = CRISPR gRNA sequence
  source 1..20: mol_type = other DNA
gtaaccagggtgggcttggg

SEQ ID NO: 12148 - DNA, 20 bp, synthetic construct
  misc_feature 1..20: note = CRISPR gRNA sequence
  source 1..20: mol_type = other DNA
taaccagggtgggcttggga

SEQ ID NO: 12149 - DNA, 20 bp, synthetic construct
  misc_feature 1..20: note = CRISPR gRNA sequence
  source 1..20: mol_type = other DNA
aaccagggtgggcttgggag

SEQ ID NO: 12150 - DNA, 20 bp, synthetic construct
  misc_feature 1..20: note = CRISPR gRNA sequence
  source 1..20: mol_type = other DNA
ccagggtgggcttgggaggg

SEQ ID NO: 12151 - DNA, 20 bp, synthetic construct
  misc_feature 1..20: note = CRISPR gRNA sequence
  source 1..20: mol_type = other DNA
agggtgggcttgggagggga

SEQ ID NO: 12152 - DNA, 20 bp, synthetic construct
  misc_feature 1..20: note = CRISPR gRNA sequence
  source 1..20: mol_type = other DNA
ggcttgggaggggagagccg

SEQ ID NO: 12153 - DNA, 20 bp, synthetic construct
  misc_feature 1..20: note = CRISPR gRNA sequence
  source 1..20: mol_type = other DNA
ttgggaggggagagccgcag

SEQ ID NO: 12154 - DNA, 20 bp, synthetic construct
  misc_feature 1..20: note = CRISPR gRNA sequence
  source 1..20: mol_type = other DNA
tgggaggggagagccgcagt

SEQ ID NO: 12155 - DNA, 20 bp, synthetic construct
  misc_feature 1..20: note = CRISPR gRNA sequence
  source 1..20: mol_type = other DNA
aggggagagccgcagtgggt

SEQ ID NO: 12156 - DNA, 20 bp, synthetic construct
  misc_feature 1..20: note = CRISPR gRNA sequence
  source 1..20: mol_type = other DNA
ggggagagccgcagtgggtt

SEQ ID NO: 12157 - DNA, 20 bp, synthetic construct
  misc_feature 1..20: note = CRISPR gRNA sequence
  source 1..20: mol_type = other DNA
gggagagccgcagtgggttg

SEQ ID NO: 12158 - DNA, 20 bp, synthetic construct
  misc_feature 1..20: note = CRISPR gRNA sequence
  source 1..20: mol_type = other DNA
ggagagccgcagtgggttgg

SEQ ID NO: 12159 - DNA, 20 bp, synthetic construct
  misc_feature 1..20: note = CRISPR gRNA sequence
  source 1..20: mol_type = other DNA
gagccgcagtgggttggggg

SEQ ID NO: 12160 - DNA, 20 bp, synthetic construct
  misc_feature 1..20: note = CRISPR gRNA sequence
  source 1..20: mol_type = other DNA
ttgggggcagtgtccttgtg

SEQ ID NO: 12161 - DNA, 20 bp, synthetic construct
  misc_feature 1..20: note = CRISPR gRNA sequence
  source 1..20: mol_type = other DNA
tgggggcagtgtccttgtga

SEQ ID NO: 12162 - DNA, 20 bp, synthetic construct
  misc_feature 1..20: note = CRISPR gRNA sequence
  source 1..20: mol_type = other DNA
gggcagtgtccttgtgaagg

SEQ ID NO: 12163 - DNA, 20 bp, synthetic construct
  misc_feature 1..20: note = CRISPR gRNA sequence
  source 1..20: mol_type = other DNA
tttttgaatgccaccttcac

SEQ ID NO: 12164 - DNA, 20 bp, synthetic construct
  misc_feature 1..20: note = CRISPR gRNA sequence
  source 1..20: mol_type = other DNA
ttttgaatgccaccttcaca

SEQ ID NO: 12165 - DNA, 20 bp, synthetic construct
  misc_feature 1..20: note = CRISPR gRNA sequence
  source 1..20: mol_type = other DNA
acactgcccccaacccactg

SEQ ID NO: 12166 - DNA, 20 bp, synthetic construct
  misc_feature 1..20: note = CRISPR gRNA sequence
  source 1..20: mol_type = other DNA
cactgcggctctcccctccc

SEQ ID NO: 12167 - DNA, 20 bp, synthetic construct
  misc_feature 1..20: note = CRISPR gRNA sequence
  source 1..20: mol_type = other DNA
ctcccctcccaagcccaccc

SEQ ID NO: 12168 - DNA, 20 bp, synthetic construct
  misc_feature 1..20: note = CRISPR gRNA sequence
  source 1..20: mol_type = other DNA
cccaccctggttaccctgtc

SEQ ID NO: 12169 - DNA, 20 bp, synthetic construct
  misc_feature 1..20: note = CRISPR gRNA sequence
  source 1..20: mol_type = other DNA
caccctggttaccctgtcca

SEQ ID NO: 12170 - DNA, 20 bp, synthetic construct
  misc_feature 1..20: note = CRISPR gRNA sequence
  source 1..20: mol_type = other DNA
tggttaccctgtccagagca

SEQ ID NO: 12171 - DNA, 20 bp, synthetic construct
  misc_feature 1..20: note = CRISPR gRNA sequence
  source 1..20: mol_type = other DNA
taccctgtccagagcacagc

SEQ ID NO: 12172 - DNA, 20 bp, synthetic construct
  misc_feature 1..20: note = CRISPR gRNA sequence
  source 1..20: mol_type = other DNA
accctgtccagagcacagct

SEQ ID NO: 12173 - DNA, 20 bp, synthetic construct
  misc_feature 1..20: note = CRISPR gRNA sequence
  source 1..20: mol_type = other DNA
gagcacagctgggatcatct

SEQ ID NO: 12174 - DNA, 20 bp, synthetic construct
  misc_feature 1..20: note = CRISPR gRNA sequence
  source 1..20: mol_type = other DNA
agcacagctgggatcatctc

SEQ ID NO: 12175 - DNA, 20 bp, synthetic construct
  misc_feature 1..20: note = CRISPR gRNA sequence
  source 1..20: mol_type = other DNA
atccgtgaatcctgttgttg

SEQ ID NO: 12176 - DNA, 20 bp, synthetic construct
  misc_feature 1..20: note = CRISPR gRNA sequence
  source 1..20: mol_type = other DNA
tccgtgaatcctgttgttgc

SEQ ID NO: 12177 - DNA, 20 bp, synthetic construct
  misc_feature 1..20: note = CRISPR gRNA sequence
  source 1..20: mol_type = other DNA
cctgttgttgcaggtgttcc

SEQ ID NO: 12178 - DNA, 20 bp, synthetic construct
  misc_feature 1..20: note = CRISPR gRNA sequence
  source 1..20: mol_type = other DNA
aggtgttcctggacactgaa

SEQ ID NO: 12179 - DNA, 20 bp, synthetic construct
  misc_feature 1..20: note = CRISPR gRNA sequence
  source 1..20: mol_type = other DNA
ggtgttcctggacactgaat

SEQ ID NO: 12180 - DNA, 20 bp, synthetic construct
  misc_feature 1..20: note = CRISPR gRNA sequence
  source 1..20: mol_type = other DNA
ttcctggacactgaatggga

SEQ ID NO: 12181 - DNA, 20 bp, synthetic construct
  misc_feature 1..20: note = CRISPR gRNA sequence
  source 1..20: mol_type = other DNA
ctggacactgaatgggatgg

SEQ ID NO: 12182 - DNA, 20 bp, synthetic construct
  misc_feature 1..20: note = CRISPR gRNA sequence
  source 1..20: mol_type = other DNA
tggacactgaatgggatggt

SEQ ID NO: 12183 - DNA, 20 bp, synthetic construct
  misc_feature 1..20: note = CRISPR gRNA sequence
  source 1..20: mol_type = other DNA
ggtgggcgtccacatcctgc

SEQ ID NO: 12184 - DNA, 20 bp, synthetic construct
  misc_feature 1..20: note = CRISPR gRNA sequence
  source 1..20: mol_type = other DNA
gtgggcgtccacatcctgca

SEQ ID NO: 12185 - DNA, 20 bp, synthetic construct
  misc_feature 1..20: note = CRISPR gRNA sequence
  source 1..20: mol_type = other DNA
tgggcgtccacatcctgcaa

SEQ ID NO: 12186 - DNA, 20 bp, synthetic construct
  misc_feature 1..20: note = CRISPR gRNA sequence
  source 1..20: mol_type = other DNA
gggcgtccacatcctgcaag

SEQ ID NO: 12187 - DNA, 20 bp, synthetic construct
  misc_feature 1..20: note = CRISPR gRNA sequence
  source 1..20: mol_type = other DNA
ggcgtccacatcctgcaagg

SEQ ID NO: 12188 - DNA, 20 bp, synthetic construct
  misc_feature 1..20: note = CRISPR gRNA sequence
  source 1..20: mol_type = other DNA
gcgtccacatcctgcaaggg

SEQ ID NO: 12189 - DNA, 20 bp, synthetic construct
  misc_feature 1..20: note = CRISPR gRNA sequence
  source 1..20: mol_type = other DNA
ccacatcctgcaagggggga

SEQ ID NO: 12190 - DNA, 20 bp, synthetic construct
  misc_feature 1..20: note = CRISPR gRNA sequence
  source 1..20: mol_type = other DNA
cacatcctgcaaggggggat

SEQ ID NO: 12191 - DNA, 20 bp, synthetic construct
  misc_feature 1..20: note = CRISPR gRNA sequence
  source 1..20: mol_type = other DNA
ctgcaaggggggatgggact

SEQ ID NO: 12192 - DNA, 20 bp, synthetic construct
  misc_feature 1..20: note = CRISPR gRNA sequence
  source 1..20: mol_type = other DNA
gcaaggggggatgggactca

SEQ ID NO: 12193 - DNA, 20 bp, synthetic construct
  misc_feature 1..20: note = CRISPR gRNA sequence
  source 1..20: mol_type = other DNA
ggggggatgggactcagagc

SEQ ID NO: 12194 - DNA, 20 bp, synthetic construct
  misc_feature 1..20: note = CRISPR gRNA sequence
  source 1..20: mol_type = other DNA
gggggatgggactcagagcc

SEQ ID NO: 12195 - DNA, 20 bp, synthetic construct
  misc_feature 1..20: note = CRISPR gRNA sequence
  source 1..20: mol_type = other DNA
gatgggactcagagccaggt

SEQ ID NO: 12196 - DNA, 20 bp, synthetic construct
  misc_feature 1..20: note = CRISPR gRNA sequence
  source 1..20: mol_type = other DNA
tgggactcagagccaggtta

SEQ ID NO: 12197 - DNA, 20 bp, synthetic construct
  misc_feature 1..20: note = CRISPR gRNA sequence
  source 1..20: mol_type = other DNA
gggactcagagccaggttag

SEQ ID NO: 12198 - DNA, 20 bp, synthetic construct
  misc_feature 1..20: note = CRISPR gRNA sequence
  source 1..20: mol_type = other DNA
gactcagagccaggttagag

SEQ ID NO: 12199 - DNA, 20 bp, synthetic construct
  misc_feature 1..20: note = CRISPR gRNA sequence
  source 1..20: mol_type = other DNA
ctcagagccaggttagagga

SEQ ID NO: 12200 - DNA, 20 bp, synthetic construct
  misc_feature 1..20: note = CRISPR gRNA sequence
  source 1..20: mol_type = other DNA
cagagccaggttagaggaga

SEQ ID NO: 12201 - DNA, 20 bp, synthetic construct
  misc_feature 1..20: note = CRISPR gRNA sequence
  source 1..20: mol_type = other DNA
agagccaggttagaggagag

SEQ ID NO: 12202 - DNA, 20 bp, synthetic construct
  misc_feature 1..20: note = CRISPR gRNA sequence
  source 1..20: mol_type = other DNA
gagccaggttagaggagaga

SEQ ID NO: 12203 - DNA, 20 bp, synthetic construct
  misc_feature 1..20: note = CRISPR gRNA sequence
  source 1..20: mol_type = other DNA
ccaggttagaggagagaggg

SEQ ID NO: 12204 - DNA, 20 bp, synthetic construct
  misc_feature 1..20: note = CRISPR gRNA sequence
  source 1..20: mol_type = other DNA
ttagaggagagagggcggcc

SEQ ID NO: 12205 - DNA, 20 bp, synthetic construct
  misc_feature 1..20: note = CRISPR gRNA sequence
  source 1..20: mol_type = other DNA
tagaggagagagggcggcct

SEQ ID NO: 12206 - DNA, 20 bp, synthetic construct
  misc_feature 1..20: note = CRISPR gRNA sequence
  source 1..20: mol_type = other DNA
agaggagagagggcggcctg

SEQ ID NO: 12207 - DNA, 20 bp, synthetic construct
  misc_feature 1..20: note = CRISPR gRNA sequence
  source 1..20: mol_type = other DNA
gagagggcggcctggggccc

SEQ ID NO: 12208 - DNA, 20 bp, synthetic construct
  misc_feature 1..20: note = CRISPR gRNA sequence
  source 1..20: mol_type = other DNA
gcggcctggggccccagtga

SEQ ID NO: 12209 - DNA, 20 bp, synthetic construct
  misc_feature 1..20: note = CRISPR gRNA sequence
  source 1..20: mol_type = other DNA
cccaaatccctccttccacc

SEQ ID NO: 12210 - DNA, 20 bp, synthetic construct
  misc_feature 1..20: note = CRISPR gRNA sequence
  source 1..20: mol_type = other DNA
atccctccttccacccagcc

SEQ ID NO: 12211 - DNA, 20 bp, synthetic construct
  misc_feature 1..20: note = CRISPR gRNA sequence
  source 1..20: mol_type = other DNA
ttccacccagcctagaacgt

SEQ ID NO: 12212 - DNA, 20 bp, synthetic construct
  misc_feature 1..20: note = CRISPR gRNA sequence
  source 1..20: mol_type = other DNA
tccacccagcctagaacgtt

SEQ ID NO: 12213 - DNA, 20 bp, synthetic construct
  misc_feature 1..20: note = CRISPR gRNA sequence
  source 1..20: mol_type = other DNA
ccacccagcctagaacgttg

SEQ ID NO: 12214 - DNA, 20 bp, synthetic construct
  misc_feature 1..20: note = CRISPR gRNA sequence
  source 1..20: mol_type = other DNA
aacgttggggacttttcccc

SEQ ID NO: 12215 - DNA, 20 bp, synthetic construct
  misc_feature 1..20: note = CRISPR gRNA sequence
  source 1..20: mol_type = other DNA
ttggggacttttcccctggc

SEQ ID NO: 12216 - DNA, 20 bp, synthetic construct
  misc_feature 1..20: note = CRISPR gRNA sequence
  source 1..20: mol_type = other DNA
tcccctggcaagataccgac

SEQ ID NO: 12217 - DNA, 20 bp, synthetic construct
  misc_feature 1..20: note = CRISPR gRNA sequence
  source 1..20: mol_type = other DNA
tggcaagataccgaccggtg

SEQ ID NO: 12218 - DNA, 20 bp, synthetic construct
  misc_feature 1..20: note = CRISPR gRNA sequence
  source 1..20: mol_type = other DNA
ggcaagataccgaccggtgt

SEQ ID NO: 12219 - DNA, 20 bp, synthetic construct
  misc_feature 1..20: note = CRISPR gRNA sequence
  source 1..20: mol_type = other DNA
ataccgaccggtgtgggtca

SEQ ID NO: 12220 - DNA, 20 bp, synthetic construct
  misc_feature 1..20: note = CRISPR gRNA sequence
  source 1..20: mol_type = other DNA
taccgaccggtgtgggtcat

SEQ ID NO: 12221 - DNA, 20 bp, synthetic construct
  misc_feature 1..20: note = CRISPR gRNA sequence
  source 1..20: mol_type = other DNA
accgaccggtgtgggtcatg

SEQ ID NO: 12222 - DNA, 20 bp, synthetic construct
  misc_feature 1..20: note = CRISPR gRNA sequence
  source 1..20: mol_type = other DNA
ccggtgtgggtcatggggaa

SEQ ID NO: 12223 - DNA, 20 bp, synthetic construct
  misc_feature 1..20: note = CRISPR gRNA sequence
  source 1..20: mol_type = other DNA
cggtgtgggtcatggggaaa

SEQ ID NO: 12224 - DNA, 20 bp, synthetic construct
  misc_feature 1..20: note = CRISPR gRNA sequence
  source 1..20: mol_type = other DNA
gtgtgggtcatggggaaaag

SEQ ID NO: 12225 - DNA, 20 bp, synthetic construct
  misc_feature 1..20: note = CRISPR gRNA sequence
  source 1..20: mol_type = other DNA
tgggtcatggggaaaaggag

SEQ ID NO: 12226 - DNA, 20 bp, synthetic construct
  misc_feature 1..20: note = CRISPR gRNA sequence
  source 1..20: mol_type = other DNA
catggggaaaaggagaagcc

SEQ ID NO: 12227 - DNA, 20 bp, synthetic construct
  misc_feature 1..20: note = CRISPR gRNA sequence
  source 1..20: mol_type = other DNA
atggggaaaaggagaagcct

SEQ ID NO: 12228 - DNA, 20 bp, synthetic construct
  misc_feature 1..20: note = CRISPR gRNA sequence
  source 1..20: mol_type = other DNA
ggggaaaaggagaagcctag

SEQ ID NO: 12229 - DNA, 20 bp, synthetic construct
  misc_feature 1..20: note = CRISPR gRNA sequence
  source 1..20: mol_type = other DNA
gggaaaaggagaagcctagg

SEQ ID NO: 12230 - DNA, 20 bp, synthetic construct
  misc_feature 1..20: note = CRISPR gRNA sequence
  source 1..20: mol_type = other DNA
aggagaagcctaggaggccc

SEQ ID NO: 12231 - DNA, 20 bp, synthetic construct
  misc_feature 1..20: note = CRISPR gRNA sequence
  source 1..20: mol_type = other DNA
ggaggcccgagattccttta

SEQ ID NO: 12232 - DNA, 20 bp, synthetic construct
  misc_feature 1..20: note = CRISPR gRNA sequence
  source 1..20: mol_type = other DNA
gagattcctttatggttctg

SEQ ID NO: 12233 - DNA, 20 bp, synthetic construct
  misc_feature 1..20: note = CRISPR gRNA sequence
  source 1..20: mol_type = other DNA
gctgacttgctgtgtgaccc

SEQ ID NO: 12234 - DNA, 20 bp, synthetic construct
  misc_feature 1..20: note = CRISPR gRNA sequence
  source 1..20: mol_type = other DNA
acttgctgtgtgaccccaga

SEQ ID NO: 12235 - DNA, 20 bp, synthetic construct
  misc_feature 1..20: note = CRISPR gRNA sequence
  source 1..20: mol_type = other DNA
cttgctgtgtgaccccagaa

SEQ ID NO: 12236 - DNA, 20 bp, synthetic construct
  misc_feature 1..20: note = CRISPR gRNA sequence
  source 1..20: mol_type = other DNA
ctgtgtgaccccagaaaggt

SEQ ID NO: 12237 - DNA, 20 bp, synthetic construct
  misc_feature 1..20: note = CRISPR gRNA sequence
  source 1..20: mol_type = other DNA
tattttcctcatctgtaaaa

SEQ ID NO: 12238 - DNA, 20 bp, synthetic construct
  misc_feature 1..20: note = CRISPR gRNA sequence
  source 1..20: mol_type = other DNA
attttcctcatctgtaaaat

SEQ ID NO: 12239 - DNA, 20 bp, synthetic construct
  misc_feature 1..20: note = CRISPR gRNA sequence
  source 1..20: mol_type = other DNA
atctgtaaaatgggtcttgt

SEQ ID NO: 12240 - DNA, 20 bp, synthetic construct
  misc_feature 1..20: note = CRISPR gRNA sequence
  source 1..20: mol_type = other DNA
aagacccaccctgtgcgtct

SEQ ID NO: 12241 - DNA, 20 bp, synthetic construct
  misc_feature 1..20: note = CRISPR gRNA sequence
  source 1..20: mol_type = other DNA
acccaccctgtgcgtcttag

SEQ ID NO: 12242 - DNA, 20 bp, synthetic construct
  misc_feature 1..20: note = CRISPR gRNA sequence
  source 1..20: mol_type = other DNA
ccaccctgtgcgtcttagaa

SEQ ID NO: 12243 - DNA, 20 bp, synthetic construct
  misc_feature 1..20: note = CRISPR gRNA sequence
  source 1..20: mol_type = other DNA
caccctgtgcgtcttagaag

SEQ ID NO: 12244 - DNA, 20 bp, synthetic construct
  misc_feature 1..20: note = CRISPR gRNA sequence
  source 1..20: mol_type = other DNA
ctgtgcgtcttagaagaggt

SEQ ID NO: 12245 - DNA, 20 bp, synthetic construct
  misc_feature 1..20: note = CRISPR gRNA sequence
  source 1..20: mol_type = other DNA
ttagaagaggtgagtgattg

SEQ ID NO: 12246 - DNA, 20 bp, synthetic construct
  misc_feature 1..20: note = CRISPR gRNA sequence
  source 1..20: mol_type = other DNA
agaagaggtgagtgattgtg

SEQ ID NO: 12247 - DNA, 20 bp, synthetic construct
  misc_feature 1..20: note = CRISPR gRNA sequence
  source 1..20: mol_type = other DNA
gtgagtgattgtggagataa

SEQ ID NO: 12248 - DNA, 20 bp, synthetic construct
  misc_feature 1..20: note = CRISPR gRNA sequence
  source 1..20: mol_type = other DNA
tggagataaaagtgctttga

SEQ ID NO: 12249 - DNA, 20 bp, synthetic construct
  misc_feature 1..20: note = CRISPR gRNA sequence
  source 1..20: mol_type = other DNA
aagtgctttgaaagaatata

SEQ ID NO: 12250 - DNA, 20 bp, synthetic construct
  misc_feature 1..20: note = CRISPR gRNA sequence
  source 1..20: mol_type = other DNA
ttgaaagaatataaagtaac

SEQ ID NO: 12251 - DNA, 20 bp, synthetic construct
  misc_feature 1..20: note = CRISPR gRNA sequence
  source 1..20: mol_type = other DNA
gaatataaagtaaccagtat

SEQ ID NO: 12252 - DNA, 20 bp, synthetic construct
  misc_feature 1..20: note = CRISPR gRNA sequence
  source 1..20: mol_type = other DNA
gtaaccagtattggacatca

SEQ ID NO: 12253 - DNA, 20 bp, synthetic construct
  misc_feature 1..20: note = CRISPR gRNA sequence
  source 1..20: mol_type = other DNA
acatcatggtgacttaataa

SEQ ID NO: 12254 - DNA, 20 bp, synthetic construct
  misc_feature 1..20: note = CRISPR gRNA sequence
  source 1..20: mol_type = other DNA
atatgaaattgccaatttta

SEQ ID NO: 12255 - DNA, 20 bp, synthetic construct
  misc_feature 1..20: note = CRISPR gRNA sequence
  source 1..20: mol_type = other DNA
tatgaaattgccaattttac

SEQ ID NO: 12256 - DNA, 20 bp, synthetic construct
  misc_feature 1..20: note = CRISPR gRNA sequence
  source 1..20: mol_type = other DNA
ccaattttacaggtcaaaaa

SEQ ID NO: 12257 - DNA, 20 bp, synthetic construct
  misc_feature 1..20: note = CRISPR gRNA sequence
  source 1..20: mol_type = other DNA
caattttacaggtcaaaaat

SEQ ID NO: 12258 - DNA, 20 bp, synthetic construct
  misc_feature 1..20: note = CRISPR gRNA sequence
  source 1..20: mol_type = other DNA
ttttacaggtcaaaaatggg

SEQ ID NO: 12259 - DNA, 20 bp, synthetic construct
  misc_feature 1..20: note = CRISPR gRNA sequence
  source 1..20: mol_type = other DNA
ggtcaaaaatgggtggatgt

SEQ ID NO: 12260 - DNA, 20 bp, synthetic construct
  misc_feature 1..20: note = CRISPR gRNA sequence
  source 1..20: mol_type = other DNA
tggatgtcagcaatttcata

SEQ ID NO: 12261 - DNA, 20 bp, synthetic construct
  misc_feature 1..20: note = CRISPR gRNA sequence
  source 1..20: mol_type = other DNA
gtcagcaatttcatatggtt

SEQ ID NO: 12262 - DNA, 20 bp, synthetic construct
  misc_feature 1..20: note = CRISPR gRNA sequence
  source 1..20: mol_type = other DNA
tcatatggttcagcctaata

SEQ ID NO: 12263 - DNA, 20 bp, synthetic construct
  misc_feature 1..20: note = CRISPR gRNA sequence
  source 1..20: mol_type = other DNA
cagcctaatatagcatttat

SEQ ID NO: 12264 - DNA, 20 bp, synthetic construct
  misc_feature 1..20: note = CRISPR gRNA sequence
  source 1..20: mol_type = other DNA
ttattggcatttttgtgtgc

SEQ ID NO: 12265 - DNA, 20 bp, synthetic construct
  misc_feature 1..20: note = CRISPR gRNA sequence
  source 1..20: mol_type = other DNA
gtgccagctactgttgttat

SEQ ID NO: 12266 - DNA, 20 bp, synthetic construct
  misc_feature 1..20: note = CRISPR gRNA sequence
  source 1..20: mol_type = other DNA
gccagctactgttgttataa

SEQ ID NO: 12267 - DNA, 20 bp, synthetic construct
  misc_feature 1..20: note = CRISPR gRNA sequence
  source 1..20: mol_type = other DNA
ctgttgttataagagctttg

SEQ ID NO: 12268 - DNA, 20 bp, synthetic construct
  misc_feature 1..20: note = CRISPR gRNA sequence
  source 1..20: mol_type = other DNA
tgttgttataagagctttgt

SEQ ID NO: 12269 - DNA, 20 bp, synthetic construct
  misc_feature 1..20: note = CRISPR gRNA sequence
  source 1..20: mol_type = other DNA
gttgttataagagctttgta

SEQ ID NO: 12270 - DNA, 20 bp, synthetic construct
  misc_feature 1..20: note = CRISPR gRNA sequence
  source 1..20: mol_type = other DNA
agagctttgtagggcttgat

SEQ ID NO: 12271 - DNA, 20 bp, synthetic construct
  misc_feature 1..20: note = CRISPR gRNA sequence
  source 1..20: mol_type = other DNA
ttgtagggcttgattagttt

SEQ ID NO: 12272 - DNA, 20 bp, synthetic construct
  misc_feature 1..20: note = CRISPR gRNA sequence
  source 1..20: mol_type = other DNA
ttaagcctcacaaaacctct

SEQ ID NO: 12273 - DNA, 20 bp, synthetic construct
  misc_feature 1..20: note = CRISPR gRNA sequence
  source 1..20: mol_type = other DNA
taagcctcacaaaacctctt

SEQ ID NO: 12274 - DNA, 20 bp, synthetic construct
  misc_feature 1..20: note = CRISPR gRNA sequence
  source 1..20: mol_type = other DNA
gcctcacaaaacctcttggg

SEQ ID NO: 12275 - DNA, 20 bp, synthetic construct
  misc_feature 1..20: note = CRISPR gRNA sequence
  source 1..20: mol_type = other DNA
ttattactgtccccacttta

SEQ ID NO: 12276 - DNA, 20 bp, synthetic construct
  misc_feature 1..20: note = CRISPR gRNA sequence
  source 1..20: mol_type = other DNA
ctgtccccactttacagatg

SEQ ID NO: 12277 - DNA, 20 bp, synthetic construct
  misc_feature 1..20: note = CRISPR gRNA sequence
  source 1..20: mol_type = other DNA
tccccactttacagatgaag

SEQ ID NO: 12278 - DNA, 20 bp, synthetic construct
  misc_feature 1..20: note = CRISPR gRNA sequence
  source 1..20: mol_type = other DNA
ctttacagatgaagaagctg

SEQ ID NO: 12279 - DNA, 20 bp, synthetic construct
  misc_feature 1..20: note = CRISPR gRNA sequence
  source 1..20: mol_type = other DNA
acagatgaagaagctgaagc

SEQ ID NO: 12280 - DNA, 20 bp, synthetic construct
  misc_feature 1..20: note = CRISPR gRNA sequence
  source 1..20: mol_type = other DNA
agatgaagaagctgaagcca

SEQ ID NO: 12281 - DNA, 20 bp, synthetic construct
  misc_feature 1..20: note = CRISPR gRNA sequence
  source 1..20: mol_type = other DNA
gatgaagaagctgaagccag

SEQ ID NO: 12282 - DNA, 20 bp, synthetic construct
  misc_feature 1..20: note = CRISPR gRNA sequence
  source 1..20: mol_type = other DNA
atgaagaagctgaagccaga

SEQ ID NO: 12283 - DNA, 20 bp, synthetic construct
  misc_feature 1..20: note = CRISPR gRNA sequence
  source 1..20: mol_type = other DNA
tgaagaagctgaagccagag

SEQ ID NO: 12284 - DNA, 20 bp, synthetic construct
  misc_feature 1..20: note = CRISPR gRNA sequence
  source 1..20: mol_type = other DNA
gaagaagctgaagccagagg

SEQ ID NO: 12285 - DNA, 20 bp, synthetic construct
  misc_feature 1..20: note = CRISPR gRNA sequence
  source 1..20: mol_type = other DNA
gaagctgaagccagaggggg

SEQ ID NO: 12286 - DNA, 20 bp, synthetic construct
  misc_feature 1..20: note = CRISPR gRNA sequence
  source 1..20: mol_type = other DNA
gggggaagtgtctgctcacc

SEQ ID NO: 12287 - DNA, 20 bp, synthetic construct
  misc_feature 1..20: note = CRISPR gRNA sequence
  source 1..20: mol_type = other DNA
ggggaagtgtctgctcaccc

SEQ ID NO: 12288 - DNA, 20 bp, synthetic construct
  misc_feature 1..20: note = CRISPR gRNA sequence
  source 1..20: mol_type = other DNA
gggaagtgtctgctcaccca

SEQ ID NO: 12289 - DNA, 20 bp, synthetic construct
  misc_feature 1..20: note = CRISPR gRNA sequence
  source 1..20: mol_type = other DNA
tgtctgctcacccagggttg

SEQ ID NO: 12290 - DNA, 20 bp, synthetic construct
  misc_feature 1..20: note = CRISPR gRNA sequence
  source 1..20: mol_type = other DNA
gctcacccagggttgcagat

SEQ ID NO: 12291 - DNA, 20 bp, synthetic construct
  misc_feature 1..20: note = CRISPR gRNA sequence
  source 1..20: mol_type = other DNA
cccagggttgcagattggtg

SEQ ID NO: 12292 - DNA, 20 bp, synthetic construct
  misc_feature 1..20: note = CRISPR gRNA sequence
  source 1..20: mol_type = other DNA
ccagggttgcagattggtga

SEQ ID NO: 12293 - DNA, 20 bp, synthetic construct
  misc_feature 1..20: note = CRISPR gRNA sequence
  source 1..20: mol_type = other DNA
cagggttgcagattggtgaa

SEQ ID NO: 12294 - DNA, 20 bp, synthetic construct
  misc_feature 1..20: note = CRISPR gRNA sequence
  source 1..20: mol_type = other DNA
ggttgcagattggtgaaggg

SEQ ID NO: 12295 - DNA, 20 bp, synthetic construct
  misc_feature 1..20: note = CRISPR gRNA sequence
  source 1..20: mol_type = other DNA
ttgcagattggtgaagggaa

SEQ ID NO: 12296 - DNA, 20 bp, synthetic construct
  misc_feature 1..20: note = CRISPR gRNA sequence
  source 1..20: mol_type = other DNA
tgaagggaagagcatgattt

SEQ ID NO: 12297 - DNA, 20 bp, synthetic construct
  misc_feature 1..20: note = CRISPR gRNA sequence
  source 1..20: mol_type = other DNA
gaagagcatgatttgagctc

SEQ ID NO: 12298 - DNA, 20 bp, synthetic construct
  misc_feature 1..20: note = CRISPR gRNA sequence
  source 1..20: mol_type = other DNA
aagagcatgatttgagctcc

SEQ ID NO: 12299 - DNA, 20 bp, synthetic construct
  misc_feature 1..20: note = CRISPR gRNA sequence
  source 1..20: mol_type = other DNA
agagcatgatttgagctccg

SEQ ID NO: 12300 - DNA, 20 bp, synthetic construct
  misc_feature 1..20: note = CRISPR gRNA sequence
  source 1..20: mol_type = other DNA
tttgagctccggggtcacac

SEQ ID NO: 12301 - DNA, 20 bp, synthetic construct
  misc_feature 1..20: note = CRISPR gRNA sequence
  source 1..20: mol_type = other DNA
ttgagctccggggtcacact

SEQ ID NO: 12302 - DNA, 20 bp, synthetic construct
  misc_feature 1..20: note = CRISPR gRNA sequence
  source 1..20: mol_type = other DNA
gtcacactgggccacacgcc

SEQ ID NO: 12303 - DNA, 20 bp, synthetic construct
  misc_feature 1..20: note = CRISPR gRNA sequence
  source 1..20: mol_type = other DNA
tcacactgggccacacgcct

SEQ ID NO: 12304 - DNA, 20 bp, synthetic construct
  misc_feature 1..20: note = CRISPR gRNA sequence
  source 1..20: mol_type = other DNA
cacactgggccacacgcctg

SEQ ID NO: 12305 - DNA, 20 bp, synthetic construct
  misc_feature 1..20: note = CRISPR gRNA sequence
  source 1..20: mol_type = other DNA
cactgggccacacgcctggg

SEQ ID NO: 12306 - DNA, 20 bp, synthetic construct
  misc_feature 1..20: note = CRISPR gRNA sequence
  source 1..20: mol_type = other DNA
gggccacacgcctggggagt

SEQ ID NO: 12307 - DNA, 20 bp, synthetic construct
  misc_feature 1..20: note = CRISPR gRNA sequence
  source 1..20: mol_type = other DNA
gtgagttgttctccacccac

SEQ ID NO: 12308 - DNA, 20 bp, synthetic construct
  misc_feature 1..20: note = CRISPR gRNA sequence
  source 1..20: mol_type = other DNA
tgagttgttctccacccacc

SEQ ID NO: 12309 - DNA, 20 bp, synthetic construct
  misc_feature 1..20: note = CRISPR gRNA sequence
  source 1..20: mol_type = other DNA
gagttgttctccacccacca

SEQ ID NO: 12310 - DNA, 20 bp, synthetic construct
  misc_feature 1..20: note = CRISPR gRNA sequence
  source 1..20: mol_type = other DNA
ctccacccaccagggttgcc

SEQ ID NO: 12311 - DNA, 20 bp, synthetic construct
  misc_feature 1..20: note = CRISPR gRNA sequence
  source 1..20: mol_type = other DNA
agggttgcctggacttacgc

SEQ ID NO: 12312 - DNA, 20 bp, synthetic construct
  misc_feature 1..20: note = CRISPR gRNA sequence
  source 1..20: mol_type = other DNA
ttacgccagcgtctccacat

SEQ ID NO: 12313 - DNA, 20 bp, synthetic construct
  misc_feature 1..20: note = CRISPR gRNA sequence
  source 1..20: mol_type = other DNA
tacgccagcgtctccacatg

SEQ ID NO: 12314 - DNA, 20 bp, synthetic construct
  misc_feature 1..20: note = CRISPR gRNA sequence
  source 1..20: mol_type = other DNA
tccacatgaggacacctccg

SEQ ID NO: 12315 - DNA, 20 bp, synthetic construct
  misc_feature 1..20: note = CRISPR gRNA sequence
  source 1..20: mol_type = other DNA
ccacatgaggacacctccga

SEQ ID NO: 12316 - DNA, 20 bp, synthetic construct
  misc_feature 1..20: note = CRISPR gRNA sequence
  source 1..20: mol_type = other DNA
atgaggacacctccgaaggc

SEQ ID NO: 12317 - DNA, 20 bp, synthetic construct
  misc_feature 1..20: note = CRISPR gRNA sequence
  source 1..20: mol_type = other DNA
aggacacctccgaaggctgg

SEQ ID NO: 12318 - DNA, 20 bp, synthetic construct
  misc_feature 1..20: note = CRISPR gRNA sequence
  source 1..20: mol_type = other DNA
cacctccgaaggctggcagc

SEQ ID NO: 12319 - DNA, 20 bp, synthetic construct
  misc_feature 1..20: note = CRISPR gRNA sequence
  source 1..20: mol_type = other DNA
gaaggctggcagcgagctgc

SEQ ID NO: 12320 - DNA, 20 bp, synthetic construct
  misc_feature 1..20: note = CRISPR gRNA sequence
  source 1..20: mol_type = other DNA
aaggctggcagcgagctgct

SEQ ID NO: 12321 - DNA, 20 bp, synthetic construct
  misc_feature 1..20: note = CRISPR gRNA sequence
  source 1..20: mol_type = other DNA
ggcagcgagctgctgggccc

SEQ ID NO: 12322 - DNA, 20 bp, synthetic construct
  misc_feature 1..20: note = CRISPR gRNA sequence
  source 1..20: mol_type = other DNA
agcgagctgctgggccccgg

SEQ ID NO: 12323 - DNA, 20 bp, synthetic construct
  misc_feature 1..20: note = CRISPR gRNA sequence
  source 1..20: mol_type = other DNA
cagccgtgaacttgttgtac

SEQ ID NO: 12324 - DNA, 20 bp, synthetic construct
  misc_feature 1..20: note = CRISPR gRNA sequence
  source 1..20: mol_type = other DNA
gaacttgttgtactggacgc

SEQ ID NO: 12325 - DNA, 20 bp, synthetic construct
  misc_feature 1..20: note = CRISPR gRNA sequence
  source 1..20: mol_type = other DNA
ttgttgtactggacgctggc

SEQ ID NO: 12326 - DNA, 20 bp, synthetic construct
  misc_feature 1..20: note = CRISPR gRNA sequence
  source 1..20: mol_type = other DNA
gttgtactggacgctggcaa

SEQ ID NO: 12327 - DNA, 20 bp, synthetic construct
  misc_feature 1..20: note = CRISPR gRNA sequence
  source 1..20: mol_type = other DNA
ctggcaagagaaactcacct

SEQ ID NO: 12328 - DNA, 20 bp, synthetic construct
  misc_feature 1..20: note = CRISPR gRNA sequence
  source 1..20: mol_type = other DNA
tggcaagagaaactcacctt

SEQ ID NO: 12329 - DNA, 20 bp, synthetic construct
  misc_feature 1..20: note = CRISPR gRNA sequence
  source 1..20: mol_type = other DNA
ggcaagagaaactcaccttg

SEQ ID NO: 12330 - DNA, 20 bp, synthetic construct
  misc_feature 1..20: note = CRISPR gRNA sequence
  source 1..20: mol_type = other DNA
gagaaactcaccttggggcc

SEQ ID NO: 12331 - DNA, 20 bp, synthetic construct
  misc_feature 1..20: note = CRISPR gRNA sequence
  source 1..20: mol_type = other DNA
tcaccttggggcctggccct

SEQ ID NO: 12332 - DNA, 20 bp, synthetic construct
  misc_feature 1..20: note = CRISPR gRNA sequence
  source 1..20: mol_type = other DNA
caccttggggcctggccctt

SEQ ID NO: 12333 - DNA, 20 bp, synthetic construct
  misc_feature 1..20: note = CRISPR gRNA sequence
  source 1..20: mol_type = other DNA
gcctggcccttgggactccc

SEQ ID NO: 12334 - DNA, 20 bp, synthetic construct
  misc_feature 1..20: note = CRISPR gRNA sequence
  source 1..20: mol_type = other DNA
cccttgggactccccagctc

SEQ ID NO: 12335 - DNA, 20 bp, synthetic construct
  misc_feature 1..20: note = CRISPR gRNA sequence
  source 1..20: mol_type = other DNA
ggactccccagctccagacc

SEQ ID NO: 12336 - DNA, 20 bp, synthetic construct
  misc_feature 1..20: note = CRISPR gRNA sequence
  source 1..20: mol_type = other DNA
gactccccagctccagacca

SEQ ID NO: 12337 - DNA, 20 bp, synthetic construct
  misc_feature 1..20: note = CRISPR gRNA sequence
  source 1..20: mol_type = other DNA
accaaggccacccccacatc

SEQ ID NO: 12338 - DNA, 20 bp, synthetic construct
  misc_feature 1..20: note = CRISPR gRNA sequence
  source 1..20: mol_type = other DNA
acccccacatccagctcttc

SEQ ID NO: 12339 - DNA, 20 bp, synthetic construct
  misc_feature 1..20: note = CRISPR gRNA sequence
  source 1..20: mol_type = other DNA
cccccacatccagctcttcc

SEQ ID NO: 12340 - DNA, 20 bp, synthetic construct
  misc_feature 1..20: note = CRISPR gRNA sequence
  source 1..20: mol_type = other DNA
atccagctcttccaggacac

SEQ ID NO: 12341 - DNA, 20 bp, synthetic construct
  misc_feature 1..20: note = CRISPR gRNA sequence
  source 1..20: mol_type = other DNA
tccagctcttccaggacacc

SEQ ID NO: 12342 - DNA, 20 bp, synthetic construct
  misc_feature 1..20: note = CRISPR gRNA sequence
  source 1..20: mol_type = other DNA
ccagctcttccaggacacca

SEQ ID NO: 12343 - DNA, 20 bp, synthetic construct
  misc_feature 1..20: note = CRISPR gRNA sequence
  source 1..20: mol_type = other DNA
agctcttccaggacaccagg

SEQ ID NO: 12344 - DNA, 20 bp, synthetic construct
  misc_feature 1..20: note = CRISPR gRNA sequence
  source 1..20: mol_type = other DNA
ctcttccaggacaccaggga

SEQ ID NO: 12345 - DNA, 20 bp, synthetic construct
  misc_feature 1..20: note = CRISPR gRNA sequence
  source 1..20: mol_type = other DNA
aggacaccagggagagactt

SEQ ID NO: 12346 - DNA, 20 bp, synthetic construct
  misc_feature 1..20: note = CRISPR gRNA sequence
  source 1..20: mol_type = other DNA
gacttcagtgtctcccaccc

SEQ ID NO: 12347 - DNA, 20 bp, synthetic construct
  misc_feature 1..20: note = CRISPR gRNA sequence
  source 1..20: mol_type = other DNA
acttcagtgtctcccacccc

SEQ ID NO: 12348 - DNA, 20 bp, synthetic construct
  misc_feature 1..20: note = CRISPR gRNA sequence
  source 1..20: mol_type = other DNA
agtgtctcccaccccgggct

SEQ ID NO: 12349 - DNA, 20 bp, synthetic construct
  misc_feature 1..20: note = CRISPR gRNA sequence
  source 1..20: mol_type = other DNA
gggctgagccacccaccgcc

SEQ ID NO: 12350 - DNA, 20 bp, synthetic construct
  misc_feature 1..20: note = CRISPR gRNA sequence
  source 1..20: mol_type = other DNA
cccacactcactccatcacc

SEQ ID NO: 12351 - DNA, 20 bp, synthetic construct
  misc_feature 1..20: note = CRISPR gRNA sequence
  source 1..20: mol_type = other DNA
cacactcactccatcacccg

SEQ ID NO: 12352 - DNA, 20 bp, synthetic construct
  misc_feature 1..20: note = CRISPR gRNA sequence
  source 1..20: mol_type = other DNA
acactcactccatcacccgg

SEQ ID NO: 12353 - DNA, 20 bp, synthetic construct
  misc_feature 1..20: note = CRISPR gRNA sequence
  source 1..20: mol_type = other DNA
cactcactccatcacccgga

SEQ ID NO: 12354 - DNA, 20 bp, synthetic construct
  misc_feature 1..20: note = CRISPR gRNA sequence
  source 1..20: mol_type = other DNA
acccggagggacaccatgtc

SEQ ID NO: 12355 - DNA, 20 bp, synthetic construct
  misc_feature 1..20: note = CRISPR gRNA sequence
  source 1..20: mol_type = other DNA
cggagggacaccatgtccgg

SEQ ID NO: 12356 - DNA, 20 bp, synthetic construct
  misc_feature 1..20: note = CRISPR gRNA sequence
  source 1..20: mol_type = other DNA
caccatgtccggaagcacac

SEQ ID NO: 12357 - DNA, 20 bp, synthetic construct
  misc_feature 1..20: note = CRISPR gRNA sequence
  source 1..20: mol_type = other DNA
tgtccggaagcacacgagcc

SEQ ID NO: 12358 - DNA, 20 bp, synthetic construct
  misc_feature 1..20: note = CRISPR gRNA sequence
  source 1..20: mol_type = other DNA
aagcacacgagccaagctct

SEQ ID NO: 12359 - DNA, 20 bp, synthetic construct
  misc_feature 1..20: note = CRISPR gRNA sequence
  source 1..20: mol_type = other DNA
agctctcggctcccacgtcg

SEQ ID NO: 12360 - DNA, 20 bp, synthetic construct
  misc_feature 1..20: note = CRISPR gRNA sequence
  source 1..20: mol_type = other DNA
cggctcccacgtcgcagatg

SEQ ID NO: 12361 - DNA, 20 bp, synthetic construct
  misc_feature 1..20: note = CRISPR gRNA sequence
  source 1..20: mol_type = other DNA
cgcagatgcagttattgtac

SEQ ID NO: 12362 - DNA, 20 bp, synthetic construct
  misc_feature 1..20: note = CRISPR gRNA sequence
  source 1..20: mol_type = other DNA
gcagttattgtacaagctgt

SEQ ID NO: 12363 - DNA, 20 bp, synthetic construct
  misc_feature 1..20: note = CRISPR gRNA sequence
  source 1..20: mol_type = other DNA
attgtacaagctgtcggaaa

SEQ ID NO: 12364 - DNA, 20 bp, synthetic construct
  misc_feature 1..20: note = CRISPR gRNA sequence
  source 1..20: mol_type = other DNA
tgtacaagctgtcggaaaca

SEQ ID NO: 12365 - DNA, 20 bp, synthetic construct
  misc_feature 1..20: note = CRISPR gRNA sequence
  source 1..20: mol_type = other DNA
gtacaagctgtcggaaacag

SEQ ID NO: 12366 - DNA, 20 bp, synthetic construct
  misc_feature 1..20: note = CRISPR gRNA sequence
  source 1..20: mol_type = other DNA
aagctgtcggaaacagaggc

SEQ ID NO: 12367 - DNA, 20 bp, synthetic construct
  misc_feature 1..20: note = CRISPR gRNA sequence
  source 1..20: mol_type = other DNA
agctgtcggaaacagaggcc

SEQ ID NO: 12368 - DNA, 20 bp, synthetic construct
  misc_feature 1..20: note = CRISPR gRNA sequence
  source 1..20: mol_type = other DNA
gctgtcggaaacagaggcca

SEQ ID NO: 12369 - DNA, 20 bp, synthetic construct
  misc_feature 1..20: note = CRISPR gRNA sequence
  source 1..20: mol_type = other DNA
ctgtcggaaacagaggccag

SEQ ID NO: 12370 - DNA, 20 bp, synthetic construct
  misc_feature 1..20: note = CRISPR gRNA sequence
  source 1..20: mol_type = other DNA
tgtcggaaacagaggccagg

SEQ ID NO: 12371 - DNA, 20 bp, synthetic construct
  misc_feature 1..20: note = CRISPR gRNA sequence
  source 1..20: mol_type = other DNA
tcggaaacagaggccagggg

SEQ ID NO: 12372 - DNA, 20 bp, synthetic construct
  misc_feature 1..20: note = CRISPR gRNA sequence
  source 1..20: mol_type = other DNA
cggaaacagaggccaggggg

SEQ ID NO: 12373 - DNA, 20 bp, synthetic construct
  misc_feature 1..20: note = CRISPR gRNA sequence
  source 1..20: mol_type = other DNA
ggaaacagaggccaggggga

SEQ ID NO: 12374 - DNA, 20 bp, synthetic construct
  misc_feature 1..20: note = CRISPR gRNA sequence
  source 1..20: mol_type = other DNA
cagaggccagggggagggat

SEQ ID NO: 12375 - DNA, 20 bp, synthetic construct
  misc_feature 1..20: note = CRISPR gRNA sequence
  source 1..20: mol_type = other DNA
gaggccagggggagggattg

SEQ ID NO: 12376 - DNA, 20 bp, synthetic construct
  misc_feature 1..20: note = CRISPR gRNA sequence
  source 1..20: mol_type = other DNA
aggccagggggagggattgg

SEQ ID NO: 12377 - DNA, 20 bp, synthetic construct
  misc_feature 1..20: note = CRISPR gRNA sequence
  source 1..20: mol_type = other DNA
agggattggaggcctgtgca

SEQ ID NO: 12378 - DNA, 20 bp, synthetic construct
  misc_feature 1..20: note = CRISPR gRNA sequence
  source 1..20: mol_type = other DNA
attggaggcctgtgcatggt

SEQ ID NO: 12379 - DNA, 20 bp, synthetic construct
  misc_feature 1..20: note = CRISPR gRNA sequence
  source 1..20: mol_type = other DNA
cctgtgcatggtcagccttc

SEQ ID NO: 12380 - DNA, 20 bp, synthetic construct
  misc_feature 1..20: note = CRISPR gRNA sequence
  source 1..20: mol_type = other DNA
gtgcatggtcagccttccag

SEQ ID NO: 12381 - DNA, 20 bp, synthetic construct
  misc_feature 1..20: note = CRISPR gRNA sequence
  source 1..20: mol_type = other DNA
cttccagaagccaccatccc

SEQ ID NO: 12382 - DNA, 20 bp, synthetic construct
  misc_feature 1..20: note = CRISPR gRNA sequence
  source 1..20: mol_type = other DNA
aagccaccatccctagattc

SEQ ID NO: 12383 - DNA, 20 bp, synthetic construct
  misc_feature 1..20: note = CRISPR gRNA sequence
  source 1..20: mol_type = other DNA
ccatccctagattccagaaa

SEQ ID NO: 12384 - DNA, 20 bp, synthetic construct
  misc_feature 1..20: note = CRISPR gRNA sequence
  source 1..20: mol_type = other DNA
cctagattccagaaaaagcc

SEQ ID NO: 12385 - DNA, 20 bp, synthetic construct
  misc_feature 1..20: note = CRISPR gRNA sequence
  source 1..20: mol_type = other DNA
aagcctggtcccactatccc

SEQ ID NO: 12386 - DNA, 20 bp, synthetic construct
  misc_feature 1..20: note = CRISPR gRNA sequence
  source 1..20: mol_type = other DNA
agcctggtcccactatccct

SEQ ID NO: 12387 - DNA, 20 bp, synthetic construct
  misc_feature 1..20: note = CRISPR gRNA sequence
  source 1..20: mol_type = other DNA
gcctggtcccactatccctg

SEQ ID NO: 12388 - DNA, 20 bp, synthetic construct
  misc_feature 1..20: note = CRISPR gRNA sequence
  source 1..20: mol_type = other DNA
cctggtcccactatccctgg

SEQ ID NO: 12389 - DNA, 20 bp, synthetic construct
  misc_feature 1..20: note = CRISPR gRNA sequence
  source 1..20: mol_type = other DNA
ggtcccactatccctggggg

SEQ ID NO: 12390 - DNA, 20 bp, synthetic construct
  misc_feature 1..20: note = CRISPR gRNA sequence
  source 1..20: mol_type = other DNA
gtcccactatccctggggga

SEQ ID NO: 12391 - DNA, 20 bp, synthetic construct
  misc_feature 1..20: note = CRISPR gRNA sequence
  source 1..20: mol_type = other DNA
aatcaatatttattgcacaa

SEQ ID NO: 12392 - DNA, 20 bp, synthetic construct
  misc_feature 1..20: note = CRISPR gRNA sequence
  source 1..20: mol_type = other DNA
tcaatatttattgcacaaca

SEQ ID NO: 12393 - DNA, 20 bp, synthetic construct
  misc_feature 1..20: note = CRISPR gRNA sequence
  source 1..20: mol_type = other DNA
atttattgcacaacagagcc

SEQ ID NO: 12394 - DNA, 20 bp, synthetic construct
  misc_feature 1..20: note = CRISPR gRNA sequence
  source 1..20: mol_type = other DNA
acagagcctggcattgtgcc

SEQ ID NO: 12395 - DNA, 20 bp, synthetic construct
  misc_feature 1..20: note = CRISPR gRNA sequence
  source 1..20: mol_type = other DNA
cattgtgccaagtacttaca

SEQ ID NO: 12396 - DNA, 20 bp, synthetic construct
  misc_feature 1..20: note = CRISPR gRNA sequence
  source 1..20: mol_type = other DNA
attgtgccaagtacttacat

SEQ ID NO: 12397 - DNA, 20 bp, synthetic construct
  misc_feature 1..20: note = CRISPR gRNA sequence
  source 1..20: mol_type = other DNA
caagtacttacataggccat

SEQ ID NO: 12398 - DNA, 20 bp, synthetic construct
  misc_feature 1..20: note = CRISPR gRNA sequence
  source 1..20: mol_type = other DNA
aagtacttacataggccatt

SEQ ID NO: 12399 - DNA, 20 bp, synthetic construct
  misc_feature 1..20: note = CRISPR gRNA sequence
  source 1..20: mol_type = other DNA
acttacataggccattggga

SEQ ID NO: 12400 - DNA, 20 bp, synthetic construct
  misc_feature 1..20: note = CRISPR gRNA sequence
  source 1..20: mol_type = other DNA
ttgggatggttcccattttc

SEQ ID NO: 12401 - DNA, 20 bp, synthetic construct
  misc_feature 1..20: note = CRISPR gRNA sequence
  source 1..20: mol_type = other DNA
ccattttctagatatgaaaa

SEQ ID NO: 12402 - DNA, 20 bp, synthetic construct
  misc_feature 1..20: note = CRISPR gRNA sequence
  source 1..20: mol_type = other DNA
attttctagatatgaaaata

SEQ ID NO: 12403 - DNA, 20 bp, synthetic construct
  misc_feature 1..20: note = CRISPR gRNA sequence
  source 1..20: mol_type = other DNA
ttttctagatatgaaaatag

SEQ ID NO: 12404 - DNA, 20 bp, synthetic construct
  misc_feature 1..20: note = CRISPR gRNA sequence
  source 1..20: mol_type = other DNA
ctagatatgaaaatagaggc

SEQ ID NO: 12405 - DNA, 20 bp, synthetic construct
  misc_feature 1..20: note = CRISPR gRNA sequence
  source 1..20: mol_type = other DNA
tagatatgaaaatagaggct

SEQ ID NO: 12406 - DNA, 20 bp, synthetic construct
  misc_feature 1..20: note = CRISPR gRNA sequence
  source 1..20: mol_type = other DNA
aatagaggctaggaatgaat

SEQ ID NO: 12407 - DNA, 20 bp, synthetic construct
  misc_feature 1..20: note = CRISPR gRNA sequence
  source 1..20: mol_type = other DNA
atgaataagtgacttgctca

SEQ ID NO: 12408 - DNA, 20 bp, synthetic construct
  misc_feature 1..20: note = CRISPR gRNA sequence
  source 1..20: mol_type = other DNA
ttgctcaaagtttctgtccc

SEQ ID NO: 12409 - DNA, 20 bp, synthetic construct
  misc_feature 1..20: note = CRISPR gRNA sequence
  source 1..20: mol_type = other DNA
tgctcaaagtttctgtcccc

SEQ ID NO: 12410 - DNA, 20 bp, synthetic construct
  misc_feature 1..20: note = CRISPR gRNA sequence
  source 1..20: mol_type = other DNA
tttctgtccccaggtcccac

SEQ ID NO: 12411 - DNA, 20 bp, synthetic construct
  misc_feature 1..20: note = CRISPR gRNA sequence
  source 1..20: mol_type = other DNA
gtcccactagttctcttgtt

SEQ ID NO: 12412 - DNA, 20 bp, synthetic construct
  misc_feature 1..20: note = CRISPR gRNA sequence
  source 1..20: mol_type = other DNA
tcccactagttctcttgttc

SEQ ID NO: 12413 - DNA, 20 bp, synthetic construct
  misc_feature 1..20: note = CRISPR gRNA sequence
  source 1..20: mol_type = other DNA
cccactagttctcttgttca

SEQ ID NO: 12414 - DNA, 20 bp, synthetic construct
  misc_feature 1..20: note = CRISPR gRNA sequence
  source 1..20: mol_type = other DNA
agttctcttgttcagggctg

SEQ ID NO: 12415 - DNA, 20 bp, synthetic construct
  misc_feature 1..20: note = CRISPR gRNA sequence
  source 1..20: mol_type = other DNA
agggctgtggtgattgcttc

SEQ ID NO: 12416 - DNA, 20 bp, synthetic construct
  misc_feature 1..20: note = CRISPR gRNA sequence
  source 1..20: mol_type = other DNA
gggctgtggtgattgcttct

SEQ ID NO: 12417 - DNA, 20 bp, synthetic construct
  misc_feature 1..20: note = CRISPR gRNA sequence
  source 1..20: mol_type = other DNA
ggtgattgcttctaggatct

SEQ ID NO: 12418 - DNA, 20 bp, synthetic construct
  misc_feature 1..20: note = CRISPR gRNA sequence
  source 1..20: mol_type = other DNA
taggatctcagtgtcccctg

SEQ ID NO: 12419 - DNA, 20 bp, synthetic construct
  misc_feature 1..20: note = CRISPR gRNA sequence
  source 1..20: mol_type = other DNA
tctcagtgtcccctgcagcc

SEQ ID NO: 12420 - DNA, 20 bp, synthetic construct
  misc_feature 1..20: note = CRISPR gRNA sequence
  source 1..20: mol_type = other DNA
tcagtgtcccctgcagcctg

SEQ ID NO: 12421 - DNA, 20 bp, synthetic construct
  misc_feature 1..20: note = CRISPR gRNA sequence
  source 1..20: mol_type = other DNA
cagtgtcccctgcagcctgg

SEQ ID NO: 12422 - DNA, 20 bp, synthetic construct
  misc_feature 1..20: note = CRISPR gRNA sequence
  source 1..20: mol_type = other DNA
gtcccctgcagcctggaggt

SEQ ID NO: 12423 - DNA, 20 bp, synthetic construct
  misc_feature 1..20: note = CRISPR gRNA sequence
  source 1..20: mol_type = other DNA
cagcctggaggtcagccccg

SEQ ID NO: 12424 - DNA, 20 bp, synthetic construct
  misc_feature 1..20: note = CRISPR gRNA sequence
  source 1..20: mol_type = other DNA
agcctggaggtcagccccgt

SEQ ID NO: 12425 - DNA, 20 bp, synthetic construct
  misc_feature 1..20: note = CRISPR gRNA sequence
  source 1..20: mol_type = other DNA
cctggaggtcagccccgtgg

SEQ ID NO: 12426 - DNA, 20 bp, synthetic construct
  misc_feature 1..20: note = CRISPR gRNA sequence
  source 1..20: mol_type = other DNA
ccgtgggagtcaccacctac

SEQ ID NO: 12427 - DNA, 20 bp, synthetic construct
  misc_feature 1..20: note = CRISPR gRNA sequence
  source 1..20: mol_type = other DNA
cgtgggagtcaccacctact

SEQ ID NO: 12428 - DNA, 20 bp, synthetic construct
  misc_feature 1..20: note = CRISPR gRNA sequence
  source 1..20: mol_type = other DNA
gggattactgccccatttta

SEQ ID NO: 12429 - DNA, 20 bp, synthetic construct
  misc_feature 1..20: note = CRISPR gRNA sequence
  source 1..20: mol_type = other DNA
ttactgccccattttaaaga

SEQ ID NO: 12430 - DNA, 20 bp, synthetic construct
  misc_feature 1..20: note = CRISPR gRNA sequence
  source 1..20: mol_type = other DNA
tactgccccattttaaagac

SEQ ID NO: 12431 - DNA, 20 bp, synthetic construct
  misc_feature 1..20: note = CRISPR gRNA sequence
  source 1..20: mol_type = other DNA
attttaaagacaggcaaacc

SEQ ID NO: 12432 - DNA, 20 bp, synthetic construct
  misc_feature 1..20: note = CRISPR gRNA sequence
  source 1..20: mol_type = other DNA
aagacaggcaaaccaagacc

SEQ ID NO: 12433 - DNA, 20 bp, synthetic construct
  misc_feature 1..20: note = CRISPR gRNA sequence
  source 1..20: mol_type = other DNA
gacaggcaaaccaagaccca

SEQ ID NO: 12434 - DNA, 20 bp, synthetic construct
  misc_feature 1..20: note = CRISPR gRNA sequence
  source 1..20: mol_type = other DNA
caggcaaaccaagacccaga

SEQ ID NO: 12435 - DNA, 20 bp, synthetic construct
  misc_feature 1..20: note = CRISPR gRNA sequence
  source 1..20: mol_type = other DNA
aaaccaagacccagagagtt

SEQ ID NO: 12436 - DNA, 20 bp, synthetic construct
  misc_feature 1..20: note = CRISPR gRNA sequence
  source 1..20: mol_type = other DNA
gagttgagaccacttctctg

SEQ ID NO: 12437 - DNA, 20 bp, synthetic construct
  misc_feature 1..20: note = CRISPR gRNA sequence
  source 1..20: mol_type = other DNA
accacttctctgtggtcaaa

SEQ ID NO: 12438 - DNA, 20 bp, synthetic construct
  misc_feature 1..20: note = CRISPR gRNA sequence
  source 1..20: mol_type = other DNA
cttctctgtggtcaaacagt

SEQ ID NO: 12439 - DNA, 20 bp, synthetic construct
  misc_feature 1..20: note = CRISPR gRNA sequence
  source 1..20: mol_type = other DNA
ctgtggtcaaacagtgagcc

SEQ ID NO: 12440 - DNA, 20 bp, synthetic construct
  misc_feature 1..20: note = CRISPR gRNA sequence
  source 1..20: mol_type = other DNA
tgtggtcaaacagtgagccc

SEQ ID NO: 12441 - DNA, 20 bp, synthetic construct
  misc_feature 1..20: note = CRISPR gRNA sequence
  source 1..20: mol_type = other DNA
aaacagtgagcccaggaaaa

SEQ ID NO: 12442 - DNA, 20 bp, synthetic construct
  misc_feature 1..20: note = CRISPR gRNA sequence
  source 1..20: mol_type = other DNA
cagtgagcccaggaaaacag

SEQ ID NO: 12443 - DNA, 20 bp, synthetic construct
  misc_feature 1..20: note = CRISPR gRNA sequence
  source 1..20: mol_type = other DNA
agtgagcccaggaaaacagc

SEQ ID NO: 12444 - DNA, 20 bp, synthetic construct
  misc_feature 1..20: note = CRISPR gRNA sequence
  source 1..20: mol_type = other DNA
caggaaaacagcaggactaa

SEQ ID NO: 12445 - DNA, 20 bp, synthetic construct
  misc_feature 1..20: note = CRISPR gRNA sequence
  source 1..20: mol_type = other DNA
aggaaaacagcaggactaaa

SEQ ID NO: 12446 - DNA, 20 bp, synthetic construct
  misc_feature 1..20: note = CRISPR gRNA sequence
  source 1..20: mol_type = other DNA
aaaacagcaggactaaaagg

SEQ ID NO: 12447 - DNA, 20 bp, synthetic construct
  misc_feature 1..20: note = CRISPR gRNA sequence
  source 1..20: mol_type = other DNA
tcatttcttgccttactgtg

SEQ ID NO: 12448 - DNA, 20 bp, synthetic construct
  misc_feature 1..20: note = CRISPR gRNA sequence
  source 1..20: mol_type = other DNA
ccttactgtgtggaaactgt

SEQ ID NO: 12449 - DNA, 20 bp, synthetic construct
  misc_feature 1..20: note = CRISPR gRNA sequence
  source 1..20: mol_type = other DNA
aactgtcagaacaacttccc

SEQ ID NO: 12450 - DNA, 20 bp, synthetic construct
  misc_feature 1..20: note = CRISPR gRNA sequence
  source 1..20: mol_type = other DNA
aacttcccaagttcaaatcc

SEQ ID NO: 12451 - DNA, 20 bp, synthetic construct
  misc_feature 1..20: note = CRISPR gRNA sequence
  source 1..20: mol_type = other DNA
tcttactgcctatgtgacct

SEQ ID NO: 12452 - DNA, 20 bp, synthetic construct
  misc_feature 1..20: note = CRISPR gRNA sequence
  source 1..20: mol_type = other DNA
cttactgcctatgtgacctt

SEQ ID NO: 12453 - DNA, 20 bp, synthetic construct
  misc_feature 1..20: note = CRISPR gRNA sequence
  source 1..20: mol_type = other DNA
ctgcctatgtgaccttgggc

SEQ ID NO: 12454 - DNA, 20 bp, synthetic construct
  misc_feature 1..20: note = CRISPR gRNA sequence
  source 1..20: mol_type = other DNA
gcaagctactcaactcttct

SEQ ID NO: 12455 - DNA, 20 bp, synthetic construct
  misc_feature 1..20: note = CRISPR gRNA sequence
  source 1..20: mol_type = other DNA
tactcaactcttctgagact

SEQ ID NO: 12456 - DNA, 20 bp, synthetic construct
  misc_feature 1..20: note = CRISPR gRNA sequence
  source 1..20: mol_type = other DNA
cagtttgcccatctgtaaaa

SEQ ID NO: 12457 - DNA, 20 bp, synthetic construct
  misc_feature 1..20: note = CRISPR gRNA sequence
  source 1..20: mol_type = other DNA
agtttgcccatctgtaaaat

SEQ ID NO: 12458 - DNA, 20 bp, synthetic construct
  misc_feature 1..20: note = CRISPR gRNA sequence
  source 1..20: mol_type = other DNA
catctgtaaaatgggcatga

SEQ ID NO: 12459 - DNA, 20 bp, synthetic construct
  misc_feature 1..20: note = CRISPR gRNA sequence
  source 1..20: mol_type = other DNA
tctgtaaaatgggcatgata

SEQ ID NO: 12460 - DNA, 20 bp, synthetic construct
  misc_feature 1..20: note = CRISPR gRNA sequence
  source 1..20: mol_type = other DNA
tgggcatgatagagtcattg

SEQ ID NO: 12461 - DNA, 20 bp, synthetic construct
  misc_feature 1..20: note = CRISPR gRNA sequence
  source 1..20: mol_type = other DNA
gggcatgatagagtcattgt

SEQ ID NO: 12462 - DNA, 20 bp, synthetic construct
  misc_feature 1..20: note = CRISPR gRNA sequence
  source 1..20: mol_type = other DNA
ggcatgatagagtcattgtg

SEQ ID NO: 12463 - DNA, 20 bp, synthetic construct
  misc_feature 1..20: note = CRISPR gRNA sequence
  source 1..20: mol_type = other DNA
catgatagagtcattgtggg

SEQ ID NO: 12464 - DNA, 20 bp, synthetic construct
  misc_feature 1..20: note = CRISPR gRNA sequence
  source 1..20: mol_type = other DNA
atgatagagtcattgtgggg

SEQ ID NO: 12465 - DNA, 20 bp, synthetic construct
  misc_feature 1..20: note = CRISPR gRNA sequence
  source 1..20: mol_type = other DNA
gatagagtcattgtggggag

SEQ ID NO: 12466 - DNA, 20 bp, synthetic construct
  misc_feature 1..20: note = CRISPR gRNA sequence
  source 1..20: mol_type = other DNA
atcaatgctgatataacatt

SEQ ID NO: 12467 - DNA, 20 bp, synthetic construct
  misc_feature 1..20: note = CRISPR gRNA sequence
  source 1..20: mol_type = other DNA
ataacatttagaacatgcct

SEQ ID NO: 12468 - DNA, 20 bp, synthetic construct
  misc_feature 1..20: note = CRISPR gRNA sequence
  source 1..20: mol_type = other DNA
ttagaacatgccttggtgcc

SEQ ID NO: 12469 - DNA, 20 bp, synthetic construct
  misc_feature 1..20: note = CRISPR gRNA sequence
  source 1..20: mol_type = other DNA
gcctagaatgaactaaatgt

SEQ ID NO: 12470 - DNA, 20 bp, synthetic construct
  misc_feature 1..20: note = CRISPR gRNA sequence
  source 1..20: mol_type = other DNA
aatgaactaaatgttagcta

SEQ ID NO: 12471 - DNA, 20 bp, synthetic construct
  misc_feature 1..20: note = CRISPR gRNA sequence
  source 1..20: mol_type = other DNA
ctatggttctgactacatca

SEQ ID NO: 12472 - DNA, 20 bp, synthetic construct
  misc_feature 1..20: note = CRISPR gRNA sequence
  source 1..20: mol_type = other DNA
tatggttctgactacatcac

SEQ ID NO: 12473 - DNA, 20 bp, synthetic construct
  misc_feature 1..20: note = CRISPR gRNA sequence
  source 1..20: mol_type = other DNA
tgactacatcacaggaacat

SEQ ID NO: 12474 - DNA, 20 bp, synthetic construct
  misc_feature 1..20: note = CRISPR gRNA sequence
  source 1..20: mol_type = other DNA
tacatcacaggaacattggt

SEQ ID NO: 12475 - DNA, 20 bp, synthetic construct
  misc_feature 1..20: note = CRISPR gRNA sequence
  source 1..20: mol_type = other DNA
acatcacaggaacattggtg

SEQ ID NO: 12476 - DNA, 20 bp, synthetic construct
  misc_feature 1..20: note = CRISPR gRNA sequence
  source 1..20: mol_type = other DNA
catcacaggaacattggtga

SEQ ID NO: 12477 - DNA, 20 bp, synthetic construct
  misc_feature 1..20: note = CRISPR gRNA sequence
  source 1..20: mol_type = other DNA
aacattggtgagggtcgcat

SEQ ID NO: 12478 - DNA, 20 bp, synthetic construct
  misc_feature 1..20: note = CRISPR gRNA sequence
  source 1..20: mol_type = other DNA
gagggtcgcatgagttaaca

SEQ ID NO: 12479 - DNA, 20 bp, synthetic construct
  misc_feature 1..20: note = CRISPR gRNA sequence
  source 1..20: mol_type = other DNA
gggtcgcatgagttaacata

SEQ ID NO: 12480 - DNA, 20 bp, synthetic construct
  misc_feature 1..20: note = CRISPR gRNA sequence
  source 1..20: mol_type = other DNA
ggtcgcatgagttaacatag

SEQ ID NO: 12481 - DNA, 20 bp, synthetic construct
  misc_feature 1..20: note = CRISPR gRNA sequence
  source 1..20: mol_type = other DNA
gtcgcatgagttaacataga

SEQ ID NO: 12482 - DNA, 20 bp, synthetic construct
  misc_feature 1..20: note = CRISPR gRNA sequence
  source 1..20: mol_type = other DNA
gttaacatagagggtgtgac

SEQ ID NO: 12483 - DNA, 20 bp, synthetic construct
  misc_feature 1..20: note = CRISPR gRNA sequence
  source 1..20: mol_type = other DNA
atagagggtgtgaccagcac

SEQ ID NO: 12484 - DNA, 20 bp, synthetic construct
  misc_feature 1..20: note = CRISPR gRNA sequence
  source 1..20: mol_type = other DNA
tagagggtgtgaccagcact

SEQ ID NO: 12485 - DNA, 20 bp, synthetic construct
  misc_feature 1..20: note = CRISPR gRNA sequence
  source 1..20: mol_type = other DNA
agagggtgtgaccagcactg

SEQ ID NO: 12486 - DNA, 20 bp, synthetic construct
  misc_feature 1..20: note = CRISPR gRNA sequence
  source 1..20: mol_type = other DNA
gagggtgtgaccagcactgg

SEQ ID NO: 12487 - DNA, 20 bp, synthetic construct
  misc_feature 1..20: note = CRISPR gRNA sequence
  source 1..20: mol_type = other DNA
ggtgtgaccagcactggggg

SEQ ID NO: 12488 - DNA, 20 bp, synthetic construct
  misc_feature 1..20: note = CRISPR gRNA sequence
  source 1..20: mol_type = other DNA
gtgtgaccagcactgggggc

SEQ ID NO: 12489 - DNA, 20 bp, synthetic construct
  misc_feature 1..20: note = CRISPR gRNA sequence
  source 1..20: mol_type = other DNA
tgaccagcactgggggcagg

SEQ ID NO: 12490 - DNA, 20 bp, synthetic construct
  misc_feature 1..20: note = CRISPR gRNA sequence
  source 1..20: mol_type = other DNA
accagcactgggggcaggaa

SEQ ID NO: 12491 - DNA, 20 bp, synthetic construct
  misc_feature 1..20: note = CRISPR gRNA sequence
  source 1..20: mol_type = other DNA
actgggggcaggaagagaaa

SEQ ID NO: 12492 - DNA, 20 bp, synthetic construct
  misc_feature 1..20: note = CRISPR gRNA sequence
  source 1..20: mol_type = other DNA
ggggcaggaagagaaaaagc

SEQ ID NO: 12493 - DNA, 20 bp, synthetic construct
  misc_feature 1..20: note = CRISPR gRNA sequence
  source 1..20: mol_type = other DNA
gaagagaaaaagccagtcac

SEQ ID NO: 12494 - DNA, 20 bp, synthetic construct
  misc_feature 1..20: note = CRISPR gRNA sequence
  source 1..20: mol_type = other DNA
gaaaaagccagtcactggac

SEQ ID NO: 12495 - DNA, 20 bp, synthetic construct
  misc_feature 1..20: note = CRISPR gRNA sequence
  source 1..20: mol_type = other DNA
gccagtcactggaccagctc

SEQ ID NO: 12496 - DNA, 20 bp, synthetic construct
  misc_feature 1..20: note = CRISPR gRNA sequence
  source 1..20: mol_type = other DNA
tggaccagctccagtttctg

SEQ ID NO: 12497 - DNA, 20 bp, synthetic construct
  misc_feature 1..20: note = CRISPR gRNA sequence
  source 1..20: mol_type = other DNA
ttctgcagcatattcacaac

SEQ ID NO: 12498 - DNA, 20 bp, synthetic construct
  misc_feature 1..20: note = CRISPR gRNA sequence
  source 1..20: mol_type = other DNA
agcatattcacaaccagcat

SEQ ID NO: 12499 - DNA, 20 bp, synthetic construct
  misc_feature 1..20: note = CRISPR gRNA sequence
  source 1..20: mol_type = other DNA
atattcacaaccagcattag

SEQ ID NO: 12500 - DNA, 20 bp, synthetic construct
  misc_feature 1..20: note = CRISPR gRNA sequence
  source 1..20: mol_type = other DNA
ttcacaaccagcattagtag

SEQ ID NO: 12501 - DNA, 20 bp, synthetic construct
  misc_feature 1..20: note = CRISPR gRNA sequence
  source 1..20: mol_type = other DNA
agcattagtagcagtgaaaa

SEQ ID NO: 12502 - DNA, 20 bp, synthetic construct
  misc_feature 1..20: note = CRISPR gRNA sequence
  source 1..20: mol_type = other DNA
agcagtgaaaatagcatgat

SEQ ID NO: 12503 - DNA, 20 bp, synthetic construct
  misc_feature 1..20: note = CRISPR gRNA sequence
  source 1..20: mol_type = other DNA
agtgtcactgatgccaactt

SEQ ID NO: 12504 - DNA, 20 bp, synthetic construct
  misc_feature 1..20: note = CRISPR gRNA sequence
  source 1..20: mol_type = other DNA
tcagctgtttactcgacacc

SEQ ID NO: 12505 - DNA, 20 bp, synthetic construct
  misc_feature 1..20: note = CRISPR gRNA sequence
  source 1..20: mol_type = other DNA
gctgtttactcgacaccaag

SEQ ID NO: 12506 - DNA, 20 bp, synthetic construct
  misc_feature 1..20: note = CRISPR gRNA sequence
  source 1..20: mol_type = other DNA
gacaccaagcagccttttaa

SEQ ID NO: 12507 - DNA, 20 bp, synthetic construct
  misc_feature 1..20: note = CRISPR gRNA sequence
  source 1..20: mol_type = other DNA
acaccaagcagccttttaac

SEQ ID NO: 12508 - DNA, 20 bp, synthetic construct
  misc_feature 1..20: note = CRISPR gRNA sequence
  source 1..20: mol_type = other DNA
caagcagccttttaacaggt

SEQ ID NO: 12509 - DNA, 20 bp, synthetic construct
  misc_feature 1..20: note = CRISPR gRNA sequence
  source 1..20: mol_type = other DNA
aagcagccttttaacaggtc

SEQ ID NO: 12510 - DNA, 20 bp, synthetic construct
  misc_feature 1..20: note = CRISPR gRNA sequence
  source 1..20: mol_type = other DNA
taacaggtcaggtgctgctg

SEQ ID NO: 12511 - DNA, 20 bp, synthetic construct
  misc_feature 1..20: note = CRISPR gRNA sequence
  source 1..20: mol_type = other DNA
aacaggtcaggtgctgctgc

SEQ ID NO: 12512 - DNA, 20 bp, synthetic construct
  misc_feature 1..20: note = CRISPR gRNA sequence
  source 1..20: mol_type = other DNA
tgctgctgcgggtatgattt

SEQ ID NO: 12513 - DNA, 20 bp, synthetic construct
  misc_feature 1..20: note = CRISPR gRNA sequence
  source 1..20: mol_type = other DNA
gctgctgcgggtatgatttc

SEQ ID NO: 12514 - DNA, 20 bp, synthetic construct
  misc_feature 1..20: note = CRISPR gRNA sequence
  source 1..20: mol_type = other DNA
ctgctgcgggtatgatttca

SEQ ID NO: 12515 - DNA, 20 bp, synthetic construct
  misc_feature 1..20: note = CRISPR gRNA sequence
  source 1..20: mol_type = other DNA
gccatgactttgccatgatt

SEQ ID NO: 12516 - DNA, 20 bp, synthetic construct
  misc_feature 1..20: note = CRISPR gRNA sequence
  source 1..20: mol_type = other DNA
actttgccatgattcagcct

SEQ ID NO: 12517 - DNA, 20 bp, synthetic construct
  misc_feature 1..20: note = CRISPR gRNA sequence
  source 1..20: mol_type = other DNA
tcagcctcagaactcccttg

SEQ ID NO: 12518 - DNA, 20 bp, synthetic construct
  misc_feature 1..20: note = CRISPR gRNA sequence
  source 1..20: mol_type = other DNA
cagcctcagaactcccttgc

SEQ ID NO: 12519 - DNA, 20 bp, synthetic construct
  misc_feature 1..20: note = CRISPR gRNA sequence
  source 1..20: mol_type = other DNA
agcctcagaactcccttgca

SEQ ID NO: 12520 - DNA, 20 bp, synthetic construct
  misc_feature 1..20: note = CRISPR gRNA sequence
  source 1..20: mol_type = other DNA
ccttgcagggctgcatataa

SEQ ID NO: 12521 - DNA, 20 bp, synthetic construct
  misc_feature 1..20: note = CRISPR gRNA sequence
  source 1..20: mol_type = other DNA
tgcagggctgcatataaaag

SEQ ID NO: 12522 - DNA, 20 bp, synthetic construct
  misc_feature 1..20: note = CRISPR gRNA sequence
  source 1..20: mol_type = other DNA
agggctgcatataaaagcag

SEQ ID NO: 12523 - DNA, 20 bp, synthetic construct
  misc_feature 1..20: note = CRISPR gRNA sequence
  source 1..20: mol_type = other DNA
gggctgcatataaaagcagc

SEQ ID NO: 12524 - DNA, 20 bp, synthetic construct
  misc_feature 1..20: note = CRISPR gRNA sequence
  source 1..20: mol_type = other DNA
gcatataaaagcagcaggtg

SEQ ID NO: 12525 - DNA, 20 bp, synthetic construct
  misc_feature 1..20: note = CRISPR gRNA sequence
  source 1..20: mol_type = other DNA
tataaaagcagcaggtgcag

SEQ ID NO: 12526 - DNA, 20 bp, synthetic construct
  misc_feature 1..20: note = CRISPR gRNA sequence
  source 1..20: mol_type = other DNA
cgcctgtaatcctaacactt

SEQ ID NO: 12527 - DNA, 20 bp, synthetic construct
  misc_feature 1..20: note = CRISPR gRNA sequence
  source 1..20: mol_type = other DNA
cctgtaatcctaacactttg

SEQ ID NO: 12528 - DNA, 20 bp, synthetic construct
  misc_feature 1..20: note = CRISPR gRNA sequence
  source 1..20: mol_type = other DNA
ctgtaatcctaacactttgg

SEQ ID NO: 12529 - DNA, 20 bp, synthetic construct
  misc_feature 1..20: note = CRISPR gRNA sequence
  source 1..20: mol_type = other DNA
atcctaacactttggaggcc

SEQ ID NO: 12530 - DNA, 20 bp, synthetic construct
  misc_feature 1..20: note = CRISPR gRNA sequence
  source 1..20: mol_type = other DNA
tcctaacactttggaggccg

SEQ ID NO: 12531 - DNA, 20 bp, synthetic construct
  misc_feature 1..20: note = CRISPR gRNA sequence
  source 1..20: mol_type = other DNA
taacactttggaggccgagg

SEQ ID NO: 12532 - DNA, 20 bp, synthetic construct
  misc_feature 1..20: note = CRISPR gRNA sequence
  source 1..20: mol_type = other DNA
aacactttggaggccgaggc

SEQ ID NO: 12533 - DNA, 20 bp, synthetic construct
  misc_feature 1..20: note = CRISPR gRNA sequence
  source 1..20: mol_type = other DNA
actttggaggccgaggcggg

SEQ ID NO: 12534 - DNA, 20 bp, synthetic construct
  misc_feature 1..20: note = CRISPR gRNA sequence
  source 1..20: mol_type = other DNA
ccgaggcgggtggatcacct

SEQ ID NO: 12535 - DNA, 20 bp, synthetic construct
  misc_feature 1..20: note = CRISPR gRNA sequence
  source 1..20: mol_type = other DNA
cgaggcgggtggatcaccta

SEQ ID NO: 12536 - DNA, 20 bp, synthetic construct
  misc_feature 1..20: note = CRISPR gRNA sequence
  source 1..20: mol_type = other DNA
gcgggtggatcacctaaggt

SEQ ID NO: 12537 - DNA, 20 bp, synthetic construct
  misc_feature 1..20: note = CRISPR gRNA sequence
  source 1..20: mol_type = other DNA
cgggtggatcacctaaggtc

SEQ ID NO: 12538 - DNA, 20 bp, synthetic construct
  misc_feature 1..20: note = CRISPR gRNA sequence
  source 1..20: mol_type = other DNA
ggtggatcacctaaggtcgg

SEQ ID NO: 12539 - DNA, 20 bp, synthetic construct
  misc_feature 1..20: note = CRISPR gRNA sequence
  source 1..20: mol_type = other DNA
tcacctaaggtcgggagttt

SEQ ID NO: 12540 - DNA, 20 bp, synthetic construct
  misc_feature 1..20: note = CRISPR gRNA sequence
  source 1..20: mol_type = other DNA
taaggtcgggagtttgagac

SEQ ID NO: 12541 - DNA, 20 bp, synthetic construct
  misc_feature 1..20: note = CRISPR gRNA sequence
  source 1..20: mol_type = other DNA
tgagaccagcctgaccaaca

SEQ ID NO: 12542 - DNA, 20 bp, synthetic construct
  misc_feature 1..20: note = CRISPR gRNA sequence
  source 1..20: mol_type = other DNA
agaccagcctgaccaacatg

SEQ ID NO: 12543 - DNA, 20 bp, synthetic construct
  misc_feature 1..20: note = CRISPR gRNA sequence
  source 1..20: mol_type = other DNA
ctctactaaaaatacaaaat

SEQ ID NO: 12544 - DNA, 20 bp, synthetic construct
  misc_feature 1..20: note = CRISPR gRNA sequence
  source 1..20: mol_type = other DNA
actaaaaatacaaaattagc

SEQ ID NO: 12545 - DNA, 20 bp, synthetic construct
  misc_feature 1..20: note = CRISPR gRNA sequence
  source 1..20: mol_type = other DNA
ctaaaaatacaaaattagcc

SEQ ID NO: 12546 - DNA, 20 bp, synthetic construct
  misc_feature 1..20: note = CRISPR gRNA sequence
  source 1..20: mol_type = other DNA
acaaaattagccgggtgtga

SEQ ID NO: 12547 - DNA, 20 bp, synthetic construct
  misc_feature 1..20: note = CRISPR gRNA sequence
  source 1..20: mol_type = other DNA
atggcacatgcctatactcc

SEQ ID NO: 12548 - DNA, 20 bp, synthetic construct
  misc_feature 1..20: note = CRISPR gRNA sequence
  source 1..20: mol_type = other DNA
gcctatactcccagctactt

SEQ ID NO: 12549 - DNA, 20 bp, synthetic construct
  misc_feature 1..20: note = CRISPR gRNA sequence
  source 1..20: mol_type = other DNA
ctatactcccagctacttga

SEQ ID NO: 12550 - DNA, 20 bp, synthetic construct
  misc_feature 1..20: note = CRISPR gRNA sequence
  source 1..20: mol_type = other DNA
tatactcccagctacttgag

SEQ ID NO: 12551 - DNA, 20 bp, synthetic construct
  misc_feature 1..20: note = CRISPR gRNA sequence
  source 1..20: mol_type = other DNA
tcccagctacttgagaggct

SEQ ID NO: 12552 - DNA, 20 bp, synthetic construct
  misc_feature 1..20: note = CRISPR gRNA sequence
  source 1..20: mol_type = other DNA
cccagctacttgagaggctg

SEQ ID NO: 12553 - DNA, 20 bp, synthetic construct
  misc_feature 1..20: note = CRISPR gRNA sequence
  source 1..20: mol_type = other DNA
agctacttgagaggctgagg

SEQ ID NO: 12554 - DNA, 20 bp, synthetic construct
  misc_feature 1..20: note = CRISPR gRNA sequence
  source 1..20: mol_type = other DNA
gctacttgagaggctgaggc

SEQ ID NO: 12555 - DNA, 20 bp, synthetic construct
  misc_feature 1..20: note = CRISPR gRNA sequence
  source 1..20: mol_type = other DNA
tacttgagaggctgaggcag

SEQ ID NO: 12556 - DNA, 20 bp, synthetic construct
  misc_feature 1..20: note = CRISPR gRNA sequence
  source 1..20: mol_type = other DNA
gcaggagaattgcttgaact

SEQ ID NO: 12557 - DNA, 20 bp, synthetic construct
  misc_feature 1..20: note = CRISPR gRNA sequence
  source 1..20: mol_type = other DNA
caggagaattgcttgaactc

SEQ ID NO: 12558 - DNA, 20 bp, synthetic construct
  misc_feature 1..20: note = CRISPR gRNA sequence
  source 1..20: mol_type = other DNA
ggagaattgcttgaactcgg

SEQ ID NO: 12559 - DNA, 20 bp, synthetic construct
  misc_feature 1..20: note = CRISPR gRNA sequence
  source 1..20: mol_type = other DNA
gagaattgcttgaactcggg

SEQ ID NO: 12560 - DNA, 20 bp, synthetic construct
  misc_feature 1..20: note = CRISPR gRNA sequence
  source 1..20: mol_type = other DNA
aattgcttgaactcgggagg

SEQ ID NO: 12561 - DNA, 20 bp, synthetic construct
  misc_feature 1..20: note = CRISPR gRNA sequence
  source 1..20: mol_type = other DNA
ttgcttgaactcgggaggcg

SEQ ID NO: 12562 - DNA, 20 bp, synthetic construct
  misc_feature 1..20: note = CRISPR gRNA sequence
  source 1..20: mol_type = other DNA
gaactcgggaggcggagttg

SEQ ID NO: 12563 - DNA, 20 bp, synthetic construct
  misc_feature 1..20: note = CRISPR gRNA sequence
  source 1..20: mol_type = other DNA
aggcggagttgcagtgaact

SEQ ID NO: 12564 - DNA, 20 bp, synthetic construct
  misc_feature 1..20: note = CRISPR gRNA sequence
  source 1..20: mol_type = other DNA
agtgaactgagactgcactc

SEQ ID NO: 12565 - DNA, 20 bp, synthetic construct
  misc_feature 1..20: note = CRISPR gRNA sequence
  source 1..20: mol_type = other DNA
ctgagactgcactccagcct

SEQ ID NO: 12566 - DNA, 20 bp, synthetic construct
  misc_feature 1..20: note = CRISPR gRNA sequence
  source 1..20: mol_type = other DNA
tgcactccagccttggcaac

SEQ ID NO: 12567 - DNA, 20 bp, synthetic construct
  misc_feature 1..20: note = CRISPR gRNA sequence
  source 1..20: mol_type = other DNA
cactccagccttggcaacaa

SEQ ID NO: 12568 - DNA, 20 bp, synthetic construct
  misc_feature 1..20: note = CRISPR gRNA sequence
  source 1..20: mol_type = other DNA
aaactctgtctcgaaaaaaa

SEQ ID NO: 12569 - DNA, 20 bp, synthetic construct
  misc_feature 1..20: note = CRISPR gRNA sequence
  source 1..20: mol_type = other DNA
aagaaaaaaataaataaatg

SEQ ID NO: 12570 - DNA, 20 bp, synthetic construct
  misc_feature 1..20: note = CRISPR gRNA sequence
  source 1..20: mol_type = other DNA
aaaaaaataaataaatgcag

SEQ ID NO: 12571 - DNA, 20 bp, synthetic construct
  misc_feature 1..20: note = CRISPR gRNA sequence
  source 1..20: mol_type = other DNA
aaaaaataaataaatgcagc

SEQ ID NO: 12572 - DNA, 20 bp, synthetic construct
  misc_feature 1..20: note = CRISPR gRNA sequence
  source 1..20: mol_type = other DNA
agcaggtttacactgctgcc

SEQ ID NO: 12573 - DNA, 20 bp, synthetic construct
  misc_feature 1..20: note = CRISPR gRNA sequence
  source 1..20: mol_type = other DNA
aggtttacactgctgccaag

SEQ ID NO: 12574 - DNA, 20 bp, synthetic construct
  misc_feature 1..20: note = CRISPR gRNA sequence
  source 1..20: mol_type = other DNA
acactgctgccaagtggatt

SEQ ID NO: 12575 - DNA, 20 bp, synthetic construct
  misc_feature 1..20: note = CRISPR gRNA sequence
  source 1..20: mol_type = other DNA
cactgctgccaagtggattc

SEQ ID NO: 12576 - DNA, 20 bp, synthetic construct
  misc_feature 1..20: note = CRISPR gRNA sequence
  source 1..20: mol_type = other DNA
ggctaaatcaactcacatca

SEQ ID NO: 12577 - DNA, 20 bp, synthetic construct
  misc_feature 1..20: note = CRISPR gRNA sequence
  source 1..20: mol_type = other DNA
gctaaatcaactcacatcac

SEQ ID NO: 12578 - DNA, 20 bp, synthetic construct
  misc_feature 1..20: note = CRISPR gRNA sequence
  source 1..20: mol_type = other DNA
aatcaactcacatcacgggt

SEQ ID NO: 12579 - DNA, 20 bp, synthetic construct
  misc_feature 1..20: note = CRISPR gRNA sequence
  source 1..20: mol_type = other DNA
aactcacatcacgggtcggc

SEQ ID NO: 12580 - DNA, 20 bp, synthetic construct
  misc_feature 1..20: note = CRISPR gRNA sequence
  source 1..20: mol_type = other DNA
catcacgggtcggccggtac

SEQ ID NO: 12581 - DNA, 20 bp, synthetic construct
  misc_feature 1..20: note = CRISPR gRNA sequence
  source 1..20: mol_type = other DNA
cgggtcggccggtaccagtg

SEQ ID NO: 12582 - DNA, 20 bp, synthetic construct
  misc_feature 1..20: note = CRISPR gRNA sequence
  source 1..20: mol_type = other DNA
gccggtaccagtgcagaaac

SEQ ID NO: 12583 - DNA, 20 bp, synthetic construct
  misc_feature 1..20: note = CRISPR gRNA sequence
  source 1..20: mol_type = other DNA
gtaccagtgcagaaactaga

SEQ ID NO: 12584 - DNA, 20 bp, synthetic construct
  misc_feature 1..20: note = CRISPR gRNA sequence
  source 1..20: mol_type = other DNA
taccagtgcagaaactagat

SEQ ID NO: 12585 - DNA, 20 bp, synthetic construct
  misc_feature 1..20: note = CRISPR gRNA sequence
  source 1..20: mol_type = other DNA
accagtgcagaaactagatg

SEQ ID NO: 12586 - DNA, 20 bp, synthetic construct
  misc_feature 1..20: note = CRISPR gRNA sequence
  source 1..20: mol_type = other DNA
ccagtgcagaaactagatgg

SEQ ID NO: 12587 - DNA, 20 bp, synthetic construct
  misc_feature 1..20: note = CRISPR gRNA sequence
  source 1..20: mol_type = other DNA
gttttgcaatctctgaaccc

SEQ ID NO: 12588 - DNA, 20 bp, synthetic construct
  misc_feature 1..20: note = CRISPR gRNA sequence
  source 1..20: mol_type = other DNA
tttgcaatctctgaaccctg

SEQ ID NO: 12589 - DNA, 20 bp, synthetic construct
  misc_feature 1..20: note = CRISPR gRNA sequence
  source 1..20: mol_type = other DNA
gagacccttcctccacccca

SEQ ID NO: 12590 - DNA, 20 bp, synthetic construct
  misc_feature 1..20: note = CRISPR gRNA sequence
  source 1..20: mol_type = other DNA
agacccttcctccaccccac

SEQ ID NO: 12591 - DNA, 20 bp, synthetic construct
  misc_feature 1..20: note = CRISPR gRNA sequence
  source 1..20: mol_type = other DNA
gacccttcctccaccccaca

SEQ ID NO: 12592 - DNA, 20 bp, synthetic construct
  misc_feature 1..20: note = CRISPR gRNA sequence
  source 1..20: mol_type = other DNA
cccttcctccaccccacagg

SEQ ID NO: 12593 - DNA, 20 bp, synthetic construct
  misc_feature 1..20: note = CRISPR gRNA sequence
  source 1..20: mol_type = other DNA
cttcctccaccccacaggga

SEQ ID NO: 12594 - DNA, 20 bp, synthetic construct
  misc_feature 1..20: note = CRISPR gRNA sequence
  source 1..20: mol_type = other DNA
gaccatatttcatcgatgcc

SEQ ID NO: 12595 - DNA, 20 bp, synthetic construct
  misc_feature 1..20: note = CRISPR gRNA sequence
  source 1..20: mol_type = other DNA
gtcaccatttgaatatcatt

SEQ ID NO: 12596 - DNA, 20 bp, synthetic construct
  misc_feature 1..20: note = CRISPR gRNA sequence
  source 1..20: mol_type = other DNA
catttgaatatcattgagat

SEQ ID NO: 12597 - DNA, 20 bp, synthetic construct
  misc_feature 1..20: note = CRISPR gRNA sequence
  source 1..20: mol_type = other DNA
atttgaatatcattgagatc

SEQ ID NO: 12598 - DNA, 20 bp, synthetic construct
  misc_feature 1..20: note = CRISPR gRNA sequence
  source 1..20: mol_type = other DNA
aggatgtgtcttataaccaa

SEQ ID NO: 12599 - DNA, 20 bp, synthetic construct
  misc_feature 1..20: note = CRISPR gRNA sequence
  source 1..20: mol_type = other DNA
ttataaccaatagcgtgtca

SEQ ID NO: 12600 - DNA, 20 bp, synthetic construct
  misc_feature 1..20: note = CRISPR gRNA sequence
  source 1..20: mol_type = other DNA
gcgtgtcacagtttgcattt

SEQ ID NO: 12601 - DNA, 20 bp, synthetic construct
  misc_feature 1..20: note = CRISPR gRNA sequence
  source 1..20: mol_type = other DNA
tttgcattttggcctcatat

SEQ ID NO: 12602 - DNA, 20 bp, synthetic construct
  misc_feature 1..20: note = CRISPR gRNA sequence
  source 1..20: mol_type = other DNA
ttgcattttggcctcatatt

SEQ ID NO: 12603 - DNA, 20 bp, synthetic construct
  misc_feature 1..20: note = CRISPR gRNA sequence
  source 1..20: mol_type = other DNA
tgcattttggcctcatattg

SEQ ID NO: 12604 - DNA, 20 bp, synthetic construct
  misc_feature 1..20: note = CRISPR gRNA sequence
  source 1..20: mol_type = other DNA
ctcatattggggtcttacaa

SEQ ID NO: 12605 - DNA, 20 bp, synthetic construct
  misc_feature 1..20: note = CRISPR gRNA sequence
  source 1..20: mol_type = other DNA
tattggggtcttacaatgga

SEQ ID NO: 12606 - DNA, 20 bp, synthetic construct
  misc_feature 1..20: note = CRISPR gRNA sequence
  source 1..20: mol_type = other DNA
tcttacaatggatggcatct

SEQ ID NO: 12607 - DNA, 20 bp, synthetic construct
  misc_feature 1..20: note = CRISPR gRNA sequence
  source 1..20: mol_type = other DNA
atgaaatatgatgtttctta

SEQ ID NO: 12608 - DNA, 20 bp, synthetic construct
  misc_feature 1..20: note = CRISPR gRNA sequence
  source 1..20: mol_type = other DNA
tgaaatatgatgtttcttaa

SEQ ID NO: 12609 - DNA, 20 bp, synthetic construct
  misc_feature 1..20: note = CRISPR gRNA sequence
  source 1..20: mol_type = other DNA
gaaatatgatgtttcttaaa

SEQ ID NO: 12610 - DNA, 20 bp, synthetic construct
  misc_feature 1..20: note = CRISPR gRNA sequence
  source 1..20: mol_type = other DNA
atgtttcttaaagggtaaat

SEQ ID NO: 12611 - DNA, 20 bp, synthetic construct
  misc_feature 1..20: note = CRISPR gRNA sequence
  source 1..20: mol_type = other DNA
tgtttcttaaagggtaaatc

SEQ ID NO: 12612 - DNA, 20 bp, synthetic construct
  misc_feature 1..20: note = CRISPR gRNA sequence
  source 1..20: mol_type = other DNA
tcttaaagggtaaatcaggc

SEQ ID NO: 12613 - DNA, 20 bp, synthetic construct
  misc_feature 1..20: note = CRISPR gRNA sequence
  source 1..20: mol_type = other DNA
cttaaagggtaaatcaggct

SEQ ID NO: 12614 - DNA, 20 bp, synthetic construct
  misc_feature 1..20: note = CRISPR gRNA sequence
  source 1..20: mol_type = other DNA
agggtaaatcaggctgggca

SEQ ID NO: 12615 - DNA, 20 bp, synthetic construct
  misc_feature 1..20: note = CRISPR gRNA sequence
  source 1..20: mol_type = other DNA
gtaaatcaggctgggcatgg

SEQ ID NO: 12616 - DNA, 20 bp, synthetic construct
  misc_feature 1..20: note = CRISPR gRNA sequence
  source 1..20: mol_type = other DNA
gtggctcacacccgtaatcc

SEQ ID NO: 12617 - DNA, 20 bp, synthetic construct
  misc_feature 1..20: note = CRISPR gRNA sequence
  source 1..20: mol_type = other DNA
cacccgtaatcccagcactt

SEQ ID NO: 12618 - DNA, 20 bp, synthetic construct
  misc_feature 1..20: note = CRISPR gRNA sequence
  source 1..20: mol_type = other DNA
ccgtaatcccagcactttgg

SEQ ID NO: 12619 - DNA, 20 bp, synthetic construct
  misc_feature 1..20: note = CRISPR gRNA sequence
  source 1..20: mol_type = other DNA
cgtaatcccagcactttgga

SEQ ID NO: 12620 - DNA, 20 bp, synthetic construct
  misc_feature 1..20: note = CRISPR gRNA sequence
  source 1..20: mol_type = other DNA
tcccagcactttggaaggct

SEQ ID NO: 12621 - DNA, 20 bp, synthetic construct
  misc_feature 1..20: note = CRISPR gRNA sequence
  source 1..20: mol_type = other DNA
cccagcactttggaaggctg

SEQ ID NO: 12622 - DNA, 20 bp, synthetic construct
  misc_feature 1..20: note = CRISPR gRNA sequence
  source 1..20: mol_type = other DNA
agcactttggaaggctgagg

SEQ ID NO: 12623 - DNA, 20 bp, synthetic construct
  misc_feature 1..20: note = CRISPR gRNA sequence
  source 1..20: mol_type = other DNA
gcactttggaaggctgaggt

SEQ ID NO: 12624 - DNA, 20 bp, synthetic construct
  misc_feature 1..20: note = CRISPR gRNA sequence
  source 1..20: mol_type = other DNA
ctttggaaggctgaggtggg

SEQ ID NO: 12625 - DNA, 20 bp, synthetic construct
  misc_feature 1..20: note = CRISPR gRNA sequence
  source 1..20: mol_type = other DNA
gctgaggtgggtggatcgct

SEQ ID NO: 12626 - DNA, 20 bp, synthetic construct
  misc_feature 1..20: note = CRISPR gRNA sequence
  source 1..20: mol_type = other DNA
ctgaggtgggtggatcgctt

SEQ ID NO: 12627 - DNA, 20 bp, synthetic construct
  misc_feature 1..20: note = CRISPR gRNA sequence
  source 1..20: mol_type = other DNA
gtgggtggatcgcttgggcc

SEQ ID NO: 12628 - DNA, 20 bp, synthetic construct
  misc_feature 1..20: note = CRISPR gRNA sequence
  source 1..20: mol_type = other DNA
tgggtggatcgcttgggccc

SEQ ID NO: 12629 - DNA, 20 bp, synthetic construct
  misc_feature 1..20: note = CRISPR gRNA sequence
  source 1..20: mol_type = other DNA
tcgcttgggcccaggatttc

SEQ ID NO: 12630 - DNA, 20 bp, synthetic construct
  misc_feature 1..20: note = CRISPR gRNA sequence
  source 1..20: mol_type = other DNA
tgggcccaggatttcaagac

SEQ ID NO: 12631 - DNA, 20 bp, synthetic construct
  misc_feature 1..20: note = CRISPR gRNA sequence
  source 1..20: mol_type = other DNA
ccaggatttcaagaccagtc

SEQ ID NO: 12632 - DNA, 20 bp, synthetic construct
  misc_feature 1..20: note = CRISPR gRNA sequence
  source 1..20: mol_type = other DNA
caggatttcaagaccagtct

SEQ ID NO: 12633 - DNA, 20 bp, synthetic construct
  misc_feature 1..20: note = CRISPR gRNA sequence
  source 1..20: mol_type = other DNA
caagaccagtctgggccaca

SEQ ID NO: 12634 - DNA, 20 bp, synthetic construct
  misc_feature 1..20: note = CRISPR gRNA sequence
  source 1..20: mol_type = other DNA
ccagtctgggccacatggcg

SEQ ID NO: 12635 - DNA, 20 bp, synthetic construct
  misc_feature 1..20: note = CRISPR gRNA sequence
  source 1..20: mol_type = other DNA
ctctactgaaaacacaaaaa

SEQ ID NO: 12636 - DNA, 20 bp, synthetic construct
  misc_feature 1..20: note = CRISPR gRNA sequence
  source 1..20: mol_type = other DNA
ctgaaaacacaaaaatagcc

SEQ ID NO: 12637 - DNA, 20 bp, synthetic construct
  misc_feature 1..20: note = CRISPR gRNA sequence
  source 1..20: mol_type = other DNA
aacacaaaaatagcctggtg

SEQ ID NO: 12638 - DNA, 20 bp, synthetic construct
  misc_feature 1..20: note = CRISPR gRNA sequence
  source 1..20: mol_type = other DNA
acaaaaatagcctggtgtgg

SEQ ID NO: 12639 - DNA, 20 bp, synthetic construct
  misc_feature 1..20: note = CRISPR gRNA sequence
  source 1..20: mol_type = other DNA
aaaatagcctggtgtggtgg

SEQ ID NO: 12640 - DNA, 20 bp, synthetic construct
  misc_feature 1..20: note = CRISPR gRNA sequence
  source 1..20: mol_type = other DNA
aaatagcctggtgtggtggc

SEQ ID NO: 12641 - DNA, 20 bp, synthetic construct
  misc_feature 1..20: note = CRISPR gRNA sequence
  source 1..20: mol_type = other DNA
gtggcgggcatctgtaatcc

SEQ ID NO: 12642 - DNA, 20 bp, synthetic construct
  misc_feature 1..20: note = CRISPR gRNA sequence
  source 1..20: mol_type = other DNA
catctgtaatcccagctact

SEQ ID NO: 12643 - DNA, 20 bp, synthetic construct
  misc_feature 1..20: note = CRISPR gRNA sequence
  source 1..20: mol_type = other DNA
atctgtaatcccagctactt

SEQ ID NO: 12644 - DNA, 20 bp, synthetic construct
  misc_feature 1..20: note = CRISPR gRNA sequence
  source 1..20: mol_type = other DNA
ctgtaatcccagctacttgg

SEQ ID NO: 12645 - DNA, 20 bp, synthetic construct
  misc_feature 1..20: note = CRISPR gRNA sequence
  source 1..20: mol_type = other DNA
tgtaatcccagctacttggg

SEQ ID NO: 12646 - DNA, 20 bp, synthetic construct
  misc_feature 1..20: note = CRISPR gRNA sequence
  source 1..20: mol_type = other DNA
tcccagctacttgggaggct

SEQ ID NO: 12647 - DNA, 20 bp, synthetic construct
  misc_feature 1..20: note = CRISPR gRNA sequence
  source 1..20: mol_type = other DNA
cccagctacttgggaggctg

SEQ ID NO: 12648 - DNA, 20 bp, synthetic construct
  misc_feature 1..20: note = CRISPR gRNA sequence
  source 1..20: mol_type = other DNA
tacttgggaggctgaggcat

SEQ ID NO: 12649 - DNA, 20 bp, synthetic construct
  misc_feature 1..20: note = CRISPR gRNA sequence
  source 1..20: mol_type = other DNA
gcatgagaatcacttgaacc

SEQ ID NO: 12650 - DNA, 20 bp, synthetic construct
  misc_feature 1..20: note = CRISPR gRNA sequence
  source 1..20: mol_type = other DNA
catgagaatcacttgaaccc

SEQ ID NO: 12651 - DNA, 20 bp, synthetic construct
  misc_feature 1..20: note = CRISPR gRNA sequence
  source 1..20: mol_type = other DNA
tgagaatcacttgaacccag

SEQ ID NO: 12652 - DNA, 20 bp, synthetic construct
  misc_feature 1..20: note = CRISPR gRNA sequence
  source 1..20: mol_type = other DNA
gagaatcacttgaacccagg

SEQ ID NO: 12653 - DNA, 20 bp, synthetic construct
  misc_feature 1..20: note = CRISPR gRNA sequence
  source 1..20: mol_type = other DNA
aatcacttgaacccaggagg

SEQ ID NO: 12654 - DNA, 20 bp, synthetic construct
  misc_feature 1..20: note = CRISPR gRNA sequence
  source 1..20: mol_type = other DNA
aacccaggaggcagtgcttg

SEQ ID NO: 12655 - DNA, 20 bp, synthetic construct
  misc_feature 1..20: note = CRISPR gRNA sequence
  source 1..20: mol_type = other DNA
caggaggcagtgcttgcagt

SEQ ID NO: 12656 - DNA, 20 bp, synthetic construct
  misc_feature 1..20: note = CRISPR gRNA sequence
  source 1..20: mol_type = other DNA
ggcagtgcttgcagtgagct

SEQ ID NO: 12657 - DNA, 20 bp, synthetic construct
  misc_feature 1..20: note = CRISPR gRNA sequence
  source 1..20: mol_type = other DNA
gagatcatgccactgcacct

SEQ ID NO: 12658 - DNA, 20 bp, synthetic construct
  misc_feature 1..20: note = CRISPR gRNA sequence
  source 1..20: mol_type = other DNA
catgccactgcaccttagcc

SEQ ID NO: 12659 - DNA, 20 bp, synthetic construct
  misc_feature 1..20: note = CRISPR gRNA sequence
  source 1..20: mol_type = other DNA
atgccactgcaccttagcct

SEQ ID NO: 12660 - DNA, 20 bp, synthetic construct
  misc_feature 1..20: note = CRISPR gRNA sequence
  source 1..20: mol_type = other DNA
gcaccttagcctgggcaata

SEQ ID NO: 12661 - DNA, 20 bp, synthetic construct
  misc_feature 1..20: note = CRISPR gRNA sequence
  source 1..20: mol_type = other DNA
cttagcctgggcaataaagt

SEQ ID NO: 12662 - DNA, 20 bp, synthetic construct
  misc_feature 1..20: note = CRISPR gRNA sequence
  source 1..20: mol_type = other DNA
ctgggcaataaagtgagact

SEQ ID NO: 12663 - DNA, 20 bp, synthetic construct
  misc_feature 1..20: note = CRISPR gRNA sequence
  source 1..20: mol_type = other DNA
aagtgagacttggtctcaaa

SEQ ID NO: 12664 - DNA, 20 bp, synthetic construct
  misc_feature 1..20: note = CRISPR gRNA sequence
  source 1..20: mol_type = other DNA
agacttggtctcaaaaagaa

SEQ ID NO: 12665 - DNA, 20 bp, synthetic construct
  misc_feature 1..20: note = CRISPR gRNA sequence
  source 1..20: mol_type = other DNA
tggtctcaaaaagaaaagaa

SEQ ID NO: 12666 - DNA, 20 bp, synthetic construct
  misc_feature 1..20: note = CRISPR gRNA sequence
  source 1..20: mol_type = other DNA
aaaaagaaaagaaaagaaaa

SEQ ID NO: 12667 - DNA, 20 bp, synthetic construct
  misc_feature 1..20: note = CRISPR gRNA sequence
  source 1..20: mol_type = other DNA
gaaaagaaaagaaaaaagaa

SEQ ID NO: 12668 - DNA, 20 bp, synthetic construct
  misc_feature 1..20: note = CRISPR gRNA sequence
  source 1..20: mol_type = other DNA
gaaaaaagaaaagtgtaaat

SEQ ID NO: 12669 - DNA, 20 bp, synthetic construct
  misc_feature 1..20: note = CRISPR gRNA sequence
  source 1..20: mol_type = other DNA
agaaaagtgtaaatcagatc

SEQ ID NO: 12670 - DNA, 20 bp, synthetic construct
  misc_feature 1..20: note = CRISPR gRNA sequence
  source 1..20: mol_type = other DNA
cagatcaagtgtcgccttcc

SEQ ID NO: 12671 - DNA, 20 bp, synthetic construct
  misc_feature 1..20: note = CRISPR gRNA sequence
  source 1..20: mol_type = other DNA
agatcaagtgtcgccttccc

SEQ ID NO: 12672 - DNA, 20 bp, synthetic construct
  misc_feature 1..20: note = CRISPR gRNA sequence
  source 1..20: mol_type = other DNA
aaatacctcttgtgacccac

SEQ ID NO: 12673 - DNA, 20 bp, synthetic construct
  misc_feature 1..20: note = CRISPR gRNA sequence
  source 1..20: mol_type = other DNA
aatacctcttgtgacccaca

SEQ ID NO: 12674 - DNA, 20 bp, synthetic construct
  misc_feature 1..20: note = CRISPR gRNA sequence
  source 1..20: mol_type = other DNA
atacctcttgtgacccacaa

SEQ ID NO: 12675 - DNA, 20 bp, synthetic construct
  misc_feature 1..20: note = CRISPR gRNA sequence
  source 1..20: mol_type = other DNA
aagggcctccctgtgtgatc

SEQ ID NO: 12676 - DNA, 20 bp, synthetic construct
  misc_feature 1..20: note = CRISPR gRNA sequence
  source 1..20: mol_type = other DNA
cccctacttccaccattgcc

SEQ ID NO: 12677 - DNA, 20 bp, synthetic construct
  misc_feature 1..20: note = CRISPR gRNA sequence
  source 1..20: mol_type = other DNA
tgtccctcattcactacaca

SEQ ID NO: 12678 - DNA, 20 bp, synthetic construct
  misc_feature 1..20: note = CRISPR gRNA sequence
  source 1..20: mol_type = other DNA
tcattcactacacacagcca

SEQ ID NO: 12679 - DNA, 20 bp, synthetic construct
  misc_feature 1..20: note = CRISPR gRNA sequence
  source 1..20: mol_type = other DNA
ttcactacacacagccacag

SEQ ID NO: 12680 - DNA, 20 bp, synthetic construct
  misc_feature 1..20: note = CRISPR gRNA sequence
  source 1..20: mol_type = other DNA
cccttctgacccttaaaaca

SEQ ID NO: 12681 - DNA, 20 bp, synthetic construct
  misc_feature 1..20: note = CRISPR gRNA sequence
  source 1..20: mol_type = other DNA
acacagccccttttcccact

SEQ ID NO: 12682 - DNA, 20 bp, synthetic construct
  misc_feature 1..20: note = CRISPR gRNA sequence
  source 1..20: mol_type = other DNA
cacagccccttttcccactt

SEQ ID NO: 12683 - DNA, 20 bp, synthetic construct
  misc_feature 1..20: note = CRISPR gRNA sequence
  source 1..20: mol_type = other DNA
acagccccttttcccactta

SEQ ID NO: 12684 - DNA, 20 bp, synthetic construct
  misc_feature 1..20: note = CRISPR gRNA sequence
  source 1..20: mol_type = other DNA
cacctgctgttctttcttcc

SEQ ID NO: 12685 - DNA, 20 bp, synthetic construct
  misc_feature 1..20: note = CRISPR gRNA sequence
  source 1..20: mol_type = other DNA
cctgctgttctttcttccta

SEQ ID NO: 12686 - DNA, 20 bp, synthetic construct
  misc_feature 1..20: note = CRISPR gRNA sequence
  source 1..20: mol_type = other DNA
ttcctagagtccttttcccc

SEQ ID NO: 12687 - DNA, 20 bp, synthetic construct
  misc_feature 1..20: note = CRISPR gRNA sequence
  source 1..20: mol_type = other DNA
cctagagtccttttccccta

SEQ ID NO: 12688 - DNA, 20 bp, synthetic construct
  misc_feature 1..20: note = CRISPR gRNA sequence
  source 1..20: mol_type = other DNA
ttttcccctagagcttccca

SEQ ID NO: 12689 - DNA, 20 bp, synthetic construct
  misc_feature 1..20: note = CRISPR gRNA sequence
  source 1..20: mol_type = other DNA
tcccctagagcttcccacgg

SEQ ID NO: 12690 - DNA, 20 bp, synthetic construct
  misc_feature 1..20: note = CRISPR gRNA sequence
  source 1..20: mol_type = other DNA
ccacggaagaatcatctccc

SEQ ID NO: 12691 - DNA, 20 bp, synthetic construct
  misc_feature 1..20: note = CRISPR gRNA sequence
  source 1..20: mol_type = other DNA
cggaagaatcatctccccag

SEQ ID NO: 12692 - DNA, 20 bp, synthetic construct
  misc_feature 1..20: note = CRISPR gRNA sequence
  source 1..20: mol_type = other DNA
ccagaagtcctgtaccctcc

SEQ ID NO: 12693 - DNA, 20 bp, synthetic construct
  misc_feature 1..20: note = CRISPR gRNA sequence
  source 1..20: mol_type = other DNA
cagaagtcctgtaccctcct

SEQ ID NO: 12694 - DNA, 20 bp, synthetic construct
  misc_feature 1..20: note = CRISPR gRNA sequence
  source 1..20: mol_type = other DNA
agaagtcctgtaccctcctg

SEQ ID NO: 12695 - DNA, 20 bp, synthetic construct
  misc_feature 1..20: note = CRISPR gRNA sequence
  source 1..20: mol_type = other DNA
tgtaccctcctggggcttgt

SEQ ID NO: 12696 - DNA, 20 bp, synthetic construct
  misc_feature 1..20: note = CRISPR gRNA sequence
  source 1..20: mol_type = other DNA
gggcttgttagtttccttcc

SEQ ID NO: 12697 - DNA, 20 bp, synthetic construct
  misc_feature 1..20: note = CRISPR gRNA sequence
  source 1..20: mol_type = other DNA
tgcctaattcctactacgca

SEQ ID NO: 12698 - DNA, 20 bp, synthetic construct
  misc_feature 1..20: note = CRISPR gRNA sequence
  source 1..20: mol_type = other DNA
tactacgcaaagaaactcaa

SEQ ID NO: 12699 - DNA, 20 bp, synthetic construct
  misc_feature 1..20: note = CRISPR gRNA sequence
  source 1..20: mol_type = other DNA
acgcaaagaaactcaaaagc

SEQ ID NO: 12700 - DNA, 20 bp, synthetic construct
  misc_feature 1..20: note = CRISPR gRNA sequence
  source 1..20: mol_type = other DNA
aagcaagaacgacatctgtc

SEQ ID NO: 12701 - DNA, 20 bp, synthetic construct
  misc_feature 1..20: note = CRISPR gRNA sequence
  source 1..20: mol_type = other DNA
ctagttcatacttgtatctc

SEQ ID NO: 12702 - DNA, 20 bp, synthetic construct
  misc_feature 1..20: note = CRISPR gRNA sequence
  source 1..20: mol_type = other DNA
atacttgtatctctagtttt

SEQ ID NO: 12703 - DNA, 20 bp, synthetic construct
  misc_feature 1..20: note = CRISPR gRNA sequence
  source 1..20: mol_type = other DNA
tttttagcacaattatgaac

SEQ ID NO: 12704 - DNA, 20 bp, synthetic construct
  misc_feature 1..20: note = CRISPR gRNA sequence
  source 1..20: mol_type = other DNA
tagcacaattatgaaccaga

SEQ ID NO: 12705 - DNA, 20 bp, synthetic construct
  misc_feature 1..20: note = CRISPR gRNA sequence
  source 1..20: mol_type = other DNA
cagattctatttttgcttct

SEQ ID NO: 12706 - DNA, 20 bp, synthetic construct
  misc_feature 1..20: note = CRISPR gRNA sequence
  source 1..20: mol_type = other DNA
tgcttctgagtttctttgca

SEQ ID NO: 12707 - DNA, 20 bp, synthetic construct
  misc_feature 1..20: note = CRISPR gRNA sequence
  source 1..20: mol_type = other DNA
tctgagtttctttgcatagc

SEQ ID NO: 12708 - DNA, 20 bp, synthetic construct
  misc_feature 1..20: note = CRISPR gRNA sequence
  source 1..20: mol_type = other DNA
gagtttctttgcatagcaag

SEQ ID NO: 12709 - DNA, 20 bp, synthetic construct
  misc_feature 1..20: note = CRISPR gRNA sequence
  source 1..20: mol_type = other DNA
ttctttgcatagcaagaagt

SEQ ID NO: 12710 - DNA, 20 bp, synthetic construct
  misc_feature 1..20: note = CRISPR gRNA sequence
  source 1..20: mol_type = other DNA
ataaataaaatattgtaaaa

SEQ ID NO: 12711 - DNA, 20 bp, synthetic construct
  misc_feature 1..20: note = CRISPR gRNA sequence
  source 1..20: mol_type = other DNA
ttgtaaaacagtgatcatgc

SEQ ID NO: 12712 - DNA, 20 bp, synthetic construct
  misc_feature 1..20: note = CRISPR gRNA sequence
  source 1..20: mol_type = other DNA
tgtaaaacagtgatcatgct

SEQ ID NO: 12713 - DNA, 20 bp, synthetic construct
  misc_feature 1..20: note = CRISPR gRNA sequence
  source 1..20: mol_type = other DNA
aaaacagtgatcatgctggg

SEQ ID NO: 12714 - DNA, 20 bp, synthetic construct
  misc_feature 1..20: note = CRISPR gRNA sequence
  source 1..20: mol_type = other DNA
catgctgggaagaaattaac

SEQ ID NO: 12715 - DNA, 20 bp, synthetic construct
  misc_feature 1..20: note = CRISPR gRNA sequence
  source 1..20: mol_type = other DNA
atgctgggaagaaattaaca

SEQ ID NO: 12716 - DNA, 20 bp, synthetic construct
  misc_feature 1..20: note = CRISPR gRNA sequence
  source 1..20: mol_type = other DNA
gggaagaaattaacaaggct

SEQ ID NO: 12717 - DNA, 20 bp, synthetic construct
  misc_feature 1..20: note = CRISPR gRNA sequence
  source 1..20: mol_type = other DNA
ggaagaaattaacaaggctc

SEQ ID NO: 12718 - DNA, 20 bp, synthetic construct
  misc_feature 1..20: note = CRISPR gRNA sequence
  source 1..20: mol_type = other DNA
aagaaattaacaaggctcag

SEQ ID NO: 12719 - DNA, 20 bp, synthetic construct
  misc_feature 1..20: note = CRISPR gRNA sequence
  source 1..20: mol_type = other DNA
agaaattaacaaggctcagg

SEQ ID NO: 12720 - DNA, 20 bp, synthetic construct
  misc_feature 1..20: note = CRISPR gRNA sequence
  source 1..20: mol_type = other DNA
gaaattaacaaggctcagga

SEQ ID NO: 12721 - DNA, 20 bp, synthetic construct
  misc_feature 1..20: note = CRISPR gRNA sequence
  source 1..20: mol_type = other DNA
taacaaggctcaggagggta

SEQ ID NO: 12722 - DNA, 20 bp, synthetic construct
  misc_feature 1..20: note = CRISPR gRNA sequence
  source 1..20: mol_type = other DNA
aacaaggctcaggagggtat

SEQ ID NO: 12723 - DNA, 20 bp, synthetic construct
  misc_feature 1..20: note = CRISPR gRNA sequence
  source 1..20: mol_type = other DNA
gctcaggagggtataggacc

SEQ ID NO: 12724 - DNA, 20 bp, synthetic construct
  misc_feature 1..20: note = CRISPR gRNA sequence
  source 1..20: mol_type = other DNA
gggtataggacccagctact

SEQ ID NO: 12725 - DNA, 20 bp, synthetic construct
  misc_feature 1..20: note = CRISPR gRNA sequence
  source 1..20: mol_type = other DNA
tataggacccagctacttgg

SEQ ID NO: 12726 - DNA, 20 bp, synthetic construct
  misc_feature 1..20: note = CRISPR gRNA sequence
  source 1..20: mol_type = other DNA
ataggacccagctacttgga

SEQ ID NO: 12727 - DNA, 20 bp, synthetic construct
  misc_feature 1..20: note = CRISPR gRNA sequence
  source 1..20: mol_type = other DNA
acccagctacttggaaggct

SEQ ID NO: 12728 - DNA, 20 bp, synthetic construct
  misc_feature 1..20: note = CRISPR gRNA sequence
  source 1..20: mol_type = other DNA
cccagctacttggaaggctg

SEQ ID NO: 12729 - DNA, 20 bp, synthetic construct
  misc_feature 1..20: note = CRISPR gRNA sequence
  source 1..20: mol_type = other DNA
agctacttggaaggctgagg

SEQ ID NO: 12730 - DNA, 20 bp, synthetic construct
  misc_feature 1..20: note = CRISPR gRNA sequence
  source 1..20: mol_type = other DNA
gctacttggaaggctgaggt

SEQ ID NO: 12731 - DNA, 20 bp, synthetic construct
  misc_feature 1..20: note = CRISPR gRNA sequence
  source 1..20: mol_type = other DNA
tacttggaaggctgaggtgg

SEQ ID NO: 12732 - DNA, 20 bp, synthetic construct
  misc_feature 1..20: note = CRISPR gRNA sequence
  source 1..20: mol_type = other DNA
acttggaaggctgaggtggg

SEQ ID NO: 12733 - DNA, 20 bp, synthetic construct
  misc_feature 1..20: note = CRISPR gRNA sequence
  source 1..20: mol_type = other DNA
ctgaggtgggaggttcgctt

SEQ ID NO: 12734 - DNA, 20 bp, synthetic construct
  misc_feature 1..20: note = CRISPR gRNA sequence
  source 1..20: mol_type = other DNA
gtgggaggttcgcttcagtc

SEQ ID NO: 12735 - DNA, 20 bp, synthetic construct
  misc_feature 1..20: note = CRISPR gRNA sequence
  source 1..20: mol_type = other DNA
tgggaggttcgcttcagtcc

SEQ ID NO: 12736 - DNA, 20 bp, synthetic construct
  misc_feature 1..20: note = CRISPR gRNA sequence
  source 1..20: mol_type = other DNA
gaggttcgcttcagtccagg

SEQ ID NO: 12737 - DNA, 20 bp, synthetic construct
  misc_feature 1..20: note = CRISPR gRNA sequence
  source 1..20: mol_type = other DNA
tcgcttcagtccaggtagtc

SEQ ID NO: 12738 - DNA, 20 bp, synthetic construct
  misc_feature 1..20: note = CRISPR gRNA sequence
  source 1..20: mol_type = other DNA
cgcttcagtccaggtagtcg

SEQ ID NO: 12739 - DNA, 20 bp, synthetic construct
  misc_feature 1..20: note = CRISPR gRNA sequence
  source 1..20: mol_type = other DNA
agtccaggtagtcgaggctg

SEQ ID NO: 12740 - DNA, 20 bp, synthetic construct
  misc_feature 1..20: note = CRISPR gRNA sequence
  source 1..20: mol_type = other DNA
caggtagtcgaggctgtagt

SEQ ID NO: 12741 - DNA, 20 bp, synthetic construct
  misc_feature 1..20: note = CRISPR gRNA sequence
  source 1..20: mol_type = other DNA
tgcacccctgcactacaacc

SEQ ID NO: 12742 - DNA, 20 bp, synthetic construct
  misc_feature 1..20: note = CRISPR gRNA sequence
  source 1..20: mol_type = other DNA
gcacccctgcactacaacct

SEQ ID NO: 12743 - DNA, 20 bp, synthetic construct
  misc_feature 1..20: note = CRISPR gRNA sequence
  source 1..20: mol_type = other DNA
ccctgcactacaacctgggt

SEQ ID NO: 12744 - DNA, 20 bp, synthetic construct
  misc_feature 1..20: note = CRISPR gRNA sequence
  source 1..20: mol_type = other DNA
aaataaataaataaataaat

SEQ ID NO: 12745 - DNA, 20 bp, synthetic construct
  misc_feature 1..20: note = CRISPR gRNA sequence
  source 1..20: mol_type = other DNA
aaataaataaataaataagt

SEQ ID NO: 12746 - DNA, 20 bp, synthetic construct
  misc_feature 1..20: note = CRISPR gRNA sequence
  source 1..20: mol_type = other DNA
aaataaataaataagttggc

SEQ ID NO: 12747 - DNA, 20 bp, synthetic construct
  misc_feature 1..20: note = CRISPR gRNA sequence
  source 1..20: mol_type = other DNA
aataaataaataagttggcc

SEQ ID NO: 12748 - DNA, 20 bp, synthetic construct
  misc_feature 1..20: note = CRISPR gRNA sequence
  source 1..20: mol_type = other DNA
ataaataagttggccgggca

SEQ ID NO: 12749 - DNA, 20 bp, synthetic construct
  misc_feature 1..20: note = CRISPR gRNA sequence
  source 1..20: mol_type = other DNA
aataagttggccgggcatgg

SEQ ID NO: 12750 - DNA, 20 bp, synthetic construct
  misc_feature 1..20: note = CRISPR gRNA sequence
  source 1..20: mol_type = other DNA
gtggctcacgcctgtaatcc

SEQ ID NO: 12751 - DNA, 20 bp, synthetic construct
  misc_feature 1..20: note = CRISPR gRNA sequence
  source 1..20: mol_type = other DNA
tgtaatcctagtactcactt

SEQ ID NO: 12752 - DNA, 20 bp, synthetic construct
  misc_feature 1..20: note = CRISPR gRNA sequence
  source 1..20: mol_type = other DNA
gtaatcctagtactcacttt

SEQ ID NO: 12753 - DNA, 20 bp, synthetic construct
  misc_feature 1..20: note = CRISPR gRNA sequence
  source 1..20: mol_type = other DNA
aatcctagtactcactttgg

SEQ ID NO: 12754 - DNA, 20 bp, synthetic construct
  misc_feature 1..20: note = CRISPR gRNA sequence
  source 1..20: mol_type = other DNA
atcctagtactcactttggg

SEQ ID NO: 12755 - DNA, 20 bp, synthetic construct
  misc_feature 1..20: note = CRISPR gRNA sequence
  source 1..20: mol_type = other DNA
agtactcactttgggaggcc

SEQ ID NO: 12756 - DNA, 20 bp, synthetic construct
  misc_feature 1..20: note = CRISPR gRNA sequence
  source 1..20: mol_type = other DNA
gtactcactttgggaggccg

SEQ ID NO: 12757 - DNA, 20 bp, synthetic construct
  misc_feature 1..20: note = CRISPR gRNA sequence
  source 1..20: mol_type = other DNA
ctcactttgggaggccgagg

SEQ ID NO: 12758 - DNA, 20 bp, synthetic construct
  misc_feature 1..20: note = CRISPR gRNA sequence
  source 1..20: mol_type = other DNA
tcactttgggaggccgaggc

SEQ ID NO: 12759 - DNA, 20 bp, synthetic construct
  misc_feature 1..20: note = CRISPR gRNA sequence
  source 1..20: mol_type = other DNA
ctttgggaggccgaggcagg

SEQ ID NO: 12760 - DNA, 20 bp, synthetic construct
  misc_feature 1..20: note = CRISPR gRNA sequence
  source 1..20: mol_type = other DNA
ccgaggcaggtggatcacct

SEQ ID NO: 12761 - DNA, 20 bp, synthetic construct
  misc_feature 1..20: note = CRISPR gRNA sequence
  source 1..20: mol_type = other DNA
gcaggtggatcacctgagat

SEQ ID NO: 12762 - DNA, 20 bp, synthetic construct
  misc_feature 1..20: note = CRISPR gRNA sequence
  source 1..20: mol_type = other DNA
caggtggatcacctgagatc

SEQ ID NO: 12763 - DNA, 20 bp, synthetic construct
  misc_feature 1..20: note = CRISPR gRNA sequence
  source 1..20: mol_type = other DNA
ggtggatcacctgagatcag

SEQ ID NO: 12764 - DNA, 20 bp, synthetic construct
  misc_feature 1..20: note = CRISPR gRNA sequence
  source 1..20: mol_type = other DNA
tcacctgagatcaggagttt

SEQ ID NO: 12765 - DNA, 20 bp, synthetic construct
  misc_feature 1..20: note = CRISPR gRNA sequence
  source 1..20: mol_type = other DNA
tgagatcaggagtttgagac

SEQ ID NO: 12766 - DNA, 20 bp, synthetic construct
  misc_feature 1..20: note = CRISPR gRNA sequence
  source 1..20: mol_type = other DNA
tcaggagtttgagaccagcc

SEQ ID NO: 12767 - DNA, 20 bp, synthetic construct
  misc_feature 1..20: note = CRISPR gRNA sequence
  source 1..20: mol_type = other DNA
tgagaccagcctggccaaca

SEQ ID NO: 12768 - DNA, 20 bp, synthetic construct
  misc_feature 1..20: note = CRISPR gRNA sequence
  source 1..20: mol_type = other DNA
tctactaaaaatataaaaac

SEQ ID NO: 12769 - DNA, 20 bp, synthetic construct
  misc_feature 1..20: note = CRISPR gRNA sequence
  source 1..20: mol_type = other DNA
ctaaaaatataaaaactagc

SEQ ID NO: 12770 - DNA, 20 bp, synthetic construct
  misc_feature 1..20: note = CRISPR gRNA sequence
  source 1..20: mol_type = other DNA
atataaaaactagctggacg

SEQ ID NO: 12771 - DNA, 20 bp, synthetic construct
  misc_feature 1..20: note = CRISPR gRNA sequence
  source 1..20: mol_type = other DNA
taaaaactagctggacgtgg

SEQ ID NO: 12772 - DNA, 20 bp, synthetic construct
  misc_feature 1..20: note = CRISPR gRNA sequence
  source 1..20: mol_type = other DNA
aaactagctggacgtggtgg

SEQ ID NO: 12773 - DNA, 20 bp, synthetic construct
  misc_feature 1..20: note = CRISPR gRNA sequence
  source 1..20: mol_type = other DNA
aactagctggacgtggtggt

SEQ ID NO: 12774 - DNA, 20 bp, synthetic construct
  misc_feature 1..20: note = CRISPR gRNA sequence
  source 1..20: mol_type = other DNA
gtggtgggcgcctataatcc

SEQ ID NO: 12775 - DNA, 20 bp, synthetic construct
  misc_feature 1..20: note = CRISPR gRNA sequence
  source 1..20: mol_type = other DNA
cgcctataatcccagctact

SEQ ID NO: 12776 - DNA, 20 bp, synthetic construct
  misc_feature 1..20: note = CRISPR gRNA sequence
  source 1..20: mol_type = other DNA
cctataatcccagctactcg

SEQ ID NO: 12777 - DNA, 20 bp, synthetic construct
  misc_feature 1..20: note = CRISPR gRNA sequence
  source 1..20: mol_type = other DNA
tcccagctactcggagcact

SEQ ID NO: 12778 - DNA, 20 bp, synthetic construct
  misc_feature 1..20: note = CRISPR gRNA sequence
  source 1..20: mol_type = other DNA
cccagctactcggagcactg

SEQ ID NO: 12779 - DNA, 20 bp, synthetic construct
  misc_feature 1..20: note = CRISPR gRNA sequence
  source 1..20: mol_type = other DNA
agctactcggagcactgagg

SEQ ID NO: 12780 - DNA, 20 bp, synthetic construct
  misc_feature 1..20: note = CRISPR gRNA sequence
  source 1..20: mol_type = other DNA
gctactcggagcactgaggc

SEQ ID NO: 12781 - DNA, 20 bp, synthetic construct
  misc_feature 1..20: note = CRISPR gRNA sequence
  source 1..20: mol_type = other DNA
ggagcactgaggcaggcgaa

SEQ ID NO: 12782 - DNA, 20 bp, synthetic construct
  misc_feature 1..20: note = CRISPR gRNA sequence
  source 1..20: mol_type = other DNA
gcaggcgaatagcttgaacc

SEQ ID NO: 12783 - DNA, 20 bp, synthetic construct
  misc_feature 1..20: note = CRISPR gRNA sequence
  source 1..20: mol_type = other DNA
caggcgaatagcttgaacct

SEQ ID NO: 12784 - DNA, 20 bp, synthetic construct
  misc_feature 1..20: note = CRISPR gRNA sequence
  source 1..20: mol_type = other DNA
aggcgaatagcttgaacctg

SEQ ID NO: 12785 - DNA, 20 bp, synthetic construct
  misc_feature 1..20: note = CRISPR gRNA sequence
  source 1..20: mol_type = other DNA
ggcgaatagcttgaacctgg

SEQ ID NO: 12786 - DNA, 20 bp, synthetic construct
  misc_feature 1..20: note = CRISPR gRNA sequence
  source 1..20: mol_type = other DNA
gcgaatagcttgaacctggg

SEQ ID NO: 12787 - DNA, 20 bp, synthetic construct
  misc_feature 1..20: note = CRISPR gRNA sequence
  source 1..20: mol_type = other DNA
cgaatagcttgaacctgggg

SEQ ID NO: 12788 - DNA, 20 bp, synthetic construct
  misc_feature 1..20: note = CRISPR gRNA sequence
  source 1..20: mol_type = other DNA
gaatagcttgaacctggggg

SEQ ID NO: 12789 - DNA, 20 bp, synthetic construct
  misc_feature 1..20: note = CRISPR gRNA sequence
  source 1..20: mol_type = other DNA
aatagcttgaacctgggggg

SEQ ID NO: 12790 - DNA, 20 bp, synthetic construct
  misc_feature 1..20: note = CRISPR gRNA sequence
  source 1..20: mol_type = other DNA
agcttgaacctggggggggg

SEQ ID NO: 12791 - DNA, 20 bp, synthetic construct
  misc_feature 1..20: note = CRISPR gRNA sequence
  source 1..20: mol_type = other DNA
ttgaacctgggggggggcag

SEQ ID NO: 12792 - DNA, 20 bp, synthetic construct
  misc_feature 1..20: note = CRISPR gRNA sequence
  source 1..20: mol_type = other DNA
ctgggggggggcagaagttg

SEQ ID NO: 12793 - DNA, 20 bp, synthetic construct
  misc_feature 1..20: note = CRISPR gRNA sequence
  source 1..20: mol_type = other DNA
gggggggcagaagttgcagt

SEQ ID NO: 12794 - DNA, 20 bp, synthetic construct
  misc_feature 1..20: note = CRISPR gRNA sequence
  source 1..20: mol_type = other DNA
ggcagaagttgcagtgagct

SEQ ID NO: 12795 - DNA, 20 bp, synthetic construct
  misc_feature 1..20: note = CRISPR gRNA sequence
  source 1..20: mol_type = other DNA
gagatcacaccacttcactc

SEQ ID NO: 12796 - DNA, 20 bp, synthetic construct
  misc_feature 1..20: note = CRISPR gRNA sequence
  source 1..20: mol_type = other DNA
cacaccacttcactccagcc

SEQ ID NO: 12797 - DNA, 20 bp, synthetic construct
  misc_feature 1..20: note = CRISPR gRNA sequence
  source 1..20: mol_type = other DNA
acaccacttcactccagcct

SEQ ID NO: 12798 - DNA, 20 bp, synthetic construct
  misc_feature 1..20: note = CRISPR gRNA sequence
  source 1..20: mol_type = other DNA
cttcactccagcctgggtga

SEQ ID NO: 12799 - DNA, 20 bp, synthetic construct
  misc_feature 1..20: note = CRISPR gRNA sequence
  source 1..20: mol_type = other DNA
tcactccagcctgggtgaca

SEQ ID NO: 12800 - DNA, 20 bp, synthetic construct
  misc_feature 1..20: note = CRISPR gRNA sequence
  source 1..20: mol_type = other DNA
tccagcctgggtgacagagc

SEQ ID NO: 12801 - DNA, 20 bp, synthetic construct
  misc_feature 1..20: note = CRISPR gRNA sequence
  source 1..20: mol_type = other DNA
gcgagactccatctcaaaaa

SEQ ID NO: 12802 - DNA, 20 bp, synthetic construct
  misc_feature 1..20: note = CRISPR gRNA sequence
  source 1..20: mol_type = other DNA
attaaaaataaataaataat

SEQ ID NO: 12803 - DNA, 20 bp, synthetic construct
  misc_feature 1..20: note = CRISPR gRNA sequence
  source 1..20: mol_type = other DNA
ttaaaaataaataaataata

SEQ ID NO: 12804 - DNA, 20 bp, synthetic construct
  misc_feature 1..20: note = CRISPR gRNA sequence
  source 1..20: mol_type = other DNA
taaaaataaataaataataa

SEQ ID NO: 12805 - DNA, 20 bp, synthetic construct
  misc_feature 1..20: note = CRISPR gRNA sequence
  source 1..20: mol_type = other DNA
ggaccaaatgccatctttcc

SEQ ID NO: 12806 - DNA, 20 bp, synthetic construct
  misc_feature 1..20: note = CRISPR gRNA sequence
  source 1..20: mol_type = other DNA
gaccaaatgccatctttcct

SEQ ID NO: 12807 - DNA, 20 bp, synthetic construct
  misc_feature 1..20: note = CRISPR gRNA sequence
  source 1..20: mol_type = other DNA
ctttcctgggaatctgactc

SEQ ID NO: 12808 - DNA, 20 bp, synthetic construct
  misc_feature 1..20: note = CRISPR gRNA sequence
  source 1..20: mol_type = other DNA
aatctgactctggttgtcct

SEQ ID NO: 12809 - DNA, 20 bp, synthetic construct
  misc_feature 1..20: note = CRISPR gRNA sequence
  source 1..20: mol_type = other DNA
tgactctggttgtcctcagt

SEQ ID NO: 12810 - DNA, 20 bp, synthetic construct
  misc_feature 1..20: note = CRISPR gRNA sequence
  source 1..20: mol_type = other DNA
ctggttgtcctcagtaagtg

SEQ ID NO: 12811 - DNA, 20 bp, synthetic construct
  misc_feature 1..20: note = CRISPR gRNA sequence
  source 1..20: mol_type = other DNA
ggttgtcctcagtaagtgaa

SEQ ID NO: 12812 - DNA, 20 bp, synthetic construct
  misc_feature 1..20: note = CRISPR gRNA sequence
  source 1..20: mol_type = other DNA
cctcagtaagtgaagagctc

SEQ ID NO: 12813 - DNA, 20 bp, synthetic construct
  misc_feature 1..20: note = CRISPR gRNA sequence
  source 1..20: mol_type = other DNA
gtaagtgaagagctctggcg

SEQ ID NO: 12814 - DNA, 20 bp, synthetic construct
  misc_feature 1..20: note = CRISPR gRNA sequence
  source 1..20: mol_type = other DNA
aagtgaagagctctggcgaa

SEQ ID NO: 12815 - DNA, 20 bp, synthetic construct
  misc_feature 1..20: note = CRISPR gRNA sequence
  source 1..20: mol_type = other DNA
agtgaagagctctggcgaag

SEQ ID NO: 12816 - DNA, 20 bp, synthetic construct
  misc_feature 1..20: note = CRISPR gRNA sequence
  source 1..20: mol_type = other DNA
tgaagagctctggcgaagag

SEQ ID NO: 12817 - DNA, 20 bp, synthetic construct
  misc_feature 1..20: note = CRISPR gRNA sequence
  source 1..20: mol_type = other DNA
aagagctctggcgaagagga

SEQ ID NO: 12818 - DNA, 20 bp, synthetic construct
  misc_feature 1..20: note = CRISPR gRNA sequence
  source 1..20: mol_type = other DNA
agctctggcgaagaggagag

SEQ ID NO: 12819 - DNA, 20 bp, synthetic construct
  misc_feature 1..20: note = CRISPR gRNA sequence
  source 1..20: mol_type = other DNA
aagaggagagcagtttctct

SEQ ID NO: 12820 - DNA, 20 bp, synthetic construct
  misc_feature 1..20: note = CRISPR gRNA sequence
  source 1..20: mol_type = other DNA
gagagcagtttctctcagtc

SEQ ID NO: 12821 - DNA, 20 bp, synthetic construct
  misc_feature 1..20: note = CRISPR gRNA sequence
  source 1..20: mol_type = other DNA
gcagtttctctcagtctggc

SEQ ID NO: 12822 - DNA, 20 bp, synthetic construct
  misc_feature 1..20: note = CRISPR gRNA sequence
  source 1..20: mol_type = other DNA
tttctctcagtctggcgagt

SEQ ID NO: 12823 - DNA, 20 bp, synthetic construct
  misc_feature 1..20: note = CRISPR gRNA sequence
  source 1..20: mol_type = other DNA
ctctcagtctggcgagtaag

SEQ ID NO: 12824 - DNA, 20 bp, synthetic construct
  misc_feature 1..20: note = CRISPR gRNA sequence
  source 1..20: mol_type = other DNA
ctcagtctggcgagtaagaa

SEQ ID NO: 12825 - DNA, 20 bp, synthetic construct
  misc_feature 1..20: note = CRISPR gRNA sequence
  source 1..20: mol_type = other DNA
gtctggcgagtaagaagagc

SEQ ID NO: 12826 - DNA, 20 bp, synthetic construct
  misc_feature 1..20: note = CRISPR gRNA sequence
  source 1..20: mol_type = other DNA
taagaagagctggtaatgct

SEQ ID NO: 12827 - DNA, 20 bp, synthetic construct
  misc_feature 1..20: note = CRISPR gRNA sequence
  source 1..20: mol_type = other DNA
aagagctggtaatgctgagt

SEQ ID NO: 12828 - DNA, 20 bp, synthetic construct
  misc_feature 1..20: note = CRISPR gRNA sequence
  source 1..20: mol_type = other DNA
gtaatgctgagttggatgac

SEQ ID NO: 12829 - DNA, 20 bp, synthetic construct
  misc_feature 1..20: note = CRISPR gRNA sequence
  source 1..20: mol_type = other DNA
taatgctgagttggatgact

SEQ ID NO: 12830 - DNA, 20 bp, synthetic construct
  misc_feature 1..20: note = CRISPR gRNA sequence
  source 1..20: mol_type = other DNA
aatgctgagttggatgactg

SEQ ID NO: 12831 - DNA, 20 bp, synthetic construct
  misc_feature 1..20: note = CRISPR gRNA sequence
  source 1..20: mol_type = other DNA
gagttggatgactggggctc

SEQ ID NO: 12832 - DNA, 20 bp, synthetic construct
  misc_feature 1..20: note = CRISPR gRNA sequence
  source 1..20: mol_type = other DNA
gatgactggggctctggtcc

SEQ ID NO: 12833 - DNA, 20 bp, synthetic construct
  misc_feature 1..20: note = CRISPR gRNA sequence
  source 1..20: mol_type = other DNA
ctggggctctggtccaagct

SEQ ID NO: 12834 - DNA, 20 bp, synthetic construct
  misc_feature 1..20: note = CRISPR gRNA sequence
  source 1..20: mol_type = other DNA
ctcagtccgctcattacctc

SEQ ID NO: 12835 - DNA, 20 bp, synthetic construct
  misc_feature 1..20: note = CRISPR gRNA sequence
  source 1..20: mol_type = other DNA
tcagtccgctcattacctct

SEQ ID NO: 12836 - DNA, 20 bp, synthetic construct
  misc_feature 1..20: note = CRISPR gRNA sequence
  source 1..20: mol_type = other DNA
cattacctctgggaccacac

SEQ ID NO: 12837 - DNA, 20 bp, synthetic construct
  misc_feature 1..20: note = CRISPR gRNA sequence
  source 1..20: mol_type = other DNA
attacctctgggaccacacc

SEQ ID NO: 12838 - DNA, 20 bp, synthetic construct
  misc_feature 1..20: note = CRISPR gRNA sequence
  source 1..20: mol_type = other DNA
ttacctctgggaccacacca

SEQ ID NO: 12839 - DNA, 20 bp, synthetic construct
  misc_feature 1..20: note = CRISPR gRNA sequence
  source 1..20: mol_type = other DNA
tctgggaccacaccagggcc

SEQ ID NO: 12840 - DNA, 20 bp, synthetic construct
  misc_feature 1..20: note = CRISPR gRNA sequence
  source 1..20: mol_type = other DNA
ggaccacaccagggcctgga

SEQ ID NO: 12841 - DNA, 20 bp, synthetic construct
  misc_feature 1..20: note = CRISPR gRNA sequence
  source 1..20: mol_type = other DNA
ccacaccagggcctggatgg

SEQ ID NO: 12842 - DNA, 20 bp, synthetic construct
  misc_feature 1..20: note = CRISPR gRNA sequence
  source 1..20: mol_type = other DNA
cctggatggaagtcactcaa

SEQ ID NO: 12843 - DNA, 20 bp, synthetic construct
  misc_feature 1..20: note = CRISPR gRNA sequence
  source 1..20: mol_type = other DNA
gatggaagtcactcaaaagc

SEQ ID NO: 12844 - DNA, 20 bp, synthetic construct
  misc_feature 1..20: note = CRISPR gRNA sequence
  source 1..20: mol_type = other DNA
tggaagtcactcaaaagcaa

SEQ ID NO: 12845 - DNA, 20 bp, synthetic construct
  misc_feature 1..20: note = CRISPR gRNA sequence
  source 1..20: mol_type = other DNA
ggaagtcactcaaaagcaag

SEQ ID NO: 12846 - DNA, 20 bp, synthetic construct
  misc_feature 1..20: note = CRISPR gRNA sequence
  source 1..20: mol_type = other DNA
aaagcaagaggtgctatgcc

SEQ ID NO: 12847 - DNA, 20 bp, synthetic construct
  misc_feature 1..20: note = CRISPR gRNA sequence
  source 1..20: mol_type = other DNA
aagcaagaggtgctatgcca

SEQ ID NO: 12848 - DNA, 20 bp, synthetic construct
  misc_feature 1..20: note = CRISPR gRNA sequence
  source 1..20: mol_type = other DNA
ggtgctatgccaaggcctac

SEQ ID NO: 12849 - DNA, 20 bp, synthetic construct
  misc_feature 1..20: note = CRISPR gRNA sequence
  source 1..20: mol_type = other DNA
gctatgccaaggcctaccag

SEQ ID NO: 12850 - DNA, 20 bp, synthetic construct
  misc_feature 1..20: note = CRISPR gRNA sequence
  source 1..20: mol_type = other DNA
ctatgccaaggcctaccaga

SEQ ID NO: 12851 - DNA, 20 bp, synthetic construct
  misc_feature 1..20: note = CRISPR gRNA sequence
  source 1..20: mol_type = other DNA
tgccaaggcctaccagaagg

SEQ ID NO: 12852 - DNA, 20 bp, synthetic construct
  misc_feature 1..20: note = CRISPR gRNA sequence
  source 1..20: mol_type = other DNA
caaggcctaccagaaggtgg

SEQ ID NO: 12853 - DNA, 20 bp, synthetic construct
  misc_feature 1..20: note = CRISPR gRNA sequence
  source 1..20: mol_type = other DNA
ggtggcagtgaaacactgac

SEQ ID NO: 12854 - DNA, 20 bp, synthetic construct
  misc_feature 1..20: note = CRISPR gRNA sequence
  source 1..20: mol_type = other DNA
tgaaacactgaccggcatgt

SEQ ID NO: 12855 - DNA, 20 bp, synthetic construct
  misc_feature 1..20: note = CRISPR gRNA sequence
  source 1..20: mol_type = other DNA
ctgaccggcatgtaagtgac

SEQ ID NO: 12856 - DNA, 20 bp, synthetic construct
  misc_feature 1..20: note = CRISPR gRNA sequence
  source 1..20: mol_type = other DNA
tgaccggcatgtaagtgaca

SEQ ID NO: 12857 - DNA, 20 bp, synthetic construct
  misc_feature 1..20: note = CRISPR gRNA sequence
  source 1..20: mol_type = other DNA
cggcatgtaagtgacaaggc

SEQ ID NO: 12858 - DNA, 20 bp, synthetic construct
  misc_feature 1..20: note = CRISPR gRNA sequence
  source 1..20: mol_type = other DNA
gtaagtgacaaggccggcaa

SEQ ID NO: 12859 - DNA, 20 bp, synthetic construct
  misc_feature 1..20: note = CRISPR gRNA sequence
  source 1..20: mol_type = other DNA
ccggcaaaagctgacgtacg

SEQ ID NO: 12860 - DNA, 20 bp, synthetic construct
  misc_feature 1..20: note = CRISPR gRNA sequence
  source 1..20: mol_type = other DNA
caaaagctgacgtacgtggt

SEQ ID NO: 12861 - DNA, 20 bp, synthetic construct
  misc_feature 1..20: note = CRISPR gRNA sequence
  source 1..20: mol_type = other DNA
gacgtacgtggttagccttc

SEQ ID NO: 12862 - DNA, 20 bp, synthetic construct
  misc_feature 1..20: note = CRISPR gRNA sequence
  source 1..20: mol_type = other DNA
gtacgtggttagccttccag

SEQ ID NO: 12863 - DNA, 20 bp, synthetic construct
  misc_feature 1..20: note = CRISPR gRNA sequence
  source 1..20: mol_type = other DNA
cttccagaagccaccacccc

SEQ ID NO: 12864 - DNA, 20 bp, synthetic construct
  misc_feature 1..20: note = CRISPR gRNA sequence
  source 1..20: mol_type = other DNA
ttccagaagccaccacccct

SEQ ID NO: 12865 - DNA, 20 bp, synthetic construct
  misc_feature 1..20: note = CRISPR gRNA sequence
  source 1..20: mol_type = other DNA
aagccaccacccctaggttc

SEQ ID NO: 12866 - DNA, 20 bp, synthetic construct
  misc_feature 1..20: note = CRISPR gRNA sequence
  source 1..20: mol_type = other DNA
ccacccctaggttccggaaa

SEQ ID NO: 12867 - DNA, 20 bp, synthetic construct
  misc_feature 1..20: note = CRISPR gRNA sequence
  source 1..20: mol_type = other DNA
cctaggttccggaaaaagcc

SEQ ID NO: 12868 - DNA, 20 bp, synthetic construct
  misc_feature 1..20: note = CRISPR gRNA sequence
  source 1..20: mol_type = other DNA
aagcctggtcccgccatccc

SEQ ID NO: 12869 - DNA, 20 bp, synthetic construct
  misc_feature 1..20: note = CRISPR gRNA sequence
  source 1..20: mol_type = other DNA
agcctggtcccgccatccct

SEQ ID NO: 12870 - DNA, 20 bp, synthetic construct
  misc_feature 1..20: note = CRISPR gRNA sequence
  source 1..20: mol_type = other DNA
gcctggtcccgccatccctg

SEQ ID NO: 12871 - DNA, 20 bp, synthetic construct
  misc_feature 1..20: note = CRISPR gRNA sequence
  source 1..20: mol_type = other DNA
cctggtcccgccatccctgg

SEQ ID NO: 12872 - DNA, 20 bp, synthetic construct
  misc_feature 1..20: note = CRISPR gRNA sequence
  source 1..20: mol_type = other DNA
tcccgccatccctgggggaa

SEQ ID NO: 12873 - DNA, 20 bp, synthetic construct
  misc_feature 1..20: note = CRISPR gRNA sequence
  source 1..20: mol_type = other DNA
cccgccatccctgggggaaa

SEQ ID NO: 12874 - DNA, 20 bp, synthetic construct
  misc_feature 1..20: note = CRISPR gRNA sequence
  source 1..20: mol_type = other DNA
cgccatccctgggggaaaag

SEQ ID NO: 12875 - DNA, 20 bp, synthetic construct
  misc_feature 1..20: note = CRISPR gRNA sequence
  source 1..20: mol_type = other DNA
gagcaatatttattgcataa

SEQ ID NO: 12876 - DNA, 20 bp, synthetic construct
  misc_feature 1..20: note = CRISPR gRNA sequence
  source 1..20: mol_type = other DNA
atttattgcataacagaacc

SEQ ID NO: 12877 - DNA, 20 bp, synthetic construct
  misc_feature 1..20: note = CRISPR gRNA sequence
  source 1..20: mol_type = other DNA
acagaacctggcattgtgac

SEQ ID NO: 12878 - DNA, 20 bp, synthetic construct
  misc_feature 1..20: note = CRISPR gRNA sequence
  source 1..20: mol_type = other DNA
cattgtgacaagtgcttaca

SEQ ID NO: 12879 - DNA, 20 bp, synthetic construct
  misc_feature 1..20: note = CRISPR gRNA sequence
  source 1..20: mol_type = other DNA
caagtgcttacatagaccat

SEQ ID NO: 12880 - DNA, 20 bp, synthetic construct
  misc_feature 1..20: note = CRISPR gRNA sequence
  source 1..20: mol_type = other DNA
aagtgcttacatagaccatt

SEQ ID NO: 12881 - DNA, 20 bp, synthetic construct
  misc_feature 1..20: note = CRISPR gRNA sequence
  source 1..20: mol_type = other DNA
gcttacatagaccattagga

SEQ ID NO: 12882 - DNA, 20 bp, synthetic construct
  misc_feature 1..20: note = CRISPR gRNA sequence
  source 1..20: mol_type = other DNA
ttaggatggttcccattttc

SEQ ID NO: 12883 - DNA, 20 bp, synthetic construct
  misc_feature 1..20: note = CRISPR gRNA sequence
  source 1..20: mol_type = other DNA
taggatggttcccattttcc

SEQ ID NO: 12884 - DNA, 20 bp, synthetic construct
  misc_feature 1..20: note = CRISPR gRNA sequence
  source 1..20: mol_type = other DNA
atggttcccattttccaggt

SEQ ID NO: 12885 - DNA, 20 bp, synthetic construct
  misc_feature 1..20: note = CRISPR gRNA sequence
  source 1..20: mol_type = other DNA
ccattttccaggtaagaaaa

SEQ ID NO: 12886 - DNA, 20 bp, synthetic construct
  misc_feature 1..20: note = CRISPR gRNA sequence
  source 1..20: mol_type = other DNA
ttttccaggtaagaaaacag

SEQ ID NO: 12887 - DNA, 20 bp, synthetic construct
  misc_feature 1..20: note = CRISPR gRNA sequence
  source 1..20: mol_type = other DNA
ccaggtaagaaaacagcggc

SEQ ID NO: 12888 - DNA, 20 bp, synthetic construct
  misc_feature 1..20: note = CRISPR gRNA sequence
  source 1..20: mol_type = other DNA
caggtaagaaaacagcggct

SEQ ID NO: 12889 - DNA, 20 bp, synthetic construct
  misc_feature 1..20: note = CRISPR gRNA sequence
  source 1..20: mol_type = other DNA
gaatgaataactgacttgct

SEQ ID NO: 12890 - DNA, 20 bp, synthetic construct
  misc_feature 1..20: note = CRISPR gRNA sequence
  source 1..20: mol_type = other DNA
atgaataactgacttgctca

SEQ ID NO: 12891 - DNA, 20 bp, synthetic construct
  misc_feature 1..20: note = CRISPR gRNA sequence
  source 1..20: mol_type = other DNA
gtcccgctaatccttttgtt

SEQ ID NO: 12892 - DNA, 20 bp, synthetic construct
  misc_feature 1..20: note = CRISPR gRNA sequence
  source 1..20: mol_type = other DNA
tcccgctaatccttttgttc

SEQ ID NO: 12893 - DNA, 20 bp, synthetic construct
  misc_feature 1..20: note = CRISPR gRNA sequence
  source 1..20: mol_type = other DNA
cccgctaatccttttgttca

SEQ ID NO: 12894 - DNA, 20 bp, synthetic construct
  misc_feature 1..20: note = CRISPR gRNA sequence
  source 1..20: mol_type = other DNA
aatccttttgttcagggctg

SEQ ID NO: 12895 - DNA, 20 bp, synthetic construct
  misc_feature 1..20: note = CRISPR gRNA sequence
  source 1..20: mol_type = other DNA
agggctgtggtgattgcttc

SEQ ID NO: 12896 - DNA, 20 bp, synthetic construct
  misc_feature 1..20: note = CRISPR gRNA sequence
  source 1..20: mol_type = other DNA
gggctgtggtgattgcttct

SEQ ID NO: 12897 - DNA, 20 bp, synthetic construct
  misc_feature 1..20: note = CRISPR gRNA sequence
  source 1..20: mol_type = other DNA
ggctgtggtgattgcttcta

SEQ ID NO: 12898 - DNA, 20 bp, synthetic construct
  misc_feature 1..20: note = CRISPR gRNA sequence
  source 1..20: mol_type = other DNA
ggtgattgcttctagggtct

SEQ ID NO: 12899 - DNA, 20 bp, synthetic construct
  misc_feature 1..20: note = CRISPR gRNA sequence
  source 1..20: mol_type = other DNA
tagggtctcagtgtcccctg

SEQ ID NO: 12900 - DNA, 20 bp, synthetic construct
  misc_feature 1..20: note = CRISPR gRNA sequence
  source 1..20: mol_type = other DNA
gtctcagtgtcccctgcagc

SEQ ID NO: 12901 - DNA, 20 bp, synthetic construct
  misc_feature 1..20: note = CRISPR gRNA sequence
  source 1..20: mol_type = other DNA
cccctgcagccagcacgatg

SEQ ID NO: 12902 - DNA, 20 bp, synthetic construct
  misc_feature 1..20: note = CRISPR gRNA sequence
  source 1..20: mol_type = other DNA
ccctgcagccagcacgatgt

SEQ ID NO: 12903 - DNA, 20 bp, synthetic construct
  misc_feature 1..20: note = CRISPR gRNA sequence
  source 1..20: mol_type = other DNA
tgtgggttccctgcgctctg

SEQ ID NO: 12904 - DNA, 20 bp, synthetic construct
  misc_feature 1..20: note = CRISPR gRNA sequence
  source 1..20: mol_type = other DNA
ccctgcgctctgcagccccc

SEQ ID NO: 12905 - DNA, 20 bp, synthetic construct
  misc_feature 1..20: note = CRISPR gRNA sequence
  source 1..20: mol_type = other DNA
cgctctgcagccccccagct

SEQ ID NO: 12906 - DNA, 20 bp, synthetic construct
  misc_feature 1..20: note = CRISPR gRNA sequence
  source 1..20: mol_type = other DNA
cccccagctcagcacctgac

SEQ ID NO: 12907 - DNA, 20 bp, synthetic construct
  misc_feature 1..20: note = CRISPR gRNA sequence
  source 1..20: mol_type = other DNA
ctcagcacctgaccggtatc

SEQ ID NO: 12908 - DNA, 20 bp, synthetic construct
  misc_feature 1..20: note = CRISPR gRNA sequence
  source 1..20: mol_type = other DNA
tcagcacctgaccggtatcc

SEQ ID NO: 12909 - DNA, 20 bp, synthetic construct
  misc_feature 1..20: note = CRISPR gRNA sequence
  source 1..20: mol_type = other DNA
cagcacctgaccggtatccg

SEQ ID NO: 12910 - DNA, 20 bp, synthetic construct
  misc_feature 1..20: note = CRISPR gRNA sequence
  source 1..20: mol_type = other DNA
atccggggccccactcacct

SEQ ID NO: 12911 - DNA, 20 bp, synthetic construct
  misc_feature 1..20: note = CRISPR gRNA sequence
  source 1..20: mol_type = other DNA
ggccccactcaccttagcct

SEQ ID NO: 12912 - DNA, 20 bp, synthetic construct
  misc_feature 1..20: note = CRISPR gRNA sequence
  source 1..20: mol_type = other DNA
cccactcaccttagcctgag

SEQ ID NO: 12913 - DNA, 20 bp, synthetic construct
  misc_feature 1..20: note = CRISPR gRNA sequence
  source 1..20: mol_type = other DNA
ccactcaccttagcctgagc

SEQ ID NO: 12914 - DNA, 20 bp, synthetic construct
  misc_feature 1..20: note = CRISPR gRNA sequence
  source 1..20: mol_type = other DNA
cactcaccttagcctgagca

SEQ ID NO: 12915 - DNA, 20 bp, synthetic construct
  misc_feature 1..20: note = CRISPR gRNA sequence
  source 1..20: mol_type = other DNA
ccttagcctgagcagggatg

SEQ ID NO: 12916 - DNA, 20 bp, synthetic construct
  misc_feature 1..20: note = CRISPR gRNA sequence
  source 1..20: mol_type = other DNA
agcctgagcagggatgcagc

SEQ ID NO: 12917 - DNA, 20 bp, synthetic construct
  misc_feature 1..20: note = CRISPR gRNA sequence
  source 1..20: mol_type = other DNA
gagcagggatgcagcgagcg

SEQ ID NO: 12918 - DNA, 20 bp, synthetic construct
  misc_feature 1..20: note = CRISPR gRNA sequence
  source 1..20: mol_type = other DNA
agcagggatgcagcgagcga

SEQ ID NO: 12919 - DNA, 20 bp, synthetic construct
  misc_feature 1..20: note = CRISPR gRNA sequence
  source 1..20: mol_type = other DNA
agggatgcagcgagcgaagg

SEQ ID NO: 12920 - DNA, 20 bp, synthetic construct
  misc_feature 1..20: note = CRISPR gRNA sequence
  source 1..20: mol_type = other DNA
gggatgcagcgagcgaaggc

SEQ ID NO: 12921 - DNA, 20 bp, synthetic construct
  misc_feature 1..20: note = CRISPR gRNA sequence
  source 1..20: mol_type = other DNA
ggatgcagcgagcgaaggca

SEQ ID NO: 12922 - DNA, 20 bp, synthetic construct
  misc_feature 1..20: note = CRISPR gRNA sequence
  source 1..20: mol_type = other DNA
agcgagcgaaggcagggcct

SEQ ID NO: 12923 - DNA, 20 bp, synthetic construct
  misc_feature 1..20: note = CRISPR gRNA sequence
  source 1..20: mol_type = other DNA
agcgaaggcagggcctcggc

SEQ ID NO: 12924 - DNA, 20 bp, synthetic construct
  misc_feature 1..20: note = CRISPR gRNA sequence
  source 1..20: mol_type = other DNA
gcagggcctcggcgagtttg

SEQ ID NO: 12925 - DNA, 20 bp, synthetic construct
  misc_feature 1..20: note = CRISPR gRNA sequence
  source 1..20: mol_type = other DNA
cagggcctcggcgagtttgt

SEQ ID NO: 12926 - DNA, 20 bp, synthetic construct
  misc_feature 1..20: note = CRISPR gRNA sequence
  source 1..20: mol_type = other DNA
tcggcgagtttgtaggcacc

SEQ ID NO: 12927 - DNA, 20 bp, synthetic construct
  misc_feature 1..20: note = CRISPR gRNA sequence
  source 1..20: mol_type = other DNA
cggcgagtttgtaggcaccc

SEQ ID NO: 12928 - DNA, 20 bp, synthetic construct
  misc_feature 1..20: note = CRISPR gRNA sequence
  source 1..20: mol_type = other DNA
gagtttgtaggcacccaggt

SEQ ID NO: 12929 - DNA, 20 bp, synthetic construct
  misc_feature 1..20: note = CRISPR gRNA sequence
  source 1..20: mol_type = other DNA
ccaggtcagtgatgttgttc

SEQ ID NO: 12930 - DNA, 20 bp, synthetic construct
  misc_feature 1..20: note = CRISPR gRNA sequence
  source 1..20: mol_type = other DNA
caggtcagtgatgttgttct

SEQ ID NO: 12931 - DNA, 20 bp, synthetic construct
  misc_feature 1..20: note = CRISPR gRNA sequence
  source 1..20: mol_type = other DNA
tcagtgatgttgttctggga

SEQ ID NO: 12932 - DNA, 20 bp, synthetic construct
  misc_feature 1..20: note = CRISPR gRNA sequence
  source 1..20: mol_type = other DNA
tgttgttctgggacagactg

SEQ ID NO: 12933 - DNA, 20 bp, synthetic construct
  misc_feature 1..20: note = CRISPR gRNA sequence
  source 1..20: mol_type = other DNA
gttgttctgggacagactgc

SEQ ID NO: 12934 - DNA, 20 bp, synthetic construct
  misc_feature 1..20: note = CRISPR gRNA sequence
  source 1..20: mol_type = other DNA
ttgttctgggacagactgcg

SEQ ID NO: 12935 - DNA, 20 bp, synthetic construct
  misc_feature 1..20: note = CRISPR gRNA sequence
  source 1..20: mol_type = other DNA
tgggacagactgcggggaca

SEQ ID NO: 12936 - DNA, 20 bp, synthetic construct
  misc_feature 1..20: note = CRISPR gRNA sequence
  source 1..20: mol_type = other DNA
acagactgcggggacacagt

SEQ ID NO: 12937 - DNA, 20 bp, synthetic construct
  misc_feature 1..20: note = CRISPR gRNA sequence
  source 1..20: mol_type = other DNA
cagactgcggggacacagtg

SEQ ID NO: 12938 - DNA, 20 bp, synthetic construct
  misc_feature 1..20: note = CRISPR gRNA sequence
  source 1..20: mol_type = other DNA
agactgcggggacacagtga

SEQ ID NO: 12939 - DNA, 20 bp, synthetic construct
  misc_feature 1..20: note = CRISPR gRNA sequence
  source 1..20: mol_type = other DNA
gactgcggggacacagtgag

SEQ ID NO: 12940 - DNA, 20 bp, synthetic construct
  misc_feature 1..20: note = CRISPR gRNA sequence
  source 1..20: mol_type = other DNA
actgcggggacacagtgagg

SEQ ID NO: 12941 - DNA, 20 bp, synthetic construct
  misc_feature 1..20: note = CRISPR gRNA sequence
  source 1..20: mol_type = other DNA
tgcggggacacagtgagggg

SEQ ID NO: 12942 - DNA, 20 bp, synthetic construct
  misc_feature 1..20: note = CRISPR gRNA sequence
  source 1..20: mol_type = other DNA
gcggggacacagtgaggggg

SEQ ID NO: 12943 - DNA, 20 bp, synthetic construct
  misc_feature 1..20: note = CRISPR gRNA sequence
  source 1..20: mol_type = other DNA
cggggacacagtgaggggga

SEQ ID NO: 12944 - DNA, 20 bp, synthetic construct
  misc_feature 1..20: note = CRISPR gRNA sequence
  source 1..20: mol_type = other DNA
acacagtgagggggagggct

SEQ ID NO: 12945 - DNA, 20 bp, synthetic construct
  misc_feature 1..20: note = CRISPR gRNA sequence
  source 1..20: mol_type = other DNA
cacagtgagggggagggctc

SEQ ID NO: 12946 - DNA, 20 bp, synthetic construct
  misc_feature 1..20: note = CRISPR gRNA sequence
  source 1..20: mol_type = other DNA
gcatgcctcactttgacctc

SEQ ID NO: 12947 - DNA, 20 bp, synthetic construct
  misc_feature 1..20: note = CRISPR gRNA sequence
  source 1..20: mol_type = other DNA
catgcctcactttgacctca

SEQ ID NO: 12948 - DNA, 20 bp, synthetic construct
  misc_feature 1..20: note = CRISPR gRNA sequence
  source 1..20: mol_type = other DNA
tgcctcactttgacctcaag

SEQ ID NO: 12949 - DNA, 20 bp, synthetic construct
  misc_feature 1..20: note = CRISPR gRNA sequence
  source 1..20: mol_type = other DNA
cctcactttgacctcaagga

SEQ ID NO: 12950 - DNA, 20 bp, synthetic construct
  misc_feature 1..20: note = CRISPR gRNA sequence
  source 1..20: mol_type = other DNA
tttgacctcaaggagagttc

SEQ ID NO: 12951 - DNA, 20 bp, synthetic construct
  misc_feature 1..20: note = CRISPR gRNA sequence
  source 1..20: mol_type = other DNA
ttgacctcaaggagagttct

SEQ ID NO: 12952 - DNA, 20 bp, synthetic construct
  misc_feature 1..20: note = CRISPR gRNA sequence
  source 1..20: mol_type = other DNA
tcaaggagagttctgggtca

SEQ ID NO: 12953 - DNA, 20 bp, synthetic construct
  misc_feature 1..20: note = CRISPR gRNA sequence
  source 1..20: mol_type = other DNA
caaggagagttctgggtcat

SEQ ID NO: 12954 - DNA, 20 bp, synthetic construct
  misc_feature 1..20: note = CRISPR gRNA sequence
  source 1..20: mol_type = other DNA
tctgggtcataggctgtgaa

SEQ ID NO: 12955 - DNA, 20 bp, synthetic construct
  misc_feature 1..20: note = CRISPR gRNA sequence
  source 1..20: mol_type = other DNA
gctgtgaatggcgctgtcga

SEQ ID NO: 12956 - DNA, 20 bp, synthetic construct
  misc_feature 1..20: note = CRISPR gRNA sequence
  source 1..20: mol_type = other DNA
atggcgctgtcgacagactt

SEQ ID NO: 12957 - DNA, 20 bp, synthetic construct
  misc_feature 1..20: note = CRISPR gRNA sequence
  source 1..20: mol_type = other DNA
gacagacttaagctacctct

SEQ ID NO: 12958 - DNA, 20 bp, synthetic construct
  misc_feature 1..20: note = CRISPR gRNA sequence
  source 1..20: mol_type = other DNA
ttaagctacctctcggtaaa

SEQ ID NO: 12959 - DNA, 20 bp, synthetic construct
  misc_feature 1..20: note = CRISPR gRNA sequence
  source 1..20: mol_type = other DNA
taagctacctctcggtaaat

SEQ ID NO: 12960 - DNA, 20 bp, synthetic construct
  misc_feature 1..20: note = CRISPR gRNA sequence
  source 1..20: mol_type = other DNA
agctacctctcggtaaatag

SEQ ID NO: 12961 - DNA, 20 bp, synthetic construct
  misc_feature 1..20: note = CRISPR gRNA sequence
  source 1..20: mol_type = other DNA
gctacctctcggtaaatagg

SEQ ID NO: 12962 - DNA, 20 bp, synthetic construct
  misc_feature 1..20: note = CRISPR gRNA sequence
  source 1..20: mol_type = other DNA
ggtaaataggaggatactgt

SEQ ID NO: 12963 - DNA, 20 bp, synthetic construct
  misc_feature 1..20: note = CRISPR gRNA sequence
  source 1..20: mol_type = other DNA
gtaaataggaggatactgtt

SEQ ID NO: 12964 - DNA, 20 bp, synthetic construct
  misc_feature 1..20: note = CRISPR gRNA sequence
  source 1..20: mol_type = other DNA
gaggatactgttaggtcctg

SEQ ID NO: 12965 - DNA, 20 bp, synthetic construct
  misc_feature 1..20: note = CRISPR gRNA sequence
  source 1..20: mol_type = other DNA
tactgttaggtcctgtggcc

SEQ ID NO: 12966 - DNA, 20 bp, synthetic construct
  misc_feature 1..20: note = CRISPR gRNA sequence
  source 1..20: mol_type = other DNA
tgttaggtcctgtggccaag

SEQ ID NO: 12967 - DNA, 20 bp, synthetic construct
  misc_feature 1..20: note = CRISPR gRNA sequence
  source 1..20: mol_type = other DNA
gttaggtcctgtggccaagt

SEQ ID NO: 12968 - DNA, 20 bp, synthetic construct
  misc_feature 1..20: note = CRISPR gRNA sequence
  source 1..20: mol_type = other DNA
taggtcctgtggccaagtgg

SEQ ID NO: 12969 - DNA, 20 bp, synthetic construct
  misc_feature 1..20: note = CRISPR gRNA sequence
  source 1..20: mol_type = other DNA
aggtcctgtggccaagtggg

SEQ ID NO: 12970 - DNA, 20 bp, synthetic construct
  misc_feature 1..20: note = CRISPR gRNA sequence
  source 1..20: mol_type = other DNA
ggtcctgtggccaagtggga

SEQ ID NO: 12971 - DNA, 20 bp, synthetic construct
  misc_feature 1..20: note = CRISPR gRNA sequence
  source 1..20: mol_type = other DNA
cctgtggccaagtgggaggg

SEQ ID NO: 12972 - DNA, 20 bp, synthetic construct
  misc_feature 1..20: note = CRISPR gRNA sequence
  source 1..20: mol_type = other DNA
ctgtggccaagtgggagggc

SEQ ID NO: 12973 - DNA, 20 bp, synthetic construct
  misc_feature 1..20: note = CRISPR gRNA sequence
  source 1..20: mol_type = other DNA
tgtggccaagtgggagggca

SEQ ID NO: 12974 - DNA, 20 bp, synthetic construct
  misc_feature 1..20: note = CRISPR gRNA sequence
  source 1..20: mol_type = other DNA
ccaagtgggagggcagggat

SEQ ID NO: 12975 - DNA, 20 bp, synthetic construct
  misc_feature 1..20: note = CRISPR gRNA sequence
  source 1..20: mol_type = other DNA
caagtgggagggcagggatg

SEQ ID NO: 12976 - DNA, 20 bp, synthetic construct
  misc_feature 1..20: note = CRISPR gRNA sequence
  source 1..20: mol_type = other DNA
agtgggagggcagggatgag

SEQ ID NO: 12977 - DNA, 20 bp, synthetic construct
  misc_feature 1..20: note = CRISPR gRNA sequence
  source 1..20: mol_type = other DNA
gtgggagggcagggatgagg

SEQ ID NO: 12978 - DNA, 20 bp, synthetic construct
  misc_feature 1..20: note = CRISPR gRNA sequence
  source 1..20: mol_type = other DNA
ggagggcagggatgaggagg

SEQ ID NO: 12979 - DNA, 20 bp, synthetic construct
  misc_feature 1..20: note = CRISPR gRNA sequence
  source 1..20: mol_type = other DNA
ggcagggatgaggaggtgga

SEQ ID NO: 12980 - DNA, 20 bp, synthetic construct
  misc_feature 1..20: note = CRISPR gRNA sequence
  source 1..20: mol_type = other DNA
gcagggatgaggaggtggat

SEQ ID NO: 12981 - DNA, 20 bp, synthetic construct
  misc_feature 1..20: note = CRISPR gRNA sequence
  source 1..20: mol_type = other DNA
agggatgaggaggtggatgg

SEQ ID NO: 12982 - DNA, 20 bp, synthetic construct
  misc_feature 1..20: note = CRISPR gRNA sequence
  source 1..20: mol_type = other DNA
gggatgaggaggtggatggg

SEQ ID NO: 12983 - DNA, 20 bp, synthetic construct
  misc_feature 1..20: note = CRISPR gRNA sequence
  source 1..20: mol_type = other DNA
ggatgaggaggtggatggga

SEQ ID NO: 12984 - DNA, 20 bp, synthetic construct
  misc_feature 1..20: note = CRISPR gRNA sequence
  source 1..20: mol_type = other DNA
atgaggaggtggatgggagg

SEQ ID NO: 12985 - DNA, 20 bp, synthetic construct
  misc_feature 1..20: note = CRISPR gRNA sequence
  source 1..20: mol_type = other DNA
gaggaggtggatgggaggga

SEQ ID NO: 12986 - DNA, 20 bp, synthetic construct
  misc_feature 1..20: note = CRISPR gRNA sequence
  source 1..20: mol_type = other DNA
tttccctctgcgccactttt

SEQ ID NO: 12987 - DNA, 20 bp, synthetic construct
  misc_feature 1..20: note = CRISPR gRNA sequence
  source 1..20: mol_type = other DNA
tttcagcactataatgaaat

SEQ ID NO: 12988 - DNA, 20 bp, synthetic construct
  misc_feature 1..20: note = CRISPR gRNA sequence
  source 1..20: mol_type = other DNA
cactataatgaaataagtgt

SEQ ID NO: 12989 - DNA, 20 bp, synthetic construct
  misc_feature 1..20: note = CRISPR gRNA sequence
  source 1..20: mol_type = other DNA
tgttggcattatttgtttaa

SEQ ID NO: 12990 - DNA, 20 bp, synthetic construct
  misc_feature 1..20: note = CRISPR gRNA sequence
  source 1..20: mol_type = other DNA
ggctgtgtaatcctttctgc

SEQ ID NO: 12991 - DNA, 20 bp, synthetic construct
  misc_feature 1..20: note = CRISPR gRNA sequence
  source 1..20: mol_type = other DNA
gctgtgtaatcctttctgcc

SEQ ID NO: 12992 - DNA, 20 bp, synthetic construct
  misc_feature 1..20: note = CRISPR gRNA sequence
  source 1..20: mol_type = other DNA
taatcctttctgccgggttg

SEQ ID NO: 12993 - DNA, 20 bp, synthetic construct
  misc_feature 1..20: note = CRISPR gRNA sequence
  source 1..20: mol_type = other DNA
aatcctttctgccgggttgt

SEQ ID NO: 12994 - DNA, 20 bp, synthetic construct
  misc_feature 1..20: note = CRISPR gRNA sequence
  source 1..20: mol_type = other DNA
gccgggttgtgggcttcaca

SEQ ID NO: 12995 - DNA, 20 bp, synthetic construct
  misc_feature 1..20: note = CRISPR gRNA sequence
  source 1..20: mol_type = other DNA
cgggttgtgggcttcacatg

SEQ ID NO: 12996 - DNA, 20 bp, synthetic construct
  misc_feature 1..20: note = CRISPR gRNA sequence
  source 1..20: mol_type = other DNA
gttgtgggcttcacatggag

SEQ ID NO: 12997 - DNA, 20 bp, synthetic construct
  misc_feature 1..20: note = CRISPR gRNA sequence
  source 1..20: mol_type = other DNA
ttgtgggcttcacatggagc

SEQ ID NO: 12998 - DNA, 20 bp, synthetic construct
  misc_feature 1..20: note = CRISPR gRNA sequence
  source 1..20: mol_type = other DNA
tgtgggcttcacatggagca

SEQ ID NO: 12999 - DNA, 20 bp, synthetic construct
  misc_feature 1..20: note = CRISPR gRNA sequence
  source 1..20: mol_type = other DNA
cattactgtatccctgtgcc

SEQ ID NO: 13000 - DNA, 20 bp, synthetic construct
  misc_feature 1..20: note = CRISPR gRNA sequence
  source 1..20: mol_type = other DNA
ttactgtatccctgtgccta

SEQ ID NO: 13001 - DNA, 20 bp, synthetic construct
  misc_feature 1..20: note = CRISPR gRNA sequence
  source 1..20: mol_type = other DNA
ccctgtgcctagagcactgc

SEQ ID NO: 13002 - DNA, 20 bp, synthetic construct
  misc_feature 1..20: note = CRISPR gRNA sequence
  source 1..20: mol_type = other DNA
cctgtgcctagagcactgcc

SEQ ID NO: 13003 - DNA, 20 bp, synthetic construct
  misc_feature 1..20: note = CRISPR gRNA sequence
  source 1..20: mol_type = other DNA
ctagagcactgccaggcaca

SEQ ID NO: 13004 - DNA, 20 bp, synthetic construct
  misc_feature 1..20: note = CRISPR gRNA sequence
  source 1..20: mol_type = other DNA
gagcactgccaggcacatag

SEQ ID NO: 13005 - DNA, 20 bp, synthetic construct
  misc_feature 1..20: note = CRISPR gRNA sequence
  source 1..20: mol_type = other DNA
agcactgccaggcacatagt

SEQ ID NO: 13006 - DNA, 20 bp, synthetic construct
  misc_feature 1..20: note = CRISPR gRNA sequence
  source 1..20: mol_type = other DNA
taggtgctcaataaatactt

SEQ ID NO: 13007 - DNA, 20 bp, synthetic construct
  misc_feature 1..20: note = CRISPR gRNA sequence
  source 1..20: mol_type = other DNA
gtgctcaataaatacttaag

SEQ ID NO: 13008 - DNA, 20 bp, synthetic construct
  misc_feature 1..20: note = CRISPR gRNA sequence
  source 1..20: mol_type = other DNA
tgctcaataaatacttaagt

SEQ ID NO: 13009 - DNA, 20 bp, synthetic construct
  misc_feature 1..20: note = CRISPR gRNA sequence
  source 1..20: mol_type = other DNA
gctcaataaatacttaagtg

SEQ ID NO: 13010 - DNA, 20 bp, synthetic construct
  misc_feature 1..20: note = CRISPR gRNA sequence
  source 1..20: mol_type = other DNA
caataaatacttaagtgggg

SEQ ID NO: 13011 - DNA, 20 bp, synthetic construct
  misc_feature 1..20: note = CRISPR gRNA sequence
  source 1..20: mol_type = other DNA
taaatacttaagtggggtgg

SEQ ID NO: 13012 - DNA, 20 bp, synthetic construct
  misc_feature 1..20: note = CRISPR gRNA sequence
  source 1..20: mol_type = other DNA
aaatacttaagtggggtggc

SEQ ID NO: 13013 - DNA, 20 bp, synthetic construct
  misc_feature 1..20: note = CRISPR gRNA sequence
  source 1..20: mol_type = other DNA
acttaagtggggtggcgggt

SEQ ID NO: 13014 - DNA, 20 bp, synthetic construct
  misc_feature 1..20: note = CRISPR gRNA sequence
  source 1..20: mol_type = other DNA
aagtggggtggcgggtaaga

SEQ ID NO: 13015 - DNA, 20 bp, synthetic construct
  misc_feature 1..20: note = CRISPR gRNA sequence
  source 1..20: mol_type = other DNA
gtggggtggcgggtaagaaa

SEQ ID NO: 13016 - DNA, 20 bp, synthetic construct
  misc_feature 1..20: note = CRISPR gRNA sequence
  source 1..20: mol_type = other DNA
tggggtggcgggtaagaaag

SEQ ID NO: 13017 - DNA, 20 bp, synthetic construct
  misc_feature 1..20: note = CRISPR gRNA sequence
  source 1..20: mol_type = other DNA
ggggtggcgggtaagaaaga

SEQ ID NO: 13018 - DNA, 20 bp, synthetic construct
  misc_feature 1..20: note = CRISPR gRNA sequence
  source 1..20: mol_type = other DNA
gggtggcgggtaagaaagag

SEQ ID NO: 13019 - DNA, 20 bp, synthetic construct
  misc_feature 1..20: note = CRISPR gRNA sequence
  source 1..20: mol_type = other DNA
ggtggcgggtaagaaagagg

SEQ ID NO: 13020 - DNA, 20 bp, synthetic construct
  misc_feature 1..20: note = CRISPR gRNA sequence
  source 1..20: mol_type = other DNA
gcgggtaagaaagaggggga

SEQ ID NO: 13021 - DNA, 20 bp, synthetic construct
  misc_feature 1..20: note = CRISPR gRNA sequence
  source 1..20: mol_type = other DNA
ggtaagaaagagggggacgg

SEQ ID NO: 13022 - DNA, 20 bp, synthetic construct
  misc_feature 1..20: note = CRISPR gRNA sequence
  source 1..20: mol_type = other DNA
gtaagaaagagggggacgga

SEQ ID NO: 13023 - DNA, 20 bp, synthetic construct
  misc_feature 1..20: note = CRISPR gRNA sequence
  source 1..20: mol_type = other DNA
aagagggggacggaaggact

SEQ ID NO: 13024 - DNA, 20 bp, synthetic construct
  misc_feature 1..20: note = CRISPR gRNA sequence
  source 1..20: mol_type = other DNA
agagggggacggaaggacta

SEQ ID NO: 13025 - DNA, 20 bp, synthetic construct
  misc_feature 1..20: note = CRISPR gRNA sequence
  source 1..20: mol_type = other DNA
agggggacggaaggactaag

SEQ ID NO: 13026 - DNA, 20 bp, synthetic construct
  misc_feature 1..20: note = CRISPR gRNA sequence
  source 1..20: mol_type = other DNA
gggacggaaggactaaggag

SEQ ID NO: 13027 - DNA, 20 bp, synthetic construct
  misc_feature 1..20: note = CRISPR gRNA sequence
  source 1..20: mol_type = other DNA
aggactaaggagaagaaatc

SEQ ID NO: 13028 - DNA, 20 bp, synthetic construct
  misc_feature 1..20: note = CRISPR gRNA sequence
  source 1..20: mol_type = other DNA
aggagaagaaatctagctta

SEQ ID NO: 13029 - DNA, 20 bp, synthetic construct
  misc_feature 1..20: note = CRISPR gRNA sequence
  source 1..20: mol_type = other DNA
atctagcttacagtgttacc

SEQ ID NO: 13030 - DNA, 20 bp, synthetic construct
  misc_feature 1..20: note = CRISPR gRNA sequence
  source 1..20: mol_type = other DNA
tctagcttacagtgttacct

SEQ ID NO: 13031 - DNA, 20 bp, synthetic construct
  misc_feature 1..20: note = CRISPR gRNA sequence
  source 1..20: mol_type = other DNA
tacagtgttacctaggacac

SEQ ID NO: 13032 - DNA, 20 bp, synthetic construct
  misc_feature 1..20: note = CRISPR gRNA sequence
  source 1..20: mol_type = other DNA
cctaggacactagaaattac

SEQ ID NO: 13033 - DNA, 20 bp, synthetic construct
  misc_feature 1..20: note = CRISPR gRNA sequence
  source 1..20: mol_type = other DNA
taggacactagaaattactg

SEQ ID NO: 13034 - DNA, 20 bp, synthetic construct
  misc_feature 1..20: note = CRISPR gRNA sequence
  source 1..20: mol_type = other DNA
gacactagaaattactggag

SEQ ID NO: 13035 - DNA, 20 bp, synthetic construct
  misc_feature 1..20: note = CRISPR gRNA sequence
  source 1..20: mol_type = other DNA
aaattactggagaagtccca

SEQ ID NO: 13036 - DNA, 20 bp, synthetic construct
  misc_feature 1..20: note = CRISPR gRNA sequence
  source 1..20: mol_type = other DNA
agtcccacagtcctacaatt

SEQ ID NO: 13037 - DNA, 20 bp, synthetic construct
  misc_feature 1..20: note = CRISPR gRNA sequence
  source 1..20: mol_type = other DNA
gtcccacagtcctacaatta

SEQ ID NO: 13038 - DNA, 20 bp, synthetic construct
  misc_feature 1..20: note = CRISPR gRNA sequence
  source 1..20: mol_type = other DNA
ctacaattaaggaaattgct

SEQ ID NO: 13039 - DNA, 20 bp, synthetic construct
  misc_feature 1..20: note = CRISPR gRNA sequence
  source 1..20: mol_type = other DNA
ggaaattgctaagtaaattc

SEQ ID NO: 13040 - DNA, 20 bp, synthetic construct
  misc_feature 1..20: note = CRISPR gRNA sequence
  source 1..20: mol_type = other DNA
gtaaattccggtaaattatt

SEQ ID NO: 13041 - DNA, 20 bp, synthetic construct
  misc_feature 1..20: note = CRISPR gRNA sequence
  source 1..20: mol_type = other DNA
gtaaattatttggccatcct

SEQ ID NO: 13042 - DNA, 20 bp, synthetic construct
  misc_feature 1..20: note = CRISPR gRNA sequence
  source 1..20: mol_type = other DNA
atttggccatcctaagacct

SEQ ID NO: 13043 - DNA, 20 bp, synthetic construct
  misc_feature 1..20: note = CRISPR gRNA sequence
  source 1..20: mol_type = other DNA
catcctaagaccttggttgt

SEQ ID NO: 13044 - DNA, 20 bp, synthetic construct
  misc_feature 1..20: note = CRISPR gRNA sequence
  source 1..20: mol_type = other DNA
atcctaagaccttggttgtg

SEQ ID NO: 13045 - DNA, 20 bp, synthetic construct
  misc_feature 1..20: note = CRISPR gRNA sequence
  source 1..20: mol_type = other DNA
tcctaagaccttggttgtga

SEQ ID NO: 13046 - DNA, 20 bp, synthetic construct
  misc_feature 1..20: note = CRISPR gRNA sequence
  source 1..20: mol_type = other DNA
cctaagaccttggttgtgag

SEQ ID NO: 13047 - DNA, 20 bp, synthetic construct
  misc_feature 1..20: note = CRISPR gRNA sequence
  source 1..20: mol_type = other DNA
ctaagaccttggttgtgagg

SEQ ID NO: 13048 - DNA, 20 bp, synthetic construct
  misc_feature 1..20: note = CRISPR gRNA sequence
  source 1..20: mol_type = other DNA
aagaccttggttgtgagggg

SEQ ID NO: 13049 - DNA, 20 bp, synthetic construct
  misc_feature 1..20: note = CRISPR gRNA sequence
  source 1..20: mol_type = other DNA
cttggttgtgagggggagtg

SEQ ID NO: 13050 - DNA, 20 bp, synthetic construct
  misc_feature 1..20: note = CRISPR gRNA sequence
  source 1..20: mol_type = other DNA
ttggttgtgagggggagtgt

SEQ ID NO: 13051 - DNA, 20 bp, synthetic construct
  misc_feature 1..20: note = CRISPR gRNA sequence
  source 1..20: mol_type = other DNA
gttgtgagggggagtgtggg

SEQ ID NO: 13052 - DNA, 20 bp, synthetic construct
  misc_feature 1..20: note = CRISPR gRNA sequence
  source 1..20: mol_type = other DNA
gggaagattttgatatcctc

SEQ ID NO: 13053 - DNA, 20 bp, synthetic construct
  misc_feature 1..20: note = CRISPR gRNA sequence
  source 1..20: mol_type = other DNA
ggaagattttgatatcctct

SEQ ID NO: 13054 - DNA, 20 bp, synthetic construct
  misc_feature 1..20: note = CRISPR gRNA sequence
  source 1..20: mol_type = other DNA
attttgatatcctctaggtt

SEQ ID NO: 13055 - DNA, 20 bp, synthetic construct
  misc_feature 1..20: note = CRISPR gRNA sequence
  source 1..20: mol_type = other DNA
agtaaaaaatcatgttgaac

SEQ ID NO: 13056 - DNA, 20 bp, synthetic construct
  misc_feature 1..20: note = CRISPR gRNA sequence
  source 1..20: mol_type = other DNA
gtaaaaaatcatgttgaact

SEQ ID NO: 13057 - DNA, 20 bp, synthetic construct
  misc_feature 1..20: note = CRISPR gRNA sequence
  source 1..20: mol_type = other DNA
aaatcatgttgaactgggcg

SEQ ID NO: 13058 - DNA, 20 bp, synthetic construct
  misc_feature 1..20: note = CRISPR gRNA sequence
  source 1..20: mol_type = other DNA
tcatgttgaactgggcgtgg

SEQ ID NO: 13059 - DNA, 20 bp, synthetic construct
  misc_feature 1..20: note = CRISPR gRNA sequence
  source 1..20: mol_type = other DNA
ctgggcgtggtggctcatgc

SEQ ID NO: 13060 - DNA, 20 bp, synthetic construct
  misc_feature 1..20: note = CRISPR gRNA sequence
  source 1..20: mol_type = other DNA
gtggctcatgccggtaatcc

SEQ ID NO: 13061 - DNA, 20 bp, synthetic construct
  misc_feature 1..20: note = CRISPR gRNA sequence
  source 1..20: mol_type = other DNA
tgccggtaatcccagcactt

SEQ ID NO: 13062 - DNA, 20 bp, synthetic construct
  misc_feature 1..20: note = CRISPR gRNA sequence
  source 1..20: mol_type = other DNA
gccggtaatcccagcacttt

SEQ ID NO: 13063 - DNA, 20 bp, synthetic construct
  misc_feature 1..20: note = CRISPR gRNA sequence
  source 1..20: mol_type = other DNA
cggtaatcccagcactttgg

SEQ ID NO: 13064 - DNA, 20 bp, synthetic construct
  misc_feature 1..20: note = CRISPR gRNA sequence
  source 1..20: mol_type = other DNA
ggtaatcccagcactttggg

SEQ ID NO: 13065 - DNA, 20 bp, synthetic construct
  misc_feature 1..20: note = CRISPR gRNA sequence
  source 1..20: mol_type = other DNA
tcccagcactttgggaggct

SEQ ID NO: 13066 - DNA, 20 bp, synthetic construct
  misc_feature 1..20: note = CRISPR gRNA sequence
  source 1..20: mol_type = other DNA
cccagcactttgggaggctg

SEQ ID NO: 13067 - DNA, 20 bp, synthetic construct
  misc_feature 1..20: note = CRISPR gRNA sequence
  source 1..20: mol_type = other DNA
agcactttgggaggctgagg

SEQ ID NO: 13068 - DNA, 20 bp, synthetic construct
  misc_feature 1..20: note = CRISPR gRNA sequence
  source 1..20: mol_type = other DNA
gcactttgggaggctgaggt

SEQ ID NO: 13069 - DNA, 20 bp, synthetic construct
  misc_feature 1..20: note = CRISPR gRNA sequence
  source 1..20: mol_type = other DNA
ctttgggaggctgaggtggg

SEQ ID NO: 13070 - DNA, 20 bp, synthetic construct
  misc_feature 1..20: note = CRISPR gRNA sequence
  source 1..20: mol_type = other DNA
ctgaggtgggcggatcactt

SEQ ID NO: 13071 - DNA, 20 bp, synthetic construct
  misc_feature 1..20: note = CRISPR gRNA sequence
  source 1..20: mol_type = other DNA
tgaggtgggcggatcacttg

SEQ ID NO: 13072 - DNA, 20 bp, synthetic construct
  misc_feature 1..20: note = CRISPR gRNA sequence
  source 1..20: mol_type = other DNA
gtgggcggatcacttgaggt

SEQ ID NO: 13073 - DNA, 20 bp, synthetic construct
  misc_feature 1..20: note = CRISPR gRNA sequence
  source 1..20: mol_type = other DNA
tgggcggatcacttgaggtc

SEQ ID NO: 13074 - DNA, 20 bp, synthetic construct
  misc_feature 1..20: note = CRISPR gRNA sequence
  source 1..20: mol_type = other DNA
ggcggatcacttgaggtcag

SEQ ID NO: 13075 - DNA, 20 bp, synthetic construct
  misc_feature 1..20: note = CRISPR gRNA sequence
  source 1..20: mol_type = other DNA
tcacttgaggtcaggagttc

SEQ ID NO: 13076 - DNA, 20 bp, synthetic construct
  misc_feature 1..20: note = CRISPR gRNA sequence
  source 1..20: mol_type = other DNA
tgaggtcaggagttcaagac

SEQ ID NO: 13077 - DNA, 20 bp, synthetic construct
  misc_feature 1..20: note = CRISPR gRNA sequence
  source 1..20: mol_type = other DNA
tcaggagttcaagaccagcc

SEQ ID NO: 13078 - DNA, 20 bp, synthetic construct
  misc_feature 1..20: note = CRISPR gRNA sequence
  source 1..20: mol_type = other DNA
caagaccagcctggccaacc

SEQ ID NO: 13079 - DNA, 20 bp, synthetic construct
  misc_feature 1..20: note = CRISPR gRNA sequence
  source 1..20: mol_type = other DNA
tctactaaaaatacaaaaat

SEQ ID NO: 13080 - DNA, 20 bp, synthetic construct
  misc_feature 1..20: note = CRISPR gRNA sequence
  source 1..20: mol_type = other DNA
ctaaaaatacaaaaattagt

SEQ ID NO: 13081 - DNA, 20 bp, synthetic construct
  misc_feature 1..20: note = CRISPR gRNA sequence
  source 1..20: mol_type = other DNA
taaaaatacaaaaattagtt

SEQ ID NO: 13082 - DNA, 20 bp, synthetic construct
  misc_feature 1..20: note = CRISPR gRNA sequence
  source 1..20: mol_type = other DNA
atacaaaaattagttgggtg

SEQ ID NO: 13083 - DNA, 20 bp, synthetic construct
  misc_feature 1..20: note = CRISPR gRNA sequence
  source 1..20: mol_type = other DNA
caaaaattagttgggtgtag

SEQ ID NO: 13084 - DNA, 20 bp, synthetic construct
  misc_feature 1..20: note = CRISPR gRNA sequence
  source 1..20: mol_type = other DNA
gtggtgcatgcctgtaattc

SEQ ID NO: 13085 - DNA, 20 bp, synthetic construct
  misc_feature 1..20: note = CRISPR gRNA sequence
  source 1..20: mol_type = other DNA
tgcctgtaattccagctact

SEQ ID NO: 13086 - DNA, 20 bp, synthetic construct
  misc_feature 1..20: note = CRISPR gRNA sequence
  source 1..20: mol_type = other DNA
gcctgtaattccagctactt

SEQ ID NO: 13087 - DNA, 20 bp, synthetic construct
  misc_feature 1..20: note = CRISPR gRNA sequence
  source 1..20: mol_type = other DNA
ctgtaattccagctacttgg

SEQ ID NO: 13088 - DNA, 20 bp, synthetic construct
  misc_feature 1..20: note = CRISPR gRNA sequence
  source 1..20: mol_type = other DNA
tgtaattccagctacttggg

SEQ ID NO: 13089 - DNA, 20 bp, synthetic construct
  misc_feature 1..20: note = CRISPR gRNA sequence
  source 1..20: mol_type = other DNA
ttccagctacttgggaggct

SEQ ID NO: 13090 - DNA, 20 bp, synthetic construct
  misc_feature 1..20: note = CRISPR gRNA sequence
  source 1..20: mol_type = other DNA
tccagctacttgggaggctg

SEQ ID NO: 13091 - DNA, 20 bp, synthetic construct
  misc_feature 1..20: note = CRISPR gRNA sequence
  source 1..20: mol_type = other DNA
tacttgggaggctgaggtgt

SEQ ID NO: 13092 - DNA, 20 bp, synthetic construct
  misc_feature 1..20: note = CRISPR gRNA sequence
  source 1..20: mol_type = other DNA
gtgtgagaattgcttgaacc

SEQ ID NO: 13093 - DNA, 20 bp, synthetic construct
  misc_feature 1..20: note = CRISPR gRNA sequence
  source 1..20: mol_type = other DNA
tgtgagaattgcttgaaccc

SEQ ID NO: 13094 - DNA, 20 bp, synthetic construct
  misc_feature 1..20: note = CRISPR gRNA sequence
  source 1..20: mol_type = other DNA
tgagaattgcttgaacccag

SEQ ID NO: 13095 - DNA, 20 bp, synthetic construct
  misc_feature 1..20: note = CRISPR gRNA sequence
  source 1..20: mol_type = other DNA
gagaattgcttgaacccagg

SEQ ID NO: 13096 - DNA, 20 bp, synthetic construct
  misc_feature 1..20: note = CRISPR gRNA sequence
  source 1..20: mol_type = other DNA
ttgcttgaacccaggaggtg

SEQ ID NO: 13097 - DNA, 20 bp, synthetic construct
  misc_feature 1..20: note = CRISPR gRNA sequence
  source 1..20: mol_type = other DNA
gaggtgaagtttgcaataaa

SEQ ID NO: 13098 - DNA, 20 bp, synthetic construct
  misc_feature 1..20: note = CRISPR gRNA sequence
  source 1..20: mol_type = other DNA
tagatcgtaccactgcactc

SEQ ID NO: 13099 - DNA, 20 bp, synthetic construct
  misc_feature 1..20: note = CRISPR gRNA sequence
  source 1..20: mol_type = other DNA
cgtaccactgcactccagcc

SEQ ID NO: 13100 - DNA, 20 bp, synthetic construct
  misc_feature 1..20: note = CRISPR gRNA sequence
  source 1..20: mol_type = other DNA
gtaccactgcactccagcct

SEQ ID NO: 13101 - DNA, 20 bp, synthetic construct
  misc_feature 1..20: note = CRISPR gRNA sequence
  source 1..20: mol_type = other DNA
ctgcactccagcctgggcta

SEQ ID NO: 13102 - DNA, 20 bp, synthetic construct
  misc_feature 1..20: note = CRISPR gRNA sequence
  source 1..20: mol_type = other DNA
gcactccagcctgggctaca

SEQ ID NO: 13103 - DNA, 20 bp, synthetic construct
  misc_feature 1..20: note = CRISPR gRNA sequence
  source 1..20: mol_type = other DNA
tccagcctgggctacagagc

SEQ ID NO: 13104 - DNA, 20 bp, synthetic construct
  misc_feature 1..20: note = CRISPR gRNA sequence
  source 1..20: mol_type = other DNA
aaaaaaaaatcccattgaac

SEQ ID NO: 13105 - DNA, 20 bp, synthetic construct
  misc_feature 1..20: note = CRISPR gRNA sequence
  source 1..20: mol_type = other DNA
aaaaaaaatcccattgaacc

SEQ ID NO: 13106 - DNA, 20 bp, synthetic construct
  misc_feature 1..20: note = CRISPR gRNA sequence
  source 1..20: mol_type = other DNA
aaatcccattgaaccaggca

SEQ ID NO: 13107 - DNA, 20 bp, synthetic construct
  misc_feature 1..20: note = CRISPR gRNA sequence
  source 1..20: mol_type = other DNA
gtgactcatgcctgtaatcc

SEQ ID NO: 13108 - DNA, 20 bp, synthetic construct
  misc_feature 1..20: note = CRISPR gRNA sequence
  source 1..20: mol_type = other DNA
tgcctgtaatcccagtactt

SEQ ID NO: 13109 - DNA, 20 bp, synthetic construct
  misc_feature 1..20: note = CRISPR gRNA sequence
  source 1..20: mol_type = other DNA
gcctgtaatcccagtacttt

SEQ ID NO: 13110 - DNA, 20 bp, synthetic construct
  misc_feature 1..20: note = CRISPR gRNA sequence
  source 1..20: mol_type = other DNA
ctgtaatcccagtactttgg

SEQ ID NO: 13111 - DNA, 20 bp, synthetic construct
  misc_feature 1..20: note = CRISPR gRNA sequence
  source 1..20: mol_type = other DNA
tgtaatcccagtactttggg

SEQ ID NO: 13112 - DNA, 20 bp, synthetic construct
  misc_feature 1..20: note = CRISPR gRNA sequence
  source 1..20: mol_type = other DNA
aatcccagtactttgggagg

SEQ ID NO: 13113 - DNA, 20 bp, synthetic construct
  misc_feature 1..20: note = CRISPR gRNA sequence
  source 1..20: mol_type = other DNA
tcccagtactttgggaggca

SEQ ID NO: 13114 - DNA, 20 bp, synthetic construct
  misc_feature 1..20: note = CRISPR gRNA sequence
  source 1..20: mol_type = other DNA
cccagtactttgggaggcag

SEQ ID NO: 13115 - DNA, 20 bp, synthetic construct
  misc_feature 1..20: note = CRISPR gRNA sequence
  source 1..20: mol_type = other DNA
agtactttgggaggcagagg

SEQ ID NO: 13116 - DNA, 20 bp, synthetic construct
  misc_feature 1..20: note = CRISPR gRNA sequence
  source 1..20: mol_type = other DNA
gtactttgggaggcagaggc

SEQ ID NO: 13117 - DNA, 20 bp, synthetic construct
  misc_feature 1..20: note = CRISPR gRNA sequence
  source 1..20: mol_type = other DNA
actttgggaggcagaggcag

SEQ ID NO: 13118 - DNA, 20 bp, synthetic construct
  misc_feature 1..20: note = CRISPR gRNA sequence
  source 1..20: mol_type = other DNA
ctttgggaggcagaggcagg

SEQ ID NO: 13119 - DNA, 20 bp, synthetic construct
  misc_feature 1..20: note = CRISPR gRNA sequence
  source 1..20: mol_type = other DNA
gggaggcagaggcaggagga

SEQ ID NO: 13120 - DNA, 20 bp, synthetic construct
  misc_feature 1..20: note = CRISPR gRNA sequence
  source 1..20: mol_type = other DNA
cagaggcaggaggatggctt

SEQ ID NO: 13121 - DNA, 20 bp, synthetic construct
  misc_feature 1..20: note = CRISPR gRNA sequence
  source 1..20: mol_type = other DNA
gcaggaggatggcttgagct

SEQ ID NO: 13122 - DNA, 20 bp, synthetic construct
  misc_feature 1..20: note = CRISPR gRNA sequence
  source 1..20: mol_type = other DNA
ggaggatggcttgagctcag

SEQ ID NO: 13123 - DNA, 20 bp, synthetic construct
  misc_feature 1..20: note = CRISPR gRNA sequence
  source 1..20: mol_type = other DNA
tggcttgagctcagaagttc

SEQ ID NO: 13124 - DNA, 20 bp, synthetic construct
  misc_feature 1..20: note = CRISPR gRNA sequence
  source 1..20: mol_type = other DNA
tgagctcagaagttcaagac

SEQ ID NO: 13125 - DNA, 20 bp, synthetic construct
  misc_feature 1..20: note = CRISPR gRNA sequence
  source 1..20: mol_type = other DNA
tcagaagttcaagaccagcc

SEQ ID NO: 13126 - DNA, 20 bp, synthetic construct
  misc_feature 1..20: note = CRISPR gRNA sequence
  source 1..20: mol_type = other DNA
cagaagttcaagaccagcct

SEQ ID NO: 13127 - DNA, 20 bp, synthetic construct
  misc_feature 1..20: note = CRISPR gRNA sequence
  source 1..20: mol_type = other DNA
caagaccagcctgggcaacg

SEQ ID NO: 13128 - DNA, 20 bp, synthetic construct
  misc_feature 1..20: note = CRISPR gRNA sequence
  source 1..20: mol_type = other DNA
ctacaaaaaaatacaaaaat

SEQ ID NO: 13129 - DNA, 20 bp, synthetic construct
  misc_feature 1..20: note = CRISPR gRNA sequence
  source 1..20: mol_type = other DNA
caaaaaaatacaaaaattag

SEQ ID NO: 13130 - DNA, 20 bp, synthetic construct
  misc_feature 1..20: note = CRISPR gRNA sequence
  source 1..20: mol_type = other DNA
aaaaaaatacaaaaattagc

SEQ ID NO: 13131 - DNA, 20 bp, synthetic construct
  misc_feature 1..20: note = CRISPR gRNA sequence
  source 1..20: mol_type = other DNA
atacaaaaattagcgggacg

SEQ ID NO: 13132 - DNA, 20 bp, synthetic construct
  misc_feature 1..20: note = CRISPR gRNA sequence
  source 1..20: mol_type = other DNA
caaaaattagcgggacgtgg

SEQ ID NO: 13133 - DNA, 20 bp, synthetic construct
  misc_feature 1..20: note = CRISPR gRNA sequence
  source 1..20: mol_type = other DNA
gtggtggcatgcacctgtcc

SEQ ID NO: 13134 - DNA, 20 bp, synthetic construct
  misc_feature 1..20: note = CRISPR gRNA sequence
  source 1..20: mol_type = other DNA
atgcacctgtcccagctact

SEQ ID NO: 13135 - DNA, 20 bp, synthetic construct
  misc_feature 1..20: note = CRISPR gRNA sequence
  source 1..20: mol_type = other DNA
cacctgtcccagctactcag

SEQ ID NO: 13136 - DNA, 20 bp, synthetic construct
  misc_feature 1..20: note = CRISPR gRNA sequence
  source 1..20: mol_type = other DNA
acctgtcccagctactcaga

SEQ ID NO: 13137 - DNA, 20 bp, synthetic construct
  misc_feature 1..20: note = CRISPR gRNA sequence
  source 1..20: mol_type = other DNA
tcccagctactcagaaggtt

SEQ ID NO: 13138 - DNA, 20 bp, synthetic construct
  misc_feature 1..20: note = CRISPR gRNA sequence
  source 1..20: mol_type = other DNA
agctactcagaaggttgaga

SEQ ID NO: 13139 - DNA, 20 bp, synthetic construct
  misc_feature 1..20: note = CRISPR gRNA sequence
  source 1..20: mol_type = other DNA
gctactcagaaggttgagat

SEQ ID NO: 13140 - DNA, 20 bp, synthetic construct
  misc_feature 1..20: note = CRISPR gRNA sequence
  source 1..20: mol_type = other DNA
tactcagaaggttgagatgg

SEQ ID NO: 13141 - DNA, 20 bp, synthetic construct
  misc_feature 1..20: note = CRISPR gRNA sequence
  source 1..20: mol_type = other DNA
actcagaaggttgagatggg

SEQ ID NO: 13142 - DNA, 20 bp, synthetic construct
  misc_feature 1..20: note = CRISPR gRNA sequence
  source 1..20: mol_type = other DNA
ttgagatgggaggattgctt

SEQ ID NO: 13143 - DNA, 20 bp, synthetic construct
  misc_feature 1..20: note = CRISPR gRNA sequence
  source 1..20: mol_type = other DNA
atgggaggattgcttgagcc

SEQ ID NO: 13144 - DNA, 20 bp, synthetic construct
  misc_feature 1..20: note = CRISPR gRNA sequence
  source 1..20: mol_type = other DNA
tgggaggattgcttgagcct

SEQ ID NO: 13145 - DNA, 20 bp, synthetic construct
  misc_feature 1..20: note = CRISPR gRNA sequence
  source 1..20: mol_type = other DNA
ggaggattgcttgagcctag

SEQ ID NO: 13146 - DNA, 20 bp, synthetic construct
  misc_feature 1..20: note = CRISPR gRNA sequence
  source 1..20: mol_type = other DNA
ttgcttgagcctaggagatt

SEQ ID NO: 13147 - DNA, 20 bp, synthetic construct
  misc_feature 1..20: note = CRISPR gRNA sequence
  source 1..20: mol_type = other DNA
tgcttgagcctaggagattg

SEQ ID NO: 13148 - DNA, 20 bp, synthetic construct
  misc_feature 1..20: note = CRISPR gRNA sequence
  source 1..20: mol_type = other DNA
agcctaggagattgaggctg

SEQ ID NO: 13149 - DNA, 20 bp, synthetic construct
  misc_feature 1..20: note = CRISPR gRNA sequence
  source 1..20: mol_type = other DNA
taggagattgaggctgcagt

SEQ ID NO: 13150 - DNA, 20 bp, synthetic construct
  misc_feature 1..20: note = CRISPR gRNA sequence
  source 1..20: mol_type = other DNA
tacaccactgcactccaccc

SEQ ID NO: 13151 - DNA, 20 bp, synthetic construct
  misc_feature 1..20: note = CRISPR gRNA sequence
  source 1..20: mol_type = other DNA
acaccactgcactccaccct

SEQ ID NO: 13152 - DNA, 20 bp, synthetic construct
  misc_feature 1..20: note = CRISPR gRNA sequence
  source 1..20: mol_type = other DNA
ctgcactccaccctgggtga

SEQ ID NO: 13153 - DNA, 20 bp, synthetic construct
  misc_feature 1..20: note = CRISPR gRNA sequence
  source 1..20: mol_type = other DNA
gcactccaccctgggtgaca

SEQ ID NO: 13154 - DNA, 20 bp, synthetic construct
  misc_feature 1..20: note = CRISPR gRNA sequence
  source 1..20: mol_type = other DNA
tccaccctgggtgacagagc

SEQ ID NO: 13155 - DNA, 20 bp, synthetic construct
  misc_feature 1..20: note = CRISPR gRNA sequence
  source 1..20: mol_type = other DNA
gcgagaccttgtctgaaaaa

SEQ ID NO: 13156 - DNA, 20 bp, synthetic construct
  misc_feature 1..20: note = CRISPR gRNA sequence
  source 1..20: mol_type = other DNA
cttatccatctccaacttcc

SEQ ID NO: 13157 - DNA, 20 bp, synthetic construct
  misc_feature 1..20: note = CRISPR gRNA sequence
  source 1..20: mol_type = other DNA
tatccatctccaacttccca

SEQ ID NO: 13158 - DNA, 20 bp, synthetic construct
  misc_feature 1..20: note = CRISPR gRNA sequence
  source 1..20: mol_type = other DNA
atctccaacttcccagagcc

SEQ ID NO: 13159 - DNA, 20 bp, synthetic construct
  misc_feature 1..20: note = CRISPR gRNA sequence
  source 1..20: mol_type = other DNA
caacttcccagagcccagaa

SEQ ID NO: 13160 - DNA, 20 bp, synthetic construct
  misc_feature 1..20: note = CRISPR gRNA sequence
  source 1..20: mol_type = other DNA
agcccagaacagtttttaaa

SEQ ID NO: 13161 - DNA, 20 bp, synthetic construct
  misc_feature 1..20: note = CRISPR gRNA sequence
  source 1..20: mol_type = other DNA
atctctcctatttcaccccc

SEQ ID NO: 13162 - DNA, 20 bp, synthetic construct
  misc_feature 1..20: note = CRISPR gRNA sequence
  source 1..20: mol_type = other DNA
tgttcattgtgtctcctcac

SEQ ID NO: 13163 - DNA, 20 bp, synthetic construct
  misc_feature 1..20: note = CRISPR gRNA sequence
  source 1..20: mol_type = other DNA
gtgtctcctcactagaattt

SEQ ID NO: 13164 - DNA, 20 bp, synthetic construct
  misc_feature 1..20: note = CRISPR gRNA sequence
  source 1..20: mol_type = other DNA
cactagaatttaagattcct

SEQ ID NO: 13165 - DNA, 20 bp, synthetic construct
  misc_feature 1..20: note = CRISPR gRNA sequence
  source 1..20: mol_type = other DNA
actagaatttaagattcctg

SEQ ID NO: 13166 - DNA, 20 bp, synthetic construct
  misc_feature 1..20: note = CRISPR gRNA sequence
  source 1..20: mol_type = other DNA
gaatttaagattcctgaggt

SEQ ID NO: 13167 - DNA, 20 bp, synthetic construct
  misc_feature 1..20: note = CRISPR gRNA sequence
  source 1..20: mol_type = other DNA
aatttaagattcctgaggtc

SEQ ID NO: 13168 - DNA, 20 bp, synthetic construct
  misc_feature 1..20: note = CRISPR gRNA sequence
  source 1..20: mol_type = other DNA
atttaagattcctgaggtca

SEQ ID NO: 13169 - DNA, 20 bp, synthetic construct
  misc_feature 1..20: note = CRISPR gRNA sequence
  source 1..20: mol_type = other DNA
tttaagattcctgaggtcag

SEQ ID NO: 13170 - DNA, 20 bp, synthetic construct
  misc_feature 1..20: note = CRISPR gRNA sequence
  source 1..20: mol_type = other DNA
ggatttatttgttttgttta

SEQ ID NO: 13171 - DNA, 20 bp, synthetic construct
  misc_feature 1..20: note = CRISPR gRNA sequence
  source 1..20: mol_type = other DNA
ttatttgttttgtttaaagc

SEQ ID NO: 13172 - DNA, 20 bp, synthetic construct
  misc_feature 1..20: note = CRISPR gRNA sequence
  source 1..20: mol_type = other DNA
tatttgttttgtttaaagct

SEQ ID NO: 13173 - DNA, 20 bp, synthetic construct
  misc_feature 1..20: note = CRISPR gRNA sequence
  source 1..20: mol_type = other DNA
tttgtttaaagctgggtctc

SEQ ID NO: 13174 - DNA, 20 bp, synthetic construct
  misc_feature 1..20: note = CRISPR gRNA sequence
  source 1..20: mol_type = other DNA
ttgtttaaagctgggtctcc

SEQ ID NO: 13175 - DNA, 20 bp, synthetic construct
  misc_feature 1..20: note = CRISPR gRNA sequence
  source 1..20: mol_type = other DNA
tgtttaaagctgggtctcca

SEQ ID NO: 13176 - DNA, 20 bp, synthetic construct
  misc_feature 1..20: note = CRISPR gRNA sequence
  source 1..20: mol_type = other DNA
aaagctgggtctccagggcc

SEQ ID NO: 13177 - DNA, 20 bp, synthetic construct
  misc_feature 1..20: note = CRISPR gRNA sequence
  source 1..20: mol_type = other DNA
ctgggtctccagggcctaga

SEQ ID NO: 13178 - DNA, 20 bp, synthetic construct
  misc_feature 1..20: note = CRISPR gRNA sequence
  source 1..20: mol_type = other DNA
tgggtctccagggcctagaa

SEQ ID NO: 13179 - DNA, 20 bp, synthetic construct
  misc_feature 1..20: note = CRISPR gRNA sequence
  source 1..20: mol_type = other DNA
cctagaaaggtgcctgcaca

SEQ ID NO: 13180 - DNA, 20 bp, synthetic construct
  misc_feature 1..20: note = CRISPR gRNA sequence
  source 1..20: mol_type = other DNA
agaaaggtgcctgcacatag

SEQ ID NO: 13181 - DNA, 20 bp, synthetic construct
  misc_feature 1..20: note = CRISPR gRNA sequence
  source 1..20: mol_type = other DNA
gaaaggtgcctgcacatagt

SEQ ID NO: 13182 - DNA, 20 bp, synthetic construct
  misc_feature 1..20: note = CRISPR gRNA sequence
  source 1..20: mol_type = other DNA
ttgttgattaaattaataaa

SEQ ID NO: 13183 - DNA, 20 bp, synthetic construct
  misc_feature 1..20: note = CRISPR gRNA sequence
  source 1..20: mol_type = other DNA
tgattaaattaataaatggt

SEQ ID NO: 13184 - DNA, 20 bp, synthetic construct
  misc_feature 1..20: note = CRISPR gRNA sequence
  source 1..20: mol_type = other DNA
gattaaattaataaatggtt

SEQ ID NO: 13185 - DNA, 20 bp, synthetic construct
  misc_feature 1..20: note = CRISPR gRNA sequence
  source 1..20: mol_type = other DNA
aaattaataaatggttgggt

SEQ ID NO: 13186 - DNA, 20 bp, synthetic construct
  misc_feature 1..20: note = CRISPR gRNA sequence
  source 1..20: mol_type = other DNA
aataaatggttgggtaagta

SEQ ID NO: 13187 - DNA, 20 bp, synthetic construct
  misc_feature 1..20: note = CRISPR gRNA sequence
  source 1..20: mol_type = other DNA
gggtaagtaaagaaatgatt

SEQ ID NO: 13188 - DNA, 20 bp, synthetic construct
  misc_feature 1..20: note = CRISPR gRNA sequence
  source 1..20: mol_type = other DNA
aagtaaagaaatgattgagt

SEQ ID NO: 13189 - DNA, 20 bp, synthetic construct
  misc_feature 1..20: note = CRISPR gRNA sequence
  source 1..20: mol_type = other DNA
taaagaaatgattgagtgag

SEQ ID NO: 13190 - DNA, 20 bp, synthetic construct
  misc_feature 1..20: note = CRISPR gRNA sequence
  source 1..20: mol_type = other DNA
gaaatgattgagtgagcggt

SEQ ID NO: 13191 - DNA, 20 bp, synthetic construct
  misc_feature 1..20: note = CRISPR gRNA sequence
  source 1..20: mol_type = other DNA
gattgagtgagcggttggat

SEQ ID NO: 13192 - DNA, 20 bp, synthetic construct
  misc_feature 1..20: note = CRISPR gRNA sequence
  source 1..20: mol_type = other DNA
attgagtgagcggttggatg

SEQ ID NO: 13193 - DNA, 20 bp, synthetic construct
  misc_feature 1..20: note = CRISPR gRNA sequence
  source 1..20: mol_type = other DNA
ttgagtgagcggttggatga

SEQ ID NO: 13194 - DNA, 20 bp, synthetic construct
  misc_feature 1..20: note = CRISPR gRNA sequence
  source 1..20: mol_type = other DNA
gagtgagcggttggatgagg

SEQ ID NO: 13195 - DNA, 20 bp, synthetic construct
  misc_feature 1..20: note = CRISPR gRNA sequence
  source 1..20: mol_type = other DNA
agcggttggatgagggagta

SEQ ID NO: 13196 - DNA, 20 bp, synthetic construct
  misc_feature 1..20: note = CRISPR gRNA sequence
  source 1..20: mol_type = other DNA
gagtaaagaaatgactgcat

SEQ ID NO: 13197 - DNA, 20 bp, synthetic construct
  misc_feature 1..20: note = CRISPR gRNA sequence
  source 1..20: mol_type = other DNA
gaaatgactgcataagtgaa

SEQ ID NO: 13198 - DNA, 20 bp, synthetic construct
  misc_feature 1..20: note = CRISPR gRNA sequence
  source 1..20: mol_type = other DNA
tgaatggatgaatcattgaa

SEQ ID NO: 13199 - DNA, 20 bp, synthetic construct
  misc_feature 1..20: note = CRISPR gRNA sequence
  source 1..20: mol_type = other DNA
atggatgaatcattgaatgg

SEQ ID NO: 13200 - DNA, 20 bp, synthetic construct
  misc_feature 1..20: note = CRISPR gRNA sequence
  source 1..20: mol_type = other DNA
tggatgaatcattgaatgga

SEQ ID NO: 13201 - DNA, 20 bp, synthetic construct
  misc_feature 1..20: note = CRISPR gRNA sequence
  source 1..20: mol_type = other DNA
tcattgaatggaaggatgaa

SEQ ID NO: 13202 - DNA, 20 bp, synthetic construct
  misc_feature 1..20: note = CRISPR gRNA sequence
  source 1..20: mol_type = other DNA
aggatgaatggctgattgaa

SEQ ID NO: 13203 - DNA, 20 bp, synthetic construct
  misc_feature 1..20: note = CRISPR gRNA sequence
  source 1..20: mol_type = other DNA
ggatgaatggctgattgaat

SEQ ID NO: 13204 - DNA, 20 bp, synthetic construct
  misc_feature 1..20: note = CRISPR gRNA sequence
  source 1..20: mol_type = other DNA
ggctgattgaataggtgaat

SEQ ID NO: 13205 - DNA, 20 bp, synthetic construct
  misc_feature 1..20: note = CRISPR gRNA sequence
  source 1..20: mol_type = other DNA
tgaataggtgaatgagtgaa

SEQ ID NO: 13206 - DNA, 20 bp, synthetic construct
  misc_feature 1..20: note = CRISPR gRNA sequence
  source 1..20: mol_type = other DNA
gagtgaatggatgaatccac

SEQ ID NO: 13207 - DNA, 20 bp, synthetic construct
  misc_feature 1..20: note = CRISPR gRNA sequence
  source 1..20: mol_type = other DNA
agtgaatggatgaatccact

SEQ ID NO: 13208 - DNA, 20 bp, synthetic construct
  misc_feature 1..20: note = CRISPR gRNA sequence
  source 1..20: mol_type = other DNA
gtgaatggatgaatccactg

SEQ ID NO: 13209 - DNA, 20 bp, synthetic construct
  misc_feature 1..20: note = CRISPR gRNA sequence
  source 1..20: mol_type = other DNA
atggatgaatccactggggc

SEQ ID NO: 13210 - DNA, 20 bp, synthetic construct
  misc_feature 1..20: note = CRISPR gRNA sequence
  source 1..20: mol_type = other DNA
tggatgaatccactggggct

SEQ ID NO: 13211 - DNA, 20 bp, synthetic construct
  misc_feature 1..20: note = CRISPR gRNA sequence
  source 1..20: mol_type = other DNA
gaatccactggggctgggca

SEQ ID NO: 13212 - DNA, 20 bp, synthetic construct
  misc_feature 1..20: note = CRISPR gRNA sequence
  source 1..20: mol_type = other DNA
ccactggggctgggcatggt

SEQ ID NO: 13213 - DNA, 20 bp, synthetic construct
  misc_feature 1..20: note = CRISPR gRNA sequence
  source 1..20: mol_type = other DNA
gtaagtcacacctataatcc

SEQ ID NO: 13214 - DNA, 20 bp, synthetic construct
  misc_feature 1..20: note = CRISPR gRNA sequence
  source 1..20: mol_type = other DNA
cacctataatcccagcactt

SEQ ID NO: 13215 - DNA, 20 bp, synthetic construct
  misc_feature 1..20: note = CRISPR gRNA sequence
  source 1..20: mol_type = other DNA
acctataatcccagcacttt

SEQ ID NO: 13216 - DNA, 20 bp, synthetic construct
  misc_feature 1..20: note = CRISPR gRNA sequence
  source 1..20: mol_type = other DNA
tataatcccagcactttggg

SEQ ID NO: 13217 - DNA, 20 bp, synthetic construct
  misc_feature 1..20: note = CRISPR gRNA sequence
  source 1..20: mol_type = other DNA
aatcccagcactttgggaag

SEQ ID NO: 13218 - DNA, 20 bp, synthetic construct
  misc_feature 1..20: note = CRISPR gRNA sequence
  source 1..20: mol_type = other DNA
tcccagcactttgggaagcg

SEQ ID NO: 13219 - DNA, 20 bp, synthetic construct
  misc_feature 1..20: note = CRISPR gRNA sequence
  source 1..20: mol_type = other DNA
cccagcactttgggaagcgg

SEQ ID NO: 13220 - DNA, 20 bp, synthetic construct
  misc_feature 1..20: note = CRISPR gRNA sequence
  source 1..20: mol_type = other DNA
gcactttgggaagcggaggt

SEQ ID NO: 13221 - DNA, 20 bp, synthetic construct
  misc_feature 1..20: note = CRISPR gRNA sequence
  source 1..20: mol_type = other DNA
cactttgggaagcggaggtg

SEQ ID NO: 13222 - DNA, 20 bp, synthetic construct
  misc_feature 1..20: note = CRISPR gRNA sequence
  source 1..20: mol_type = other DNA
ctttgggaagcggaggtgag

SEQ ID NO: 13223 - DNA, 20 bp, synthetic construct
  misc_feature 1..20: note = CRISPR gRNA sequence
  source 1..20: mol_type = other DNA
cggaggtgaggagattcctt

SEQ ID NO: 13224 - DNA, 20 bp, synthetic construct
  misc_feature 1..20: note = CRISPR gRNA sequence
  source 1..20: mol_type = other DNA
ggaggtgaggagattccttg

SEQ ID NO: 13225 - DNA, 20 bp, synthetic construct
  misc_feature 1..20: note = CRISPR gRNA sequence
  source 1..20: mol_type = other DNA
gtgaggagattccttgaggc

SEQ ID NO: 13226 - DNA, 20 bp, synthetic construct
  misc_feature 1..20: note = CRISPR gRNA sequence
  source 1..20: mol_type = other DNA
tgaggagattccttgaggcc

SEQ ID NO: 13227 - DNA, 20 bp, synthetic construct
  misc_feature 1..20: note = CRISPR gRNA sequence
  source 1..20: mol_type = other DNA
aggagattccttgaggccag

SEQ ID NO: 13228 - DNA, 20 bp, synthetic construct
  misc_feature 1..20: note = CRISPR gRNA sequence
  source 1..20: mol_type = other DNA
ttccttgaggccaggagttc

SEQ ID NO: 13229 - DNA, 20 bp, synthetic construct
  misc_feature 1..20: note = CRISPR gRNA sequence
  source 1..20: mol_type = other DNA
tccttgaggccaggagttca

SEQ ID NO: 13230 - DNA, 20 bp, synthetic construct
  misc_feature 1..20: note = CRISPR gRNA sequence
  source 1..20: mol_type = other DNA
aggccaggagttcaaggctg

SEQ ID NO: 13231 - DNA, 20 bp, synthetic construct
  misc_feature 1..20: note = CRISPR gRNA sequence
  source 1..20: mol_type = other DNA
gccaggagttcaaggctgca

SEQ ID NO: 13232 - DNA, 20 bp, synthetic construct
  misc_feature 1..20: note = CRISPR gRNA sequence
  source 1..20: mol_type = other DNA
ccaggagttcaaggctgcag

SEQ ID NO: 13233 - DNA, 20 bp, synthetic construct
  misc_feature 1..20: note = CRISPR gRNA sequence
  source 1..20: mol_type = other DNA
aggctgcagaggtatgatca

SEQ ID NO: 13234 - DNA, 20 bp, synthetic construct
  misc_feature 1..20: note = CRISPR gRNA sequence
  source 1..20: mol_type = other DNA
atgatcatagcactatattc

SEQ ID NO: 13235 - DNA, 20 bp, synthetic construct
  misc_feature 1..20: note = CRISPR gRNA sequence
  source 1..20: mol_type = other DNA
catagcactatattctagcc

SEQ ID NO: 13236 - DNA, 20 bp, synthetic construct
  misc_feature 1..20: note = CRISPR gRNA sequence
  source 1..20: mol_type = other DNA
atagcactatattctagcct

SEQ ID NO: 13237 - DNA, 20 bp, synthetic construct
  misc_feature 1..20: note = CRISPR gRNA sequence
  source 1..20: mol_type = other DNA
atattctagcctgggtgaca

SEQ ID NO: 13238 - DNA, 20 bp, synthetic construct
  misc_feature 1..20: note = CRISPR gRNA sequence
  source 1..20: mol_type = other DNA
tctagcctgggtgacacagc

SEQ ID NO: 13239 - DNA, 20 bp, synthetic construct
  misc_feature 1..20: note = CRISPR gRNA sequence
  source 1..20: mol_type = other DNA
aatttaaattaattttgaaa

SEQ ID NO: 13240 - DNA, 20 bp, synthetic construct
  misc_feature 1..20: note = CRISPR gRNA sequence
  source 1..20: mol_type = other DNA
taaattaattttgaaaaagt

SEQ ID NO: 13241 - DNA, 20 bp, synthetic construct
  misc_feature 1..20: note = CRISPR gRNA sequence
  source 1..20: mol_type = other DNA
ttaattttgaaaaagtcagc

SEQ ID NO: 13242 - DNA, 20 bp, synthetic construct
  misc_feature 1..20: note = CRISPR gRNA sequence
  source 1..20: mol_type = other DNA
tgaaaaagtcagccggactt

SEQ ID NO: 13243 - DNA, 20 bp, synthetic construct
  misc_feature 1..20: note = CRISPR gRNA sequence
  source 1..20: mol_type = other DNA
gaaaaagtcagccggacttt

SEQ ID NO: 13244 - DNA, 20 bp, synthetic construct
  misc_feature 1..20: note = CRISPR gRNA sequence
  source 1..20: mol_type = other DNA
aaaaagtcagccggactttg

SEQ ID NO: 13245 - DNA, 20 bp, synthetic construct
  misc_feature 1..20: note = CRISPR gRNA sequence
  source 1..20: mol_type = other DNA
aaaagtcagccggactttgg

SEQ ID NO: 13246 - DNA, 20 bp, synthetic construct
  misc_feature 1..20: note = CRISPR gRNA sequence
  source 1..20: mol_type = other DNA
cggactttgggggcccgatt

SEQ ID NO: 13247 - DNA, 20 bp, synthetic construct
  misc_feature 1..20: note = CRISPR gRNA sequence
  source 1..20: mol_type = other DNA
actttgggggcccgattcag

SEQ ID NO: 13248 - DNA, 20 bp, synthetic construct
  misc_feature 1..20: note = CRISPR gRNA sequence
  source 1..20: mol_type = other DNA
ctttgggggcccgattcagc

SEQ ID NO: 13249 - DNA, 20 bp, synthetic construct
  misc_feature 1..20: note = CRISPR gRNA sequence
  source 1..20: mol_type = other DNA
tgggggcccgattcagcagg

SEQ ID NO: 13250 - DNA, 20 bp, synthetic construct
  misc_feature 1..20: note = CRISPR gRNA sequence
  source 1..20: mol_type = other DNA
gggggcccgattcagcagga

SEQ ID NO: 13251 - DNA, 20 bp, synthetic construct
  misc_feature 1..20: note = CRISPR gRNA sequence
  source 1..20: mol_type = other DNA
ggggcccgattcagcaggaa

SEQ ID NO: 13252 - DNA, 20 bp, synthetic construct
  misc_feature 1..20: note = CRISPR gRNA sequence
  source 1..20: mol_type = other DNA
gcccgattcagcaggaaggg

SEQ ID NO: 13253 - DNA, 20 bp, synthetic construct
  misc_feature 1..20: note = CRISPR gRNA sequence
  source 1..20: mol_type = other DNA
cccgattcagcaggaagggc

SEQ ID NO: 13254 - DNA, 20 bp, synthetic construct
  misc_feature 1..20: note = CRISPR gRNA sequence
  source 1..20: mol_type = other DNA
ttcagcaggaagggcaggcc

SEQ ID NO: 13255 - DNA, 20 bp, synthetic construct
  misc_feature 1..20: note = CRISPR gRNA sequence
  source 1..20: mol_type = other DNA
caggcccagctcactcactt

SEQ ID NO: 13256 - DNA, 20 bp, synthetic construct
  misc_feature 1..20: note = CRISPR gRNA sequence
  source 1..20: mol_type = other DNA
aggcccagctcactcacttg

SEQ ID NO: 13257 - DNA, 20 bp, synthetic construct
  misc_feature 1..20: note = CRISPR gRNA sequence
  source 1..20: mol_type = other DNA
ggcccagctcactcacttga

SEQ ID NO: 13258 - DNA, 20 bp, synthetic construct
  misc_feature 1..20: note = CRISPR gRNA sequence
  source 1..20: mol_type = other DNA
tcactcacttgagggtttcc

SEQ ID NO: 13259 - DNA, 20 bp, synthetic construct
  misc_feature 1..20: note = CRISPR gRNA sequence
  source 1..20: mol_type = other DNA
cactcacttgagggtttcca

SEQ ID NO: 13260 - DNA, 20 bp, synthetic construct
  misc_feature 1..20: note = CRISPR gRNA sequence
  source 1..20: mol_type = other DNA
ttgagggtttccaaggactt

SEQ ID NO: 13261 - DNA, 20 bp, synthetic construct
  misc_feature 1..20: note = CRISPR gRNA sequence
  source 1..20: mol_type = other DNA
gggtttccaaggacttcagc

SEQ ID NO: 13262 - DNA, 20 bp, synthetic construct
  misc_feature 1..20: note = CRISPR gRNA sequence
  source 1..20: mol_type = other DNA
ggtttccaaggacttcagct

SEQ ID NO: 13263 - DNA, 20 bp, synthetic construct
  misc_feature 1..20: note = CRISPR gRNA sequence
  source 1..20: mol_type = other DNA
gtttccaaggacttcagctg

SEQ ID NO: 13264 - DNA, 20 bp, synthetic construct
  misc_feature 1..20: note = CRISPR gRNA sequence
  source 1..20: mol_type = other DNA
tttccaaggacttcagctgg

SEQ ID NO: 13265 - DNA, 20 bp, synthetic construct
  misc_feature 1..20: note = CRISPR gRNA sequence
  source 1..20: mol_type = other DNA
ccaaggacttcagctggggg

SEQ ID NO: 13266 - DNA, 20 bp, synthetic construct
  misc_feature 1..20: note = CRISPR gRNA sequence
  source 1..20: mol_type = other DNA
caaggacttcagctggggga

SEQ ID NO: 13267 - DNA, 20 bp, synthetic construct
  misc_feature 1..20: note = CRISPR gRNA sequence
  source 1..20: mol_type = other DNA
ggacttcagctgggggaagg

SEQ ID NO: 13268 - DNA, 20 bp, synthetic construct
  misc_feature 1..20: note = CRISPR gRNA sequence
  source 1..20: mol_type = other DNA
tcagctgggggaaggtggct

SEQ ID NO: 13269 - DNA, 20 bp, synthetic construct
  misc_feature 1..20: note = CRISPR gRNA sequence
  source 1..20: mol_type = other DNA
agctgggggaaggtggctga

SEQ ID NO: 13270 - DNA, 20 bp, synthetic construct
  misc_feature 1..20: note = CRISPR gRNA sequence
  source 1..20: mol_type = other DNA
ggaaggtggctgagagctgc

SEQ ID NO: 13271 - DNA, 20 bp, synthetic construct
  misc_feature 1..20: note = CRISPR gRNA sequence
  source 1..20: mol_type = other DNA
tccccgatcttgttctcact

SEQ ID NO: 13272 - DNA, 20 bp, synthetic construct
  misc_feature 1..20: note = CRISPR gRNA sequence
  source 1..20: mol_type = other DNA
ttgttctcactcagcgcatc

SEQ ID NO: 13273 - DNA, 20 bp, synthetic construct
  misc_feature 1..20: note = CRISPR gRNA sequence
  source 1..20: mol_type = other DNA
tgttctcactcagcgcatcc

SEQ ID NO: 13274 - DNA, 20 bp, synthetic construct
  misc_feature 1..20: note = CRISPR gRNA sequence
  source 1..20: mol_type = other DNA
cactcagcgcatccaggctg

SEQ ID NO: 13275 - DNA, 20 bp, synthetic construct
  misc_feature 1..20: note = CRISPR gRNA sequence
  source 1..20: mol_type = other DNA
actcagcgcatccaggctgc

SEQ ID NO: 13276 - DNA, 20 bp, synthetic construct
  misc_feature 1..20: note = CRISPR gRNA sequence
  source 1..20: mol_type = other DNA
cagcgcatccaggctgcagg

SEQ ID NO: 13277 - DNA, 20 bp, synthetic construct
  misc_feature 1..20: note = CRISPR gRNA sequence
  source 1..20: mol_type = other DNA
atccaggctgcaggtggaat

SEQ ID NO: 13278 - DNA, 20 bp, synthetic construct
  misc_feature 1..20: note = CRISPR gRNA sequence
  source 1..20: mol_type = other DNA
aggctgcaggtggaatcaga

SEQ ID NO: 13279 - DNA, 20 bp, synthetic construct
  misc_feature 1..20: note = CRISPR gRNA sequence
  source 1..20: mol_type = other DNA
ggctgcaggtggaatcagat

SEQ ID NO: 13280 - DNA, 20 bp, synthetic construct
  misc_feature 1..20: note = CRISPR gRNA sequence
  source 1..20: mol_type = other DNA
gctgcaggtggaatcagatg

SEQ ID NO: 13281 - DNA, 20 bp, synthetic construct
  misc_feature 1..20: note = CRISPR gRNA sequence
  source 1..20: mol_type = other DNA
ctgcaggtggaatcagatgg

SEQ ID NO: 13282 - DNA, 20 bp, synthetic construct
  misc_feature 1..20: note = CRISPR gRNA sequence
  source 1..20: mol_type = other DNA
tggaatcagatgggggccat

SEQ ID NO: 13283 - DNA, 20 bp, synthetic construct
  misc_feature 1..20: note = CRISPR gRNA sequence
  source 1..20: mol_type = other DNA
atcagatgggggccatcagc

SEQ ID NO: 13284 - DNA, 20 bp, synthetic construct
  misc_feature 1..20: note = CRISPR gRNA sequence
  source 1..20: mol_type = other DNA
ggggccatcagctagcgtcc

SEQ ID NO: 13285 - DNA, 20 bp, synthetic construct
  misc_feature 1..20: note = CRISPR gRNA sequence
  source 1..20: mol_type = other DNA
gggccatcagctagcgtcct

SEQ ID NO: 13286 - DNA, 20 bp, synthetic construct
  misc_feature 1..20: note = CRISPR gRNA sequence
  source 1..20: mol_type = other DNA
ggccatcagctagcgtcctg

SEQ ID NO: 13287 - DNA, 20 bp, synthetic construct
  misc_feature 1..20: note = CRISPR gRNA sequence
  source 1..20: mol_type = other DNA
ccatctgacccttcccatcc

SEQ ID NO: 13288 - DNA, 20 bp, synthetic construct
  misc_feature 1..20: note = CRISPR gRNA sequence
  source 1..20: mol_type = other DNA
ctgacccttcccatcccagt

SEQ ID NO: 13289 - DNA, 20 bp, synthetic construct
  misc_feature 1..20: note = CRISPR gRNA sequence
  source 1..20: mol_type = other DNA
tgacccttcccatcccagtg

SEQ ID NO: 13290 - DNA, 20 bp, synthetic construct
  misc_feature 1..20: note = CRISPR gRNA sequence
  source 1..20: mol_type = other DNA
gacccttcccatcccagtga

SEQ ID NO: 13291 - DNA, 20 bp, synthetic construct
  misc_feature 1..20: note = CRISPR gRNA sequence
  source 1..20: mol_type = other DNA
catcccagtgagggcctcct

SEQ ID NO: 13292 - DNA, 20 bp, synthetic construct
  misc_feature 1..20: note = CRISPR gRNA sequence
  source 1..20: mol_type = other DNA
agtgagggcctcctcagccc

SEQ ID NO: 13293 - DNA, 20 bp, synthetic construct
  misc_feature 1..20: note = CRISPR gRNA sequence
  source 1..20: mol_type = other DNA
cacctgcccttcccaccccc

SEQ ID NO: 13294 - DNA, 20 bp, synthetic construct
  misc_feature 1..20: note = CRISPR gRNA sequence
  source 1..20: mol_type = other DNA
cccccagctctaatacacca

SEQ ID NO: 13295 - DNA, 20 bp, synthetic construct
  misc_feature 1..20: note = CRISPR gRNA sequence
  source 1..20: mol_type = other DNA
ccccagctctaatacaccat

SEQ ID NO: 13296 - DNA, 20 bp, synthetic construct
  misc_feature 1..20: note = CRISPR gRNA sequence
  source 1..20: mol_type = other DNA
cagctctaatacaccatagg

SEQ ID NO: 13297 - DNA, 20 bp, synthetic construct
  misc_feature 1..20: note = CRISPR gRNA sequence
  source 1..20: mol_type = other DNA
tctaatacaccataggcagc

SEQ ID NO: 13298 - DNA, 20 bp, synthetic construct
  misc_feature 1..20: note = CRISPR gRNA sequence
  source 1..20: mol_type = other DNA
taggcagccggcacattcct

SEQ ID NO: 13299 - DNA, 20 bp, synthetic construct
  misc_feature 1..20: note = CRISPR gRNA sequence
  source 1..20: mol_type = other DNA
cggcacattcctgagctttt

SEQ ID NO: 13300 - DNA, 20 bp, synthetic construct
  misc_feature 1..20: note = CRISPR gRNA sequence
  source 1..20: mol_type = other DNA
cattcctgagcttttcagac

SEQ ID NO: 13301 - DNA, 20 bp, synthetic construct
  misc_feature 1..20: note = CRISPR gRNA sequence
  source 1..20: mol_type = other DNA
attcctgagcttttcagacg

SEQ ID NO: 13302 - DNA, 20 bp, synthetic construct
  misc_feature 1..20: note = CRISPR gRNA sequence
  source 1..20: mol_type = other DNA
cagacgaggacttcatcacc

SEQ ID NO: 13303 - DNA, 20 bp, synthetic construct
  misc_feature 1..20: note = CRISPR gRNA sequence
  source 1..20: mol_type = other DNA
agacgaggacttcatcacct

SEQ ID NO: 13304 - DNA, 20 bp, synthetic construct
  misc_feature 1..20: note = CRISPR gRNA sequence
  source 1..20: mol_type = other DNA
gacgaggacttcatcacctg

SEQ ID NO: 13305 - DNA, 20 bp, synthetic construct
  misc_feature 1..20: note = CRISPR gRNA sequence
  source 1..20: mol_type = other DNA
acgaggacttcatcacctgg

SEQ ID NO: 13306 - DNA, 20 bp, synthetic construct
  misc_feature 1..20: note = CRISPR gRNA sequence
  source 1..20: mol_type = other DNA
catcacctgggggctccaac

SEQ ID NO: 13307 - DNA, 20 bp, synthetic construct
  misc_feature 1..20: note = CRISPR gRNA sequence
  source 1..20: mol_type = other DNA
atcacctgggggctccaacc

SEQ ID NO: 13308 - DNA, 20 bp, synthetic construct
  misc_feature 1..20: note = CRISPR gRNA sequence
  source 1..20: mol_type = other DNA
acctgggggctccaaccagg

SEQ ID NO: 13309 - DNA, 20 bp, synthetic construct
  misc_feature 1..20: note = CRISPR gRNA sequence
  source 1..20: mol_type = other DNA
gggggctccaaccaggcagc

SEQ ID NO: 13310 - DNA, 20 bp, synthetic construct
  misc_feature 1..20: note = CRISPR gRNA sequence
  source 1..20: mol_type = other DNA
gggctccaaccaggcagcca

SEQ ID NO: 13311 - DNA, 20 bp, synthetic construct
  misc_feature 1..20: note = CRISPR gRNA sequence
  source 1..20: mol_type = other DNA
ggctccaaccaggcagccag

SEQ ID NO: 13312 - DNA, 20 bp, synthetic construct
  misc_feature 1..20: note = CRISPR gRNA sequence
  source 1..20: mol_type = other DNA
gctccaaccaggcagccaga

SEQ ID NO: 13313 - DNA, 20 bp, synthetic construct
  misc_feature 1..20: note = CRISPR gRNA sequence
  source 1..20: mol_type = other DNA
aaccaggcagccagagggca

SEQ ID NO: 13314 - DNA, 20 bp, synthetic construct
  misc_feature 1..20: note = CRISPR gRNA sequence
  source 1..20: mol_type = other DNA
gggcaaagtctaactcatga

SEQ ID NO: 13315 - DNA, 20 bp, synthetic construct
  misc_feature 1..20: note = CRISPR gRNA sequence
  source 1..20: mol_type = other DNA
gatggacttgaatccctgtt

SEQ ID NO: 13316 - DNA, 20 bp, synthetic construct
  misc_feature 1..20: note = CRISPR gRNA sequence
  source 1..20: mol_type = other DNA
tgaatccctgtttagcttct

SEQ ID NO: 13317 - DNA, 20 bp, synthetic construct
  misc_feature 1..20: note = CRISPR gRNA sequence
  source 1..20: mol_type = other DNA
gaatccctgtttagcttctt

SEQ ID NO: 13318 - DNA, 20 bp, synthetic construct
  misc_feature 1..20: note = CRISPR gRNA sequence
  source 1..20: mol_type = other DNA
tgtttagcttcttaggaact

SEQ ID NO: 13319 - DNA, 20 bp, synthetic construct
  misc_feature 1..20: note = CRISPR gRNA sequence
  source 1..20: mol_type = other DNA
ttcttaggaactaagcccct

SEQ ID NO: 13320 - DNA, 20 bp, synthetic construct
  misc_feature 1..20: note = CRISPR gRNA sequence
  source 1..20: mol_type = other DNA
tcttaggaactaagcccctg

SEQ ID NO: 13321 - DNA, 20 bp, synthetic construct
  misc_feature 1..20: note = CRISPR gRNA sequence
  source 1..20: mol_type = other DNA
ggaactaagcccctgaggct

SEQ ID NO: 13322 - DNA, 20 bp, synthetic construct
  misc_feature 1..20: note = CRISPR gRNA sequence
  source 1..20: mol_type = other DNA
cttccttaacctccactgta

SEQ ID NO: 13323 - DNA, 20 bp, synthetic construct
  misc_feature 1..20: note = CRISPR gRNA sequence
  source 1..20: mol_type = other DNA
ccttaacctccactgtaaag

SEQ ID NO: 13324 - DNA, 20 bp, synthetic construct
  misc_feature 1..20: note = CRISPR gRNA sequence
  source 1..20: mol_type = other DNA
cttaacctccactgtaaagt

SEQ ID NO: 13325 - DNA, 20 bp, synthetic construct
  misc_feature 1..20: note = CRISPR gRNA sequence
  source 1..20: mol_type = other DNA
tatgctccccaatccctccc

SEQ ID NO: 13326 - DNA, 20 bp, synthetic construct
  misc_feature 1..20: note = CRISPR gRNA sequence
  source 1..20: mol_type = other DNA
ccctccccagctgaattgct

SEQ ID NO: 13327 - DNA, 20 bp, synthetic construct
  misc_feature 1..20: note = CRISPR gRNA sequence
  source 1..20: mol_type = other DNA
ctccccagctgaattgctga

SEQ ID NO: 13328 - DNA, 20 bp, synthetic construct
  misc_feature 1..20: note = CRISPR gRNA sequence
  source 1..20: mol_type = other DNA
cccagctgaattgctgagag

SEQ ID NO: 13329 - DNA, 20 bp, synthetic construct
  misc_feature 1..20: note = CRISPR gRNA sequence
  source 1..20: mol_type = other DNA
aattgctgagagcagcaaat

SEQ ID NO: 13330 - DNA, 20 bp, synthetic construct
  misc_feature 1..20: note = CRISPR gRNA sequence
  source 1..20: mol_type = other DNA
attgctgagagcagcaaatg

SEQ ID NO: 13331 - DNA, 20 bp, synthetic construct
  misc_feature 1..20: note = CRISPR gRNA sequence
  source 1..20: mol_type = other DNA
agagcagcaaatgaggttgt

SEQ ID NO: 13332 - DNA, 20 bp, synthetic construct
  misc_feature 1..20: note = CRISPR gRNA sequence
  source 1..20: mol_type = other DNA
gagcagcaaatgaggttgtg

SEQ ID NO: 13333 - DNA, 20 bp, synthetic construct
  misc_feature 1..20: note = CRISPR gRNA sequence
  source 1..20: mol_type = other DNA
agcaaatgaggttgtgagga

SEQ ID NO: 13334 - DNA, 20 bp, synthetic construct
  misc_feature 1..20: note = CRISPR gRNA sequence
  source 1..20: mol_type = other DNA
gcaaatgaggttgtgaggaa

SEQ ID NO: 13335 - DNA, 20 bp, synthetic construct
  misc_feature 1..20: note = CRISPR gRNA sequence
  source 1..20: mol_type = other DNA
aaatgaggttgtgaggaaag

SEQ ID NO: 13336 - DNA, 20 bp, synthetic construct
  misc_feature 1..20: note = CRISPR gRNA sequence
  source 1..20: mol_type = other DNA
ttgtgaggaaaggagtttca

SEQ ID NO: 13337 - DNA, 20 bp, synthetic construct
  misc_feature 1..20: note = CRISPR gRNA sequence
  source 1..20: mol_type = other DNA
tgtgaggaaaggagtttcaa

SEQ ID NO: 13338 - DNA, 20 bp, synthetic construct
  misc_feature 1..20: note = CRISPR gRNA sequence
  source 1..20: mol_type = other DNA
aggagtttcaaaggtcacga

SEQ ID NO: 13339 - DNA, 20 bp, synthetic construct
  misc_feature 1..20: note = CRISPR gRNA sequence
  source 1..20: mol_type = other DNA
ggagtttcaaaggtcacgaa

SEQ ID NO: 13340 - DNA, 20 bp, synthetic construct
  misc_feature 1..20: note = CRISPR gRNA sequence
  source 1..20: mol_type = other DNA
tctacaactttttttgtcac

SEQ ID NO: 13341 - DNA, 20 bp, synthetic construct
  misc_feature 1..20: note = CRISPR gRNA sequence
  source 1..20: mol_type = other DNA
ctacaactttttttgtcact

SEQ ID NO: 13342 - DNA, 20 bp, synthetic construct
  misc_feature 1..20: note = CRISPR gRNA sequence
  source 1..20: mol_type = other DNA
tacaactttttttgtcactg

SEQ ID NO: 13343 - DNA, 20 bp, synthetic construct
  misc_feature 1..20: note = CRISPR gRNA sequence
  source 1..20: mol_type = other DNA
ctggggattcccatctgatg

SEQ ID NO: 13344 - DNA, 20 bp, synthetic construct
  misc_feature 1..20: note = CRISPR gRNA sequence
  source 1..20: mol_type = other DNA
tcatctcatcactcatgtgc

SEQ ID NO: 13345 - DNA, 20 bp, synthetic construct
  misc_feature 1..20: note = CRISPR gRNA sequence
  source 1..20: mol_type = other DNA
actcatgtgccagccacatt

SEQ ID NO: 13346 - DNA, 20 bp, synthetic construct
  misc_feature 1..20: note = CRISPR gRNA sequence
  source 1..20: mol_type = other DNA
ctcatgtgccagccacattg

SEQ ID NO: 13347 - DNA, 20 bp, synthetic construct
  misc_feature 1..20: note = CRISPR gRNA sequence
  source 1..20: mol_type = other DNA
tgccagccacattgaggatg

SEQ ID NO: 13348 - DNA, 20 bp, synthetic construct
  misc_feature 1..20: note = CRISPR gRNA sequence
  source 1..20: mol_type = other DNA
cagccacattgaggatgcag

SEQ ID NO: 13349 - DNA, 20 bp, synthetic construct
  misc_feature 1..20: note = CRISPR gRNA sequence
  source 1..20: mol_type = other DNA
agccacattgaggatgcagt

SEQ ID NO: 13350 - DNA, 20 bp, synthetic construct
  misc_feature 1..20: note = CRISPR gRNA sequence
  source 1..20: mol_type = other DNA
cacattgaggatgcagtagg

SEQ ID NO: 13351 - DNA, 20 bp, synthetic construct
  misc_feature 1..20: note = CRISPR gRNA sequence
  source 1..20: mol_type = other DNA
attgaggatgcagtaggcgg

SEQ ID NO: 13352 - DNA, 20 bp, synthetic construct
  misc_feature 1..20: note = CRISPR gRNA sequence
  source 1..20: mol_type = other DNA
tgaggatgcagtaggcggaa

SEQ ID NO: 13353 - DNA, 20 bp, synthetic construct
  misc_feature 1..20: note = CRISPR gRNA sequence
  source 1..20: mol_type = other DNA
aggatgcagtaggcggaaga

SEQ ID NO: 13354 - DNA, 20 bp, synthetic construct
  misc_feature 1..20: note = CRISPR gRNA sequence
  source 1..20: mol_type = other DNA
gtaggcggaagagagaaaaa

SEQ ID NO: 13355 - DNA, 20 bp, synthetic construct
  misc_feature 1..20: note = CRISPR gRNA sequence
  source 1..20: mol_type = other DNA
taggcggaagagagaaaaaa

SEQ ID NO: 13356 - DNA, 20 bp, synthetic construct
  misc_feature 1..20: note = CRISPR gRNA sequence
  source 1..20: mol_type = other DNA
aggcggaagagagaaaaaaa

SEQ ID NO: 13357 - DNA, 20 bp, synthetic construct
  misc_feature 1..20: note = CRISPR gRNA sequence
  source 1..20: mol_type = other DNA
aagagagaaaaaaagggaca

SEQ ID NO: 13358 - DNA, 20 bp, synthetic construct
  misc_feature 1..20: note = CRISPR gRNA sequence
  source 1..20: mol_type = other DNA
gagaaaaaaagggacaaagt

SEQ ID NO: 13359 - DNA, 20 bp, synthetic construct
  misc_feature 1..20: note = CRISPR gRNA sequence
  source 1..20: mol_type = other DNA
agaaaaaaagggacaaagtg

SEQ ID NO: 13360 - DNA, 20 bp, synthetic construct
  misc_feature 1..20: note = CRISPR gRNA sequence
  source 1..20: mol_type = other DNA
gaaaaaaagggacaaagtga

SEQ ID NO: 13361 - DNA, 20 bp, synthetic construct
  misc_feature 1..20: note = CRISPR gRNA sequence
  source 1..20: mol_type = other DNA
agtgagggcttttctttctg

SEQ ID NO: 13362 - DNA, 20 bp, synthetic construct
  misc_feature 1..20: note = CRISPR gRNA sequence
  source 1..20: mol_type = other DNA
gtgagggcttttctttctgc

SEQ ID NO: 13363 - DNA, 20 bp, synthetic construct
  misc_feature 1..20: note = CRISPR gRNA sequence
  source 1..20: mol_type = other DNA
ttttctttctgcaggtgcct

SEQ ID NO: 13364 - DNA, 20 bp, synthetic construct
  misc_feature 1..20: note = CRISPR gRNA sequence
  source 1..20: mol_type = other DNA
tttctttctgcaggtgcctt

SEQ ID NO: 13365 - DNA, 20 bp, synthetic construct
  misc_feature 1..20: note = CRISPR gRNA sequence
  source 1..20: mol_type = other DNA
ttctttctgcaggtgccttg

SEQ ID NO: 13366 - DNA, 20 bp, synthetic construct
  misc_feature 1..20: note = CRISPR gRNA sequence
  source 1..20: mol_type = other DNA
tctttctgcaggtgccttgg

SEQ ID NO: 13367 - DNA, 20 bp, synthetic construct
  misc_feature 1..20: note = CRISPR gRNA sequence
  source 1..20: mol_type = other DNA
ttctgcaggtgccttggggg

SEQ ID NO: 13368 - DNA, 20 bp, synthetic construct
  misc_feature 1..20: note = CRISPR gRNA sequence
  source 1..20: mol_type = other DNA
tctgcaggtgccttgggggc

SEQ ID NO: 13369 - DNA, 20 bp, synthetic construct
  misc_feature 1..20: note = CRISPR gRNA sequence
  source 1..20: mol_type = other DNA
ggtgccttgggggcaggatt

SEQ ID NO: 13370 - DNA, 20 bp, synthetic construct
  misc_feature 1..20: note = CRISPR gRNA sequence
  source 1..20: mol_type = other DNA
gtgccttgggggcaggattt

SEQ ID NO: 13371 - DNA, 20 bp, synthetic construct
  misc_feature 1..20: note = CRISPR gRNA sequence
  source 1..20: mol_type = other DNA
tgccttgggggcaggatttg

SEQ ID NO: 13372 - DNA, 20 bp, synthetic construct
  misc_feature 1..20: note = CRISPR gRNA sequence
  source 1..20: mol_type = other DNA
gatttggggttgtcaaaacc

SEQ ID NO: 13373 - DNA, 20 bp, synthetic construct
  misc_feature 1..20: note = CRISPR gRNA sequence
  source 1..20: mol_type = other DNA
tttggggttgtcaaaaccca

SEQ ID NO: 13374 - DNA, 20 bp, synthetic construct
  misc_feature 1..20: note = CRISPR gRNA sequence
  source 1..20: mol_type = other DNA
ttggggttgtcaaaacccag

SEQ ID NO: 13375 - DNA, 20 bp, synthetic construct
  misc_feature 1..20: note = CRISPR gRNA sequence
  source 1..20: mol_type = other DNA
tgtcaaaacccagaggttgc

SEQ ID NO: 13376 - DNA, 20 bp, synthetic construct
  misc_feature 1..20: note = CRISPR gRNA sequence
  source 1..20: mol_type = other DNA
gtcaaaacccagaggttgct

SEQ ID NO: 13377 - DNA, 20 bp, synthetic construct
  misc_feature 1..20: note = CRISPR gRNA sequence
  source 1..20: mol_type = other DNA
ccagaggttgctgggcactg

SEQ ID NO: 13378 - DNA, 20 bp, synthetic construct
  misc_feature 1..20: note = CRISPR gRNA sequence
  source 1..20: mol_type = other DNA
ggcactgtagcatgcacctg

SEQ ID NO: 13379 - DNA, 20 bp, synthetic construct
  misc_feature 1..20: note = CRISPR gRNA sequence
  source 1..20: mol_type = other DNA
gtagcatgcacctgtggtcc

SEQ ID NO: 13380 - DNA, 20 bp, synthetic construct
  misc_feature 1..20: note = CRISPR gRNA sequence
  source 1..20: mol_type = other DNA
cacctgtggtcccagctact

SEQ ID NO: 13381 - DNA, 20 bp, synthetic construct
  misc_feature 1..20: note = CRISPR gRNA sequence
  source 1..20: mol_type = other DNA
acctgtggtcccagctactc

SEQ ID NO: 13382 - DNA, 20 bp, synthetic construct
  misc_feature 1..20: note = CRISPR gRNA sequence
  source 1..20: mol_type = other DNA
ctgtggtcccagctactcag

SEQ ID NO: 13383 - DNA, 20 bp, synthetic construct
  misc_feature 1..20: note = CRISPR gRNA sequence
  source 1..20: mol_type = other DNA
tgtggtcccagctactcagg

SEQ ID NO: 13384 - DNA, 20 bp, synthetic construct
  misc_feature 1..20: note = CRISPR gRNA sequence
  source 1..20: mol_type = other DNA
tcccagctactcaggaggct

SEQ ID NO: 13385 - DNA, 20 bp, synthetic construct
  misc_feature 1..20: note = CRISPR gRNA sequence
  source 1..20: mol_type = other DNA
cccagctactcaggaggctg

SEQ ID NO: 13386 - DNA, 20 bp, synthetic construct
  misc_feature 1..20: note = CRISPR gRNA sequence
  source 1..20: mol_type = other DNA
agctactcaggaggctgagg

SEQ ID NO: 13387 - DNA, 20 bp, synthetic construct
  misc_feature 1..20: note = CRISPR gRNA sequence
  source 1..20: mol_type = other DNA
gctactcaggaggctgaggc

SEQ ID NO: 13388 - DNA, 20 bp, synthetic construct
  misc_feature 1..20: note = CRISPR gRNA sequence
  source 1..20: mol_type = other DNA
tactcaggaggctgaggcag

SEQ ID NO: 13389 - DNA, 20 bp, synthetic construct
  misc_feature 1..20: note = CRISPR gRNA sequence
  source 1..20: mol_type = other DNA
actcaggaggctgaggcagg

SEQ ID NO: 13390 - DNA, 20 bp, synthetic construct
  misc_feature 1..20: note = CRISPR gRNA sequence
  source 1..20: mol_type = other DNA
ctgaggcaggaggactactt

SEQ ID NO: 13391 - DNA, 20 bp, synthetic construct
  misc_feature 1..20: note = CRISPR gRNA sequence
  source 1..20: mol_type = other DNA
tgaggcaggaggactacttg

SEQ ID NO: 13392 - DNA, 20 bp, synthetic construct
  misc_feature 1..20: note = CRISPR gRNA sequence
  source 1..20: mol_type = other DNA
gcaggaggactacttgaggc

SEQ ID NO: 13393 - DNA, 20 bp, synthetic construct
  misc_feature 1..20: note = CRISPR gRNA sequence
  source 1..20: mol_type = other DNA
caggaggactacttgaggcc

SEQ ID NO: 13394 - DNA, 20 bp, synthetic construct
  misc_feature 1..20: note = CRISPR gRNA sequence
  source 1..20: mol_type = other DNA
ctacttgaggccaggaattc

SEQ ID NO: 13395 - DNA, 20 bp, synthetic construct
  misc_feature 1..20: note = CRISPR gRNA sequence
  source 1..20: mol_type = other DNA
tacttgaggccaggaattcg

SEQ ID NO: 13396 - DNA, 20 bp, synthetic construct
  misc_feature 1..20: note = CRISPR gRNA sequence
  source 1..20: mol_type = other DNA
aggccaggaattcgaggctg

SEQ ID NO: 13397 - DNA, 20 bp, synthetic construct
  misc_feature 1..20: note = CRISPR gRNA sequence
  source 1..20: mol_type = other DNA
caggaattcgaggctgcagt

SEQ ID NO: 13398 - DNA, 20 bp, synthetic construct
  misc_feature 1..20: note = CRISPR gRNA sequence
  source 1..20: mol_type = other DNA
gctgcagtgagctatgatca

SEQ ID NO: 13399 - DNA, 20 bp, synthetic construct
  misc_feature 1..20: note = CRISPR gRNA sequence
  source 1..20: mol_type = other DNA
tatgatcacagcactgcacc

SEQ ID NO: 13400 - DNA, 20 bp, synthetic construct
  misc_feature 1..20: note = CRISPR gRNA sequence
  source 1..20: mol_type = other DNA
cagcactgcacccagatgtt

SEQ ID NO: 13401 - DNA, 20 bp, synthetic construct
  misc_feature 1..20: note = CRISPR gRNA sequence
  source 1..20: mol_type = other DNA
gcactgcacccagatgttga

SEQ ID NO: 13402 - DNA, 20 bp, synthetic construct
  misc_feature 1..20: note = CRISPR gRNA sequence
  source 1..20: mol_type = other DNA
cactgcacccagatgttgag

SEQ ID NO: 13403 - DNA, 20 bp, synthetic construct
  misc_feature 1..20: note = CRISPR gRNA sequence
  source 1..20: mol_type = other DNA
tgcacccagatgttgagagg

SEQ ID NO: 13404 - DNA, 20 bp, synthetic construct
  misc_feature 1..20: note = CRISPR gRNA sequence
  source 1..20: mol_type = other DNA
gcacccagatgttgagagga

SEQ ID NO: 13405 - DNA, 20 bp, synthetic construct
  misc_feature 1..20: note = CRISPR gRNA sequence
  source 1..20: mol_type = other DNA
cacccagatgttgagaggaa

SEQ ID NO: 13406 - DNA, 20 bp, synthetic construct
  misc_feature 1..20: note = CRISPR gRNA sequence
  source 1..20: mol_type = other DNA
acccagatgttgagaggaag

SEQ ID NO: 13407 - DNA, 20 bp, synthetic construct
  misc_feature 1..20: note = CRISPR gRNA sequence
  source 1..20: mol_type = other DNA
atgttgagaggaaggggtcc

SEQ ID NO: 13408 - DNA, 20 bp, synthetic construct
  misc_feature 1..20: note = CRISPR gRNA sequence
  source 1..20: mol_type = other DNA
gttgagaggaaggggtccca

SEQ ID NO: 13409 - DNA, 20 bp, synthetic construct
  misc_feature 1..20: note = CRISPR gRNA sequence
  source 1..20: mol_type = other DNA
cccagagtctatactcactc

SEQ ID NO: 13410 - DNA, 20 bp, synthetic construct
  misc_feature 1..20: note = CRISPR gRNA sequence
  source 1..20: mol_type = other DNA
tatactcactccagatgctg

SEQ ID NO: 13411 - DNA, 20 bp, synthetic construct
  misc_feature 1..20: note = CRISPR gRNA sequence
  source 1..20: mol_type = other DNA
atactcactccagatgctgc

SEQ ID NO: 13412 - DNA, 20 bp, synthetic construct
  misc_feature 1..20: note = CRISPR gRNA sequence
  source 1..20: mol_type = other DNA
tactcactccagatgctgca

SEQ ID NO: 13413 - DNA, 20 bp, synthetic construct
  misc_feature 1..20: note = CRISPR gRNA sequence
  source 1..20: mol_type = other DNA
ctcactccagatgctgcagg

SEQ ID NO: 13414 - DNA, 20 bp, synthetic construct
  misc_feature 1..20: note = CRISPR gRNA sequence
  source 1..20: mol_type = other DNA
tcactccagatgctgcaggg

SEQ ID NO: 13415 - DNA, 20 bp, synthetic construct
  misc_feature 1..20: note = CRISPR gRNA sequence
  source 1..20: mol_type = other DNA
ccagatgctgcagggaggaa

SEQ ID NO: 13416 - DNA, 20 bp, synthetic construct
  misc_feature 1..20: note = CRISPR gRNA sequence
  source 1..20: mol_type = other DNA
cagatgctgcagggaggaaa

SEQ ID NO: 13417 - DNA, 20 bp, synthetic construct
  misc_feature 1..20: note = CRISPR gRNA sequence
  source 1..20: mol_type = other DNA
tgcagggaggaaaaggccgt

SEQ ID NO: 13418 - DNA, 20 bp, synthetic construct
  misc_feature 1..20: note = CRISPR gRNA sequence
  source 1..20: mol_type = other DNA
gcagggaggaaaaggccgtg

SEQ ID NO: 13419 - DNA, 20 bp, synthetic construct
  misc_feature 1..20: note = CRISPR gRNA sequence
  source 1..20: mol_type = other DNA
aaggccgtgaggatccgcac

SEQ ID NO: 13420 - DNA, 20 bp, synthetic construct
  misc_feature 1..20: note = CRISPR gRNA sequence
  source 1..20: mol_type = other DNA
cgtgaggatccgcaccagtt

SEQ ID NO: 13421 - DNA, 20 bp, synthetic construct
  misc_feature 1..20: note = CRISPR gRNA sequence
  source 1..20: mol_type = other DNA
gtgaggatccgcaccagttt

SEQ ID NO: 13422 - DNA, 20 bp, synthetic construct
  misc_feature 1..20: note = CRISPR gRNA sequence
  source 1..20: mol_type = other DNA
tgaggatccgcaccagtttg

SEQ ID NO: 13423 - DNA, 20 bp, synthetic construct
  misc_feature 1..20: note = CRISPR gRNA sequence
  source 1..20: mol_type = other DNA
gatccgcaccagtttgggga

SEQ ID NO: 13424 - DNA, 20 bp, synthetic construct
  misc_feature 1..20: note = CRISPR gRNA sequence
  source 1..20: mol_type = other DNA
gcaccagtttggggaaagcc

SEQ ID NO: 13425 - DNA, 20 bp, synthetic construct
  misc_feature 1..20: note = CRISPR gRNA sequence
  source 1..20: mol_type = other DNA
caccagtttggggaaagcct

SEQ ID NO: 13426 - DNA, 20 bp, synthetic construct
  misc_feature 1..20: note = CRISPR gRNA sequence
  source 1..20: mol_type = other DNA
accagtttggggaaagcctg

SEQ ID NO: 13427 - DNA, 20 bp, synthetic construct
  misc_feature 1..20: note = CRISPR gRNA sequence
  source 1..20: mol_type = other DNA
ccagtttggggaaagcctgg

SEQ ID NO: 13428 - DNA, 20 bp, synthetic construct
  misc_feature 1..20: note = CRISPR gRNA sequence
  source 1..20: mol_type = other DNA
tggggaaagcctgggggcct

SEQ ID NO: 13429 - DNA, 20 bp, synthetic construct
  misc_feature 1..20: note = CRISPR gRNA sequence
  source 1..20: mol_type = other DNA
gaaagcctgggggcctgaga

SEQ ID NO: 13430 - DNA, 20 bp, synthetic construct
  misc_feature 1..20: note = CRISPR gRNA sequence
  source 1..20: mol_type = other DNA
aaagcctgggggcctgagac

SEQ ID NO: 13431 - DNA, 20 bp, synthetic construct
  misc_feature 1..20: note = CRISPR gRNA sequence
  source 1..20: mol_type = other DNA
aagcctgggggcctgagaca

SEQ ID NO: 13432 - DNA, 20 bp, synthetic construct
  misc_feature 1..20: note = CRISPR gRNA sequence
  source 1..20: mol_type = other DNA
tgggggcctgagacagggcc

SEQ ID NO: 13433 - DNA, 20 bp, synthetic construct
  misc_feature 1..20: note = CRISPR gRNA sequence
  source 1..20: mol_type = other DNA
gcctgagacagggcccagcc

SEQ ID NO: 13434 - DNA, 20 bp, synthetic construct
  misc_feature 1..20: note = CRISPR gRNA sequence
  source 1..20: mol_type = other DNA
cctgagacagggcccagcct

SEQ ID NO: 13435 - DNA, 20 bp, synthetic construct
  misc_feature 1..20: note = CRISPR gRNA sequence
  source 1..20: mol_type = other DNA
tgagacagggcccagcctag

SEQ ID NO: 13436 - DNA, 20 bp, synthetic construct
  misc_feature 1..20: note = CRISPR gRNA sequence
  source 1..20: mol_type = other DNA
gagacagggcccagcctagg

SEQ ID NO: 13437 - DNA, 20 bp, synthetic construct
  misc_feature 1..20: note = CRISPR gRNA sequence
  source 1..20: mol_type = other DNA
agggcccagcctaggaggca

SEQ ID NO: 13438 - DNA, 20 bp, synthetic construct
  misc_feature 1..20: note = CRISPR gRNA sequence
  source 1..20: mol_type = other DNA
ggcccagcctaggaggcaaa

SEQ ID NO: 13439 - DNA, 20 bp, synthetic construct
  misc_feature 1..20: note = CRISPR gRNA sequence
  source 1..20: mol_type = other DNA
cagcctaggaggcaaagagc

SEQ ID NO: 13440 - DNA, 20 bp, synthetic construct
  misc_feature 1..20: note = CRISPR gRNA sequence
  source 1..20: mol_type = other DNA
agcctaggaggcaaagagca

SEQ ID NO: 13441 - DNA, 20 bp, synthetic construct
  misc_feature 1..20: note = CRISPR gRNA sequence
  source 1..20: mol_type = other DNA
gcctaggaggcaaagagcaa

SEQ ID NO: 13442 - DNA, 20 bp, synthetic construct
  misc_feature 1..20: note = CRISPR gRNA sequence
  source 1..20: mol_type = other DNA
aggaggcaaagagcaagggt

SEQ ID NO: 13443 - DNA, 20 bp, synthetic construct
  misc_feature 1..20: note = CRISPR gRNA sequence
  source 1..20: mol_type = other DNA
aagagcaagggtaagacctc

SEQ ID NO: 13444 - DNA, 20 bp, synthetic construct
  misc_feature 1..20: note = CRISPR gRNA sequence
  source 1..20: mol_type = other DNA
aagggtaagacctccagtca

SEQ ID NO: 13445 - DNA, 20 bp, synthetic construct
  misc_feature 1..20: note = CRISPR gRNA sequence
  source 1..20: mol_type = other DNA
aagacctccagtcacagtca

SEQ ID NO: 13446 - DNA, 20 bp, synthetic construct
  misc_feature 1..20: note = CRISPR gRNA sequence
  source 1..20: mol_type = other DNA
cacagtcacagcccctcatt

SEQ ID NO: 13447 - DNA, 20 bp, synthetic construct
  misc_feature 1..20: note = CRISPR gRNA sequence
  source 1..20: mol_type = other DNA
cacagcccctcattcagccc

SEQ ID NO: 13448 - DNA, 20 bp, synthetic construct
  misc_feature 1..20: note = CRISPR gRNA sequence
  source 1..20: mol_type = other DNA
acagcccctcattcagcccc

SEQ ID NO: 13449 - DNA, 20 bp, synthetic construct
  misc_feature 1..20: note = CRISPR gRNA sequence
  source 1..20: mol_type = other DNA
cagcccctcattcagcccca

SEQ ID NO: 13450 - DNA, 20 bp, synthetic construct
  misc_feature 1..20: note = CRISPR gRNA sequence
  source 1..20: mol_type = other DNA
cccctcattcagccccaggg

SEQ ID NO: 13451 - DNA, 20 bp, synthetic construct
  misc_feature 1..20: note = CRISPR gRNA sequence
  source 1..20: mol_type = other DNA
ccctcattcagccccagggt

SEQ ID NO: 13452 - DNA, 20 bp, synthetic construct
  misc_feature 1..20: note = CRISPR gRNA sequence
  source 1..20: mol_type = other DNA
cctcattcagccccagggtg

SEQ ID NO: 13453 - DNA, 20 bp, synthetic construct
  misc_feature 1..20: note = CRISPR gRNA sequence
  source 1..20: mol_type = other DNA
cattcagccccagggtgggg

SEQ ID NO: 13454 - DNA, 20 bp, synthetic construct
  misc_feature 1..20: note = CRISPR gRNA sequence
  source 1..20: mol_type = other DNA
ttcagccccagggtggggca

SEQ ID NO: 13455 - DNA, 20 bp, synthetic construct
  misc_feature 1..20: note = CRISPR gRNA sequence
  source 1..20: mol_type = other DNA
ccccagggtggggcagagac

SEQ ID NO: 13456 - DNA, 20 bp, synthetic construct
  misc_feature 1..20: note = CRISPR gRNA sequence
  source 1..20: mol_type = other DNA
cccagggtggggcagagaca

SEQ ID NO: 13457 - DNA, 20 bp, synthetic construct
  misc_feature 1..20: note = CRISPR gRNA sequence
  source 1..20: mol_type = other DNA
ggtggggcagagacaaggca

SEQ ID NO: 13458 - DNA, 20 bp, synthetic construct
  misc_feature 1..20: note = CRISPR gRNA sequence
  source 1..20: mol_type = other DNA
ggggcagagacaaggcacag

SEQ ID NO: 13459 - DNA, 20 bp, synthetic construct
  misc_feature 1..20: note = CRISPR gRNA sequence
  source 1..20: mol_type = other DNA
cagagacaaggcacagaagt

SEQ ID NO: 13460 - DNA, 20 bp, synthetic construct
  misc_feature 1..20: note = CRISPR gRNA sequence
  source 1..20: mol_type = other DNA
agagacaaggcacagaagtc

SEQ ID NO: 13461 - DNA, 20 bp, synthetic construct
  misc_feature 1..20: note = CRISPR gRNA sequence
  source 1..20: mol_type = other DNA
acagaagtcaggtcctgtct

SEQ ID NO: 13462 - DNA, 20 bp, synthetic construct
  misc_feature 1..20: note = CRISPR gRNA sequence
  source 1..20: mol_type = other DNA
cagaagtcaggtcctgtctg

SEQ ID NO: 13463 - DNA, 20 bp, synthetic construct
  misc_feature 1..20: note = CRISPR gRNA sequence
  source 1..20: mol_type = other DNA
cctcctcttcccttccaccc

SEQ ID NO: 13464 - DNA, 20 bp, synthetic construct
  misc_feature 1..20: note = CRISPR gRNA sequence
  source 1..20: mol_type = other DNA
tcccttccaccccagcctct

SEQ ID NO: 13465 - DNA, 20 bp, synthetic construct
  misc_feature 1..20: note = CRISPR gRNA sequence
  source 1..20: mol_type = other DNA
cccttccaccccagcctctt

SEQ ID NO: 13466 - DNA, 20 bp, synthetic construct
  misc_feature 1..20: note = CRISPR gRNA sequence
  source 1..20: mol_type = other DNA
gtccctgcaacccttccacg

SEQ ID NO: 13467 - DNA, 20 bp, synthetic construct
  misc_feature 1..20: note = CRISPR gRNA sequence
  source 1..20: mol_type = other DNA
tccctgcaacccttccacgt

SEQ ID NO: 13468 - DNA, 20 bp, synthetic construct
  misc_feature 1..20: note = CRISPR gRNA sequence
  source 1..20: mol_type = other DNA
ggaccccaatcttttctgct

SEQ ID NO: 13469 - DNA, 20 bp, synthetic construct
  misc_feature 1..20: note = CRISPR gRNA sequence
  source 1..20: mol_type = other DNA
gaccccaatcttttctgctt

SEQ ID NO: 13470 - DNA, 20 bp, synthetic construct
  misc_feature 1..20: note = CRISPR gRNA sequence
  source 1..20: mol_type = other DNA
accccaatcttttctgcttg

SEQ ID NO: 13471 - DNA, 20 bp, synthetic construct
  misc_feature 1..20: note = CRISPR gRNA sequence
  source 1..20: mol_type = other DNA
ccaatcttttctgcttgggg

SEQ ID NO: 13472 - DNA, 20 bp, synthetic construct
  misc_feature 1..20: note = CRISPR gRNA sequence
  source 1..20: mol_type = other DNA
tctgcttggggtagatttca

SEQ ID NO: 13473 - DNA, 20 bp, synthetic construct
  misc_feature 1..20: note = CRISPR gRNA sequence
  source 1..20: mol_type = other DNA
tagatttcatagccccccat

SEQ ID NO: 13474 - DNA, 20 bp, synthetic construct
  misc_feature 1..20: note = CRISPR gRNA sequence
  source 1..20: mol_type = other DNA
gatttcatagccccccataa

SEQ ID NO: 13475 - DNA, 20 bp, synthetic construct
  misc_feature 1..20: note = CRISPR gRNA sequence
  source 1..20: mol_type = other DNA
atttcatagccccccataag

SEQ ID NO: 13476 - DNA, 20 bp, synthetic construct
  misc_feature 1..20: note = CRISPR gRNA sequence
  source 1..20: mol_type = other DNA
catagccccccataagaggc

SEQ ID NO: 13477 - DNA, 20 bp, synthetic construct
  misc_feature 1..20: note = CRISPR gRNA sequence
  source 1..20: mol_type = other DNA
ccccccataagaggccagtt

SEQ ID NO: 13478 - DNA, 20 bp, synthetic construct
  misc_feature 1..20: note = CRISPR gRNA sequence
  source 1..20: mol_type = other DNA
cccccataagaggccagttg

SEQ ID NO: 13479 - DNA, 20 bp, synthetic construct
  misc_feature 1..20: note = CRISPR gRNA sequence
  source 1..20: mol_type = other DNA
cataagaggccagttgaggc

SEQ ID NO: 13480 - DNA, 20 bp, synthetic construct
  misc_feature 1..20: note = CRISPR gRNA sequence
  source 1..20: mol_type = other DNA
ataagaggccagttgaggct

SEQ ID NO: 13481 - DNA, 20 bp, synthetic construct
  misc_feature 1..20: note = CRISPR gRNA sequence
  source 1..20: mol_type = other DNA
aggccagttgaggctgggaa

SEQ ID NO: 13482 - DNA, 20 bp, synthetic construct
  misc_feature 1..20: note = CRISPR gRNA sequence
  source 1..20: mol_type = other DNA
ccagttgaggctgggaacag

SEQ ID NO: 13483 - DNA, 20 bp, synthetic construct
  misc_feature 1..20: note = CRISPR gRNA sequence
  source 1..20: mol_type = other DNA
gtggctcatgtctgtaattc

SEQ ID NO: 13484 - DNA, 20 bp, synthetic construct
  misc_feature 1..20: note = CRISPR gRNA sequence
  source 1..20: mol_type = other DNA
tgtctgtaattccagcattt

SEQ ID NO: 13485 - DNA, 20 bp, synthetic construct
  misc_feature 1..20: note = CRISPR gRNA sequence
  source 1..20: mol_type = other DNA
gtctgtaattccagcatttt

SEQ ID NO: 13486 - DNA, 20 bp, synthetic construct
  misc_feature 1..20: note = CRISPR gRNA sequence
  source 1..20: mol_type = other DNA
ctgtaattccagcattttgg

SEQ ID NO: 13487 - DNA, 20 bp, synthetic construct
  misc_feature 1..20: note = CRISPR gRNA sequence
  source 1..20: mol_type = other DNA
tgtaattccagcattttggg

SEQ ID NO: 13488 - DNA, 20 bp, synthetic construct
  misc_feature 1..20: note = CRISPR gRNA sequence
  source 1..20: mol_type = other DNA
ttccagcattttgggaggcc

SEQ ID NO: 13489 - DNA, 20 bp, synthetic construct
  misc_feature 1..20: note = CRISPR gRNA sequence
  source 1..20: mol_type = other DNA
tccagcattttgggaggcca

SEQ ID NO: 13490 - DNA, 20 bp, synthetic construct
  misc_feature 1..20: note = CRISPR gRNA sequence
  source 1..20: mol_type = other DNA
gcattttgggaggccaaggt

SEQ ID NO: 13491 - DNA, 20 bp, synthetic construct
  misc_feature 1..20: note = CRISPR gRNA sequence
  source 1..20: mol_type = other DNA
attttgggaggccaaggtaa

SEQ ID NO: 13492 - DNA, 20 bp, synthetic construct
  misc_feature 1..20: note = CRISPR gRNA sequence
  source 1..20: mol_type = other DNA
ttttgggaggccaaggtaag

SEQ ID NO: 13493 - DNA, 20 bp, synthetic construct
  misc_feature 1..20: note = CRISPR gRNA sequence
  source 1..20: mol_type = other DNA
ccaaggtaagaggactgctt

SEQ ID NO: 13494 - DNA, 20 bp, synthetic construct
  misc_feature 1..20: note = CRISPR gRNA sequence
  source 1..20: mol_type = other DNA
gtaagaggactgcttgagcc

SEQ ID NO: 13495 - DNA, 20 bp, synthetic construct
  misc_feature 1..20: note = CRISPR gRNA sequence
  source 1..20: mol_type = other DNA
taagaggactgcttgagccc

SEQ ID NO: 13496 - DNA, 20 bp, synthetic construct
  misc_feature 1..20: note = CRISPR gRNA sequence
  source 1..20: mol_type = other DNA
agaggactgcttgagcccag

SEQ ID NO: 13497 - DNA, 20 bp, synthetic construct
  misc_feature 1..20: note = CRISPR gRNA sequence
  source 1..20: mol_type = other DNA
ctgcttgagcccaggagttc

SEQ ID NO: 13498 - DNA, 20 bp, synthetic construct
  misc_feature 1..20: note = CRISPR gRNA sequence
  source 1..20: mol_type = other DNA
tgagcccaggagttcaagac

SEQ ID NO: 13499 - DNA, 20 bp, synthetic construct
  misc_feature 1..20: note = CRISPR gRNA sequence
  source 1..20: mol_type = other DNA
ccaggagttcaagaccagct

SEQ ID NO: 13500 - DNA, 20 bp, synthetic construct
  misc_feature 1..20: note = CRISPR gRNA sequence
  source 1..20: mol_type = other DNA
caggagttcaagaccagctt

SEQ ID NO: 13501 - DNA, 20 bp, synthetic construct
  misc_feature 1..20: note = CRISPR gRNA sequence
  source 1..20: mol_type = other DNA
caagaccagcttgggcaaca

SEQ ID NO: 13502 - DNA, 20 bp, synthetic construct
  misc_feature 1..20: note = CRISPR gRNA sequence
  source 1..20: mol_type = other DNA
accagcttgggcaacatagt

SEQ ID NO: 13503 - DNA, 20 bp, synthetic construct
  misc_feature 1..20: note = CRISPR gRNA sequence
  source 1..20: mol_type = other DNA
ttgggcaacatagtgagact

SEQ ID NO: 13504 - DNA, 20 bp, synthetic construct
  misc_feature 1..20: note = CRISPR gRNA sequence
  source 1..20: mol_type = other DNA
tctacaaaaaacacaataat

SEQ ID NO: 13505 - DNA, 20 bp, synthetic construct
  misc_feature 1..20: note = CRISPR gRNA sequence
  source 1..20: mol_type = other DNA
aaaaaacacaataattagcc

SEQ ID NO: 13506 - DNA, 20 bp, synthetic construct
  misc_feature 1..20: note = CRISPR gRNA sequence
  source 1..20: mol_type = other DNA
acacaataattagccaagtg

SEQ ID NO: 13507 - DNA, 20 bp, synthetic construct
  misc_feature 1..20: note = CRISPR gRNA sequence
  source 1..20: mol_type = other DNA
caataattagccaagtgtgg

SEQ ID NO: 13508 - DNA, 20 bp, synthetic construct
  misc_feature 1..20: note = CRISPR gRNA sequence
  source 1..20: mol_type = other DNA
aagtgtggtggtgtgtcctg

SEQ ID NO: 13509 - DNA, 20 bp, synthetic construct
  misc_feature 1..20: note = CRISPR gRNA sequence
  source 1..20: mol_type = other DNA
ggtggtgtgtcctgtggtct

SEQ ID NO: 13510 - DNA, 20 bp, synthetic construct
  misc_feature 1..20: note = CRISPR gRNA sequence
  source 1..20: mol_type = other DNA
gtcctgtggtctcagcttct

SEQ ID NO: 13511 - DNA, 20 bp, synthetic construct
  misc_feature 1..20: note = CRISPR gRNA sequence
  source 1..20: mol_type = other DNA
tcctgtggtctcagcttctt

SEQ ID NO: 13512 - DNA, 20 bp, synthetic construct
  misc_feature 1..20: note = CRISPR gRNA sequence
  source 1..20: mol_type = other DNA
ctgtggtctcagcttcttag

SEQ ID NO: 13513 - DNA, 20 bp, synthetic construct
  misc_feature 1..20: note = CRISPR gRNA sequence
  source 1..20: mol_type = other DNA
tgtggtctcagcttcttagg

SEQ ID NO: 13514 - DNA, 20 bp, synthetic construct
  misc_feature 1..20: note = CRISPR gRNA sequence
  source 1..20: mol_type = other DNA
tctcagcttcttaggaggct

SEQ ID NO: 13515 - DNA, 20 bp, synthetic construct
  misc_feature 1..20: note = CRISPR gRNA sequence
  source 1..20: mol_type = other DNA
ctcagcttcttaggaggctg

SEQ ID NO: 13516 - DNA, 20 bp, synthetic construct
  misc_feature 1..20: note = CRISPR gRNA sequence
  source 1..20: mol_type = other DNA
agcttcttaggaggctgagg

SEQ ID NO: 13517 - DNA, 20 bp, synthetic construct
  misc_feature 1..20: note = CRISPR gRNA sequence
  source 1..20: mol_type = other DNA
ttcttaggaggctgaggtgg

SEQ ID NO: 13518 - DNA, 20 bp, synthetic construct
  misc_feature 1..20: note = CRISPR gRNA sequence
  source 1..20: mol_type = other DNA
ctgaggtggaagcatcgctt

SEQ ID NO: 13519 - DNA, 20 bp, synthetic construct
  misc_feature 1..20: note = CRISPR gRNA sequence
  source 1..20: mol_type = other DNA
gtggaagcatcgcttgagcc

SEQ ID NO: 13520 - DNA, 20 bp, synthetic construct
  misc_feature 1..20: note = CRISPR gRNA sequence
  source 1..20: mol_type = other DNA
tggaagcatcgcttgagccc

SEQ ID NO: 13521 - DNA, 20 bp, synthetic construct
  misc_feature 1..20: note = CRISPR gRNA sequence
  source 1..20: mol_type = other DNA
gaagcatcgcttgagcccag

SEQ ID NO: 13522 - DNA, 20 bp, synthetic construct
  misc_feature 1..20: note = CRISPR gRNA sequence
  source 1..20: mol_type = other DNA
aagcatcgcttgagcccagg

SEQ ID NO: 13523 - DNA, 20 bp, synthetic construct
  misc_feature 1..20: note = CRISPR gRNA sequence
  source 1..20: mol_type = other DNA
catcgcttgagcccaggagg

SEQ ID NO: 13524 - DNA, 20 bp, synthetic construct
  misc_feature 1..20: note = CRISPR gRNA sequence
  source 1..20: mol_type = other DNA
tcgcttgagcccaggaggtg

SEQ ID NO: 13525 - DNA, 20 bp, synthetic construct
  misc_feature 1..20: note = CRISPR gRNA sequence
  source 1..20: mol_type = other DNA
cgcttgagcccaggaggtgg

SEQ ID NO: 13526 - DNA, 20 bp, synthetic construct
  misc_feature 1..20: note = CRISPR gRNA sequence
  source 1..20: mol_type = other DNA
agcccaggaggtggaggatg

SEQ ID NO: 13527 - DNA, 20 bp, synthetic construct
  misc_feature 1..20: note = CRISPR gRNA sequence
  source 1..20: mol_type = other DNA
caggaggtggaggatgcagt

SEQ ID NO: 13528 - DNA, 20 bp, synthetic construct
  misc_feature 1..20: note = CRISPR gRNA sequence
  source 1..20: mol_type = other DNA
atgatcacaccactgcactc

SEQ ID NO: 13529 - DNA, 20 bp, synthetic construct
  misc_feature 1..20: note = CRISPR gRNA sequence
  source 1..20: mol_type = other DNA
cacaccactgcactccagcc

SEQ ID NO: 13530 - DNA, 20 bp, synthetic construct
  misc_feature 1..20: note = CRISPR gRNA sequence
  source 1..20: mol_type = other DNA
acaccactgcactccagcct

SEQ ID NO: 13531 - DNA, 20 bp, synthetic construct
  misc_feature 1..20: note = CRISPR gRNA sequence
  source 1..20: mol_type = other DNA
cactgcactccagcctgggt

SEQ ID NO: 13532 - DNA, 20 bp, synthetic construct
  misc_feature 1..20: note = CRISPR gRNA sequence
  source 1..20: mol_type = other DNA
ctgcactccagcctgggtaa

SEQ ID NO: 13533 - DNA, 20 bp, synthetic construct
  misc_feature 1..20: note = CRISPR gRNA sequence
  source 1..20: mol_type = other DNA
actccagcctgggtaagagc

SEQ ID NO: 13534 - DNA, 20 bp, synthetic construct
  misc_feature 1..20: note = CRISPR gRNA sequence
  source 1..20: mol_type = other DNA
agcgagaccctgtctcaaaa

SEQ ID NO: 13535 - DNA, 20 bp, synthetic construct
  misc_feature 1..20: note = CRISPR gRNA sequence
  source 1..20: mol_type = other DNA
aaaaagaaaaaaaacaaaaa

SEQ ID NO: 13536 - DNA, 20 bp, synthetic construct
  misc_feature 1..20: note = CRISPR gRNA sequence
  source 1..20: mol_type = other DNA
gaaaaaaaacaaaaaaagaa

SEQ ID NO: 13537 - DNA, 20 bp, synthetic construct
  misc_feature 1..20: note = CRISPR gRNA sequence
  source 1..20: mol_type = other DNA
aaacaaaaaaagaaaagaaa

SEQ ID NO: 13538 - DNA, 20 bp, synthetic construct
  misc_feature 1..20: note = CRISPR gRNA sequence
  source 1..20: mol_type = other DNA
acaaaaaaagaaaagaaaaa

SEQ ID NO: 13539 - DNA, 20 bp, synthetic construct
  misc_feature 1..20: note = CRISPR gRNA sequence
  source 1..20: mol_type = other DNA
caaaaaaagaaaagaaaaag

SEQ ID NO: 13540 - DNA, 20 bp, synthetic construct
  misc_feature 1..20: note = CRISPR gRNA sequence
  source 1..20: mol_type = other DNA
aaaagaaaagaaaaagaggt

SEQ ID NO: 13541 - DNA, 20 bp, synthetic construct
  misc_feature 1..20: note = CRISPR gRNA sequence
  source 1..20: mol_type = other DNA
gaaaagaaaaagaggtaagt

SEQ ID NO: 13542 - DNA, 20 bp, synthetic construct
  misc_feature 1..20: note = CRISPR gRNA sequence
  source 1..20: mol_type = other DNA
aaaagaaaaagaggtaagtt

SEQ ID NO: 13543 - DNA, 20 bp, synthetic construct
  misc_feature 1..20: note = CRISPR gRNA sequence
  source 1..20: mol_type = other DNA
ggtaagttgggctcccatct

SEQ ID NO: 13544 - DNA, 20 bp, synthetic construct
  misc_feature 1..20: note = CRISPR gRNA sequence
  source 1..20: mol_type = other DNA
gtaagttgggctcccatctt

SEQ ID NO: 13545 - DNA, 20 bp, synthetic construct
  misc_feature 1..20: note = CRISPR gRNA sequence
  source 1..20: mol_type = other DNA
taagttgggctcccatcttg

SEQ ID NO: 13546 - DNA, 20 bp, synthetic construct
  misc_feature 1..20: note = CRISPR gRNA sequence
  source 1..20: mol_type = other DNA
gctcccatcttggggctccc

SEQ ID NO: 13547 - DNA, 20 bp, synthetic construct
  misc_feature 1..20: note = CRISPR gRNA sequence
  source 1..20: mol_type = other DNA
gctccccagcttttgtctct

SEQ ID NO: 13548 - DNA, 20 bp, synthetic construct
  misc_feature 1..20: note = CRISPR gRNA sequence
  source 1..20: mol_type = other DNA
ccccagcttttgtctctaag

SEQ ID NO: 13549 - DNA, 20 bp, synthetic construct
  misc_feature 1..20: note = CRISPR gRNA sequence
  source 1..20: mol_type = other DNA
cccagcttttgtctctaagt

SEQ ID NO: 13550 - DNA, 20 bp, synthetic construct
  misc_feature 1..20: note = CRISPR gRNA sequence
  source 1..20: mol_type = other DNA
ccagcttttgtctctaagta

SEQ ID NO: 13551 - DNA, 20 bp, synthetic construct
  misc_feature 1..20: note = CRISPR gRNA sequence
  source 1..20: mol_type = other DNA
agcttttgtctctaagtagg

SEQ ID NO: 13552 - DNA, 20 bp, synthetic construct
  misc_feature 1..20: note = CRISPR gRNA sequence
  source 1..20: mol_type = other DNA
tttgtctctaagtagggagc

SEQ ID NO: 13553 - DNA, 20 bp, synthetic construct
  misc_feature 1..20: note = CRISPR gRNA sequence
  source 1..20: mol_type = other DNA
cttactcttcccaacatcca

SEQ ID NO: 13554 - DNA, 20 bp, synthetic construct
  misc_feature 1..20: note = CRISPR gRNA sequence
  source 1..20: mol_type = other DNA
cagatacccttctcccgccg

SEQ ID NO: 13555 - DNA, 20 bp, synthetic construct
  misc_feature 1..20: note = CRISPR gRNA sequence
  source 1..20: mol_type = other DNA
acccttctcccgccgcagcc

SEQ ID NO: 13556 - DNA, 20 bp, synthetic construct
  misc_feature 1..20: note = CRISPR gRNA sequence
  source 1..20: mol_type = other DNA
cccttctcccgccgcagcct

SEQ ID NO: 13557 - DNA, 20 bp, synthetic construct
  misc_feature 1..20: note = CRISPR gRNA sequence
  source 1..20: mol_type = other DNA
ccttctcccgccgcagcctg

SEQ ID NO: 13558 - DNA, 20 bp, synthetic construct
  misc_feature 1..20: note = CRISPR gRNA sequence
  source 1..20: mol_type = other DNA
tctcccgccgcagcctgggg

SEQ ID NO: 13559 - DNA, 20 bp, synthetic construct
  misc_feature 1..20: note = CRISPR gRNA sequence
  source 1..20: mol_type = other DNA
ctcccgccgcagcctgggga

SEQ ID NO: 13560 - DNA, 20 bp, synthetic construct
  misc_feature 1..20: note = CRISPR gRNA sequence
  source 1..20: mol_type = other DNA
tcccgccgcagcctggggaa

SEQ ID NO: 13561 - DNA, 20 bp, synthetic construct
  misc_feature 1..20: note = CRISPR gRNA sequence
  source 1..20: mol_type = other DNA
cccgccgcagcctggggaag

SEQ ID NO: 13562 - DNA, 20 bp, synthetic construct
  misc_feature 1..20: note = CRISPR gRNA sequence
  source 1..20: mol_type = other DNA
gggaaggggtcctgaaatgc

SEQ ID NO: 13563 - DNA, 20 bp, synthetic construct
  misc_feature 1..20: note = CRISPR gRNA sequence
  source 1..20: mol_type = other DNA
tgccagctgacgaccactgc

SEQ ID NO: 13564 - DNA, 20 bp, synthetic construct
  misc_feature 1..20: note = CRISPR gRNA sequence
  source 1..20: mol_type = other DNA
cagctgacgaccactgccag

SEQ ID NO: 13565 - DNA, 20 bp, synthetic construct
  misc_feature 1..20: note = CRISPR gRNA sequence
  source 1..20: mol_type = other DNA
gaccactgccagtggtaaac

SEQ ID NO: 13566 - DNA, 20 bp, synthetic construct
  misc_feature 1..20: note = CRISPR gRNA sequence
  source 1..20: mol_type = other DNA
accactgccagtggtaaacc

SEQ ID NO: 13567 - DNA, 20 bp, synthetic construct
  misc_feature 1..20: note = CRISPR gRNA sequence
  source 1..20: mol_type = other DNA
actgccagtggtaaaccagg

SEQ ID NO: 13568 - DNA, 20 bp, synthetic construct
  misc_feature 1..20: note = CRISPR gRNA sequence
  source 1..20: mol_type = other DNA
cctttgcattttaataacaa

SEQ ID NO: 13569 - DNA, 20 bp, synthetic construct
  misc_feature 1..20: note = CRISPR gRNA sequence
  source 1..20: mol_type = other DNA
ctttgcattttaataacaaa

SEQ ID NO: 13570 - DNA, 20 bp, synthetic construct
  misc_feature 1..20: note = CRISPR gRNA sequence
  source 1..20: mol_type = other DNA
aacaaaaggaaccatttgtt

SEQ ID NO: 13571 - DNA, 20 bp, synthetic construct
  misc_feature 1..20: note = CRISPR gRNA sequence
  source 1..20: mol_type = other DNA
atttgttgagcatttattat

SEQ ID NO: 13572 - DNA, 20 bp, synthetic construct
  misc_feature 1..20: note = CRISPR gRNA sequence
  source 1..20: mol_type = other DNA
gttgagcatttattataagc

SEQ ID NO: 13573 - DNA, 20 bp, synthetic construct
  misc_feature 1..20: note = CRISPR gRNA sequence
  source 1..20: mol_type = other DNA
ttgagcatttattataagcc

SEQ ID NO: 13574 - DNA, 20 bp, synthetic construct
  misc_feature 1..20: note = CRISPR gRNA sequence
  source 1..20: mol_type = other DNA
tgagcatttattataagcca

SEQ ID NO: 13575 - DNA, 20 bp, synthetic construct
  misc_feature 1..20: note = CRISPR gRNA sequence
  source 1..20: mol_type = other DNA
gagcatttattataagccag

SEQ ID NO: 13576 - DNA, 20 bp, synthetic construct
  misc_feature 1..20: note = CRISPR gRNA sequence
  source 1..20: mol_type = other DNA
attataagccaggggcatgc

SEQ ID NO: 13577 - DNA, 20 bp, synthetic construct
  misc_feature 1..20: note = CRISPR gRNA sequence
  source 1..20: mol_type = other DNA
ttataagccaggggcatgct

SEQ ID NO: 13578 - DNA, 20 bp, synthetic construct
  misc_feature 1..20: note = CRISPR gRNA sequence
  source 1..20: mol_type = other DNA
ggcatgctaggcccttccct

SEQ ID NO: 13579 - DNA, 20 bp, synthetic construct
  misc_feature 1..20: note = CRISPR gRNA sequence
  source 1..20: mol_type = other DNA
gctaggcccttccctcggcc

SEQ ID NO: 13580 - DNA, 20 bp, synthetic construct
  misc_feature 1..20: note = CRISPR gRNA sequence
  source 1..20: mol_type = other DNA
ctagatctcatttactcctc

SEQ ID NO: 13581 - DNA, 20 bp, synthetic construct
  misc_feature 1..20: note = CRISPR gRNA sequence
  source 1..20: mol_type = other DNA
catttactcctcaagactct

SEQ ID NO: 13582 - DNA, 20 bp, synthetic construct
  misc_feature 1..20: note = CRISPR gRNA sequence
  source 1..20: mol_type = other DNA
ctcctcaagactctgagcta

SEQ ID NO: 13583 - DNA, 20 bp, synthetic construct
  misc_feature 1..20: note = CRISPR gRNA sequence
  source 1..20: mol_type = other DNA
tcctcaagactctgagctat

SEQ ID NO: 13584 - DNA, 20 bp, synthetic construct
  misc_feature 1..20: note = CRISPR gRNA sequence
  source 1..20: mol_type = other DNA
tcttatctccattttacata

SEQ ID NO: 13585 - DNA, 20 bp, synthetic construct
  misc_feature 1..20: note = CRISPR gRNA sequence
  source 1..20: mol_type = other DNA
cttatctccattttacatat

SEQ ID NO: 13586 - DNA, 20 bp, synthetic construct
  misc_feature 1..20: note = CRISPR gRNA sequence
  source 1..20: mol_type = other DNA
ttatctccattttacatata

SEQ ID NO: 13587 - DNA, 20 bp, synthetic construct
  misc_feature 1..20: note = CRISPR gRNA sequence
  source 1..20: mol_type = other DNA
attttacatatagggaaact

SEQ ID NO: 13588 - DNA, 20 bp, synthetic construct
  misc_feature 1..20: note = CRISPR gRNA sequence
  source 1..20: mol_type = other DNA
ttttacatatagggaaactg

SEQ ID NO: 13589 - DNA, 20 bp, synthetic construct
  misc_feature 1..20: note = CRISPR gRNA sequence
  source 1..20: mol_type = other DNA
atatagggaaactgaggcac

SEQ ID NO: 13590 - DNA, 20 bp, synthetic construct
  misc_feature 1..20: note = CRISPR gRNA sequence
  source 1..20: mol_type = other DNA
tatagggaaactgaggcact

SEQ ID NO: 13591 - DNA, 20 bp, synthetic construct
  misc_feature 1..20: note = CRISPR gRNA sequence
  source 1..20: mol_type = other DNA
tgaggcactaggcgatcaaa

SEQ ID NO: 13592 - DNA, 20 bp, synthetic construct
  misc_feature 1..20: note = CRISPR gRNA sequence
  source 1..20: mol_type = other DNA
aggcgatcaaatagctcaca

SEQ ID NO: 13593 - DNA, 20 bp, synthetic construct
  misc_feature 1..20: note = CRISPR gRNA sequence
  source 1..20: mol_type = other DNA
ggcgatcaaatagctcacac

SEQ ID NO: 13594 - DNA, 20 bp, synthetic construct
  misc_feature 1..20: note = CRISPR gRNA sequence
  source 1..20: mol_type = other DNA
gcgatcaaatagctcacaca

SEQ ID NO: 13595 - DNA, 20 bp, synthetic construct
  misc_feature 1..20: note = CRISPR gRNA sequence
  source 1..20: mol_type = other DNA
atagctcacacagggtcaca

SEQ ID NO: 13596 - DNA, 20 bp, synthetic construct
  misc_feature 1..20: note = CRISPR gRNA sequence
  source 1..20: mol_type = other DNA
tcacacagggtcacacagcc

SEQ ID NO: 13597 - DNA, 20 bp, synthetic construct
  misc_feature 1..20: note = CRISPR gRNA sequence
  source 1..20: mol_type = other DNA
acacagcctggatcaacatt

SEQ ID NO: 13598 - DNA, 20 bp, synthetic construct
  misc_feature 1..20: note = CRISPR gRNA sequence
  source 1..20: mol_type = other DNA
acagcctggatcaacattta

SEQ ID NO: 13599 - DNA, 20 bp, synthetic construct
  misc_feature 1..20: note = CRISPR gRNA sequence
  source 1..20: mol_type = other DNA
gcctggatcaacatttagag

SEQ ID NO: 13600 - DNA, 20 bp, synthetic construct
  misc_feature 1..20: note = CRISPR gRNA sequence
  source 1..20: mol_type = other DNA
caacatttagagcagacttc

SEQ ID NO: 13601 - DNA, 20 bp, synthetic construct
  misc_feature 1..20: note = CRISPR gRNA sequence
  source 1..20: mol_type = other DNA
aacatttagagcagacttca

SEQ ID NO: 13602 - DNA, 20 bp, synthetic construct
  misc_feature 1..20: note = CRISPR gRNA sequence
  source 1..20: mol_type = other DNA
acatttagagcagacttcaa

SEQ ID NO: 13603 - DNA, 20 bp, synthetic construct
  misc_feature 1..20: note = CRISPR gRNA sequence
  source 1..20: mol_type = other DNA
catttagagcagacttcaag

SEQ ID NO: 13604 - DNA, 20 bp, synthetic construct
  misc_feature 1..20: note = CRISPR gRNA sequence
  source 1..20: mol_type = other DNA
agagcagacttcaaggggat

SEQ ID NO: 13605 - DNA, 20 bp, synthetic construct
  misc_feature 1..20: note = CRISPR gRNA sequence
  source 1..20: mol_type = other DNA
ttcaaggggatgagaaaaat

SEQ ID NO: 13606 - DNA, 20 bp, synthetic construct
  misc_feature 1..20: note = CRISPR gRNA sequence
  source 1..20: mol_type = other DNA
tcaaggggatgagaaaaata

SEQ ID NO: 13607 - DNA, 20 bp, synthetic construct
  misc_feature 1..20: note = CRISPR gRNA sequence
  source 1..20: mol_type = other DNA
tgagaaaaataaggacaacg

SEQ ID NO: 13608 - DNA, 20 bp, synthetic construct
  misc_feature 1..20: note = CRISPR gRNA sequence
  source 1..20: mol_type = other DNA
gagaaaaataaggacaacga

SEQ ID NO: 13609 - DNA, 20 bp, synthetic construct
  misc_feature 1..20: note = CRISPR gRNA sequence
  source 1..20: mol_type = other DNA
agaaaaataaggacaacgaa

SEQ ID NO: 13610 - DNA, 20 bp, synthetic construct
  misc_feature 1..20: note = CRISPR gRNA sequence
  source 1..20: mol_type = other DNA
aaggacaacgaagggccgtt

SEQ ID NO: 13611 - DNA, 20 bp, synthetic construct
  misc_feature 1..20: note = CRISPR gRNA sequence
  source 1..20: mol_type = other DNA
ggccgtttagtttaaaaata

SEQ ID NO: 13612 - DNA, 20 bp, synthetic construct
  misc_feature 1..20: note = CRISPR gRNA sequence
  source 1..20: mol_type = other DNA
ggttaaatgcattccatata

SEQ ID NO: 13613 - DNA, 20 bp, synthetic construct
  misc_feature 1..20: note = CRISPR gRNA sequence
  source 1..20: mol_type = other DNA
ttaaatgcattccatataaa

SEQ ID NO: 13614 - DNA, 20 bp, synthetic construct
  misc_feature 1..20: note = CRISPR gRNA sequence
  source 1..20: mol_type = other DNA
cctttgaactttttcaatat

SEQ ID NO: 13615 - DNA, 20 bp, synthetic construct
  misc_feature 1..20: note = CRISPR gRNA sequence
  source 1..20: mol_type = other DNA
atattagaatgatcattctt

SEQ ID NO: 13616 - DNA, 20 bp, synthetic construct
  misc_feature 1..20: note = CRISPR gRNA sequence
  source 1..20: mol_type = other DNA
atcattctttggtaaaatta

SEQ ID NO: 13617 - DNA, 20 bp, synthetic construct
  misc_feature 1..20: note = CRISPR gRNA sequence
  source 1..20: mol_type = other DNA
ctttggtaaaattatggtgc

SEQ ID NO: 13618 - DNA, 20 bp, synthetic construct
  misc_feature 1..20: note = CRISPR gRNA sequence
  source 1..20: mol_type = other DNA
tggtaaaattatggtgccag

SEQ ID NO: 13619 - DNA, 20 bp, synthetic construct
  misc_feature 1..20: note = CRISPR gRNA sequence
  source 1..20: mol_type = other DNA
taaaattatggtgccagcag

SEQ ID NO: 13620 - DNA, 20 bp, synthetic construct
  misc_feature 1..20: note = CRISPR gRNA sequence
  source 1..20: mol_type = other DNA
aaaattatggtgccagcagt

SEQ ID NO: 13621 - DNA, 20 bp, synthetic construct
  misc_feature 1..20: note = CRISPR gRNA sequence
  source 1..20: mol_type = other DNA
tgttatttgtttgtttgaat

SEQ ID NO: 13622 - DNA, 20 bp, synthetic construct
  misc_feature 1..20: note = CRISPR gRNA sequence
  source 1..20: mol_type = other DNA
ccttgataaacattaaaaaa

SEQ ID NO: 13623 - DNA, 20 bp, synthetic construct
  misc_feature 1..20: note = CRISPR gRNA sequence
  source 1..20: mol_type = other DNA
taaaaaacagtaaccgcgca

SEQ ID NO: 13624 - DNA, 20 bp, synthetic construct
  misc_feature 1..20: note = CRISPR gRNA sequence
  source 1..20: mol_type = other DNA
aattcattccgaaatgttct

SEQ ID NO: 13625 - DNA, 20 bp, synthetic construct
  misc_feature 1..20: note = CRISPR gRNA sequence
  source 1..20: mol_type = other DNA
tctcggcctctgaaatcctg

SEQ ID NO: 13626 - DNA, 20 bp, synthetic construct
  misc_feature 1..20: note = CRISPR gRNA sequence
  source 1..20: mol_type = other DNA
cctctgaaatcctgaagtct

SEQ ID NO: 13627 - DNA, 20 bp, synthetic construct
  misc_feature 1..20: note = CRISPR gRNA sequence
  source 1..20: mol_type = other DNA
atcctgaagtctgagaacac

SEQ ID NO: 13628 - DNA, 20 bp, synthetic construct
  misc_feature 1..20: note = CRISPR gRNA sequence
  source 1..20: mol_type = other DNA
aagtctgagaacactggcct

SEQ ID NO: 13629 - DNA, 20 bp, synthetic construct
  misc_feature 1..20: note = CRISPR gRNA sequence
  source 1..20: mol_type = other DNA
gagaacactggcctcagcaa

SEQ ID NO: 13630 - DNA, 20 bp, synthetic construct
  misc_feature 1..20: note = CRISPR gRNA sequence
  source 1..20: mol_type = other DNA
agaacactggcctcagcaaa

SEQ ID NO: 13631 - DNA, 20 bp, synthetic construct
  misc_feature 1..20: note = CRISPR gRNA sequence
  source 1..20: mol_type = other DNA
ctggcctcagcaaaaggcca

SEQ ID NO: 13632 - DNA, 20 bp, synthetic construct
  misc_feature 1..20: note = CRISPR gRNA sequence
  source 1..20: mol_type = other DNA
tggcctcagcaaaaggccac

SEQ ID NO: 13633 - DNA, 20 bp, synthetic construct
  misc_feature 1..20: note = CRISPR gRNA sequence
  source 1..20: mol_type = other DNA
tcagcaaaaggccacaggat

SEQ ID NO: 13634 - DNA, 20 bp, synthetic construct
  misc_feature 1..20: note = CRISPR gRNA sequence
  source 1..20: mol_type = other DNA
agcaaaaggccacaggatca

SEQ ID NO: 13635 - DNA, 20 bp, synthetic construct
  misc_feature 1..20: note = CRISPR gRNA sequence
  source 1..20: mol_type = other DNA
acaggatcagagtttgactc

SEQ ID NO: 13636 - DNA, 20 bp, synthetic construct
  misc_feature 1..20: note = CRISPR gRNA sequence
  source 1..20: mol_type = other DNA
caggatcagagtttgactcc

SEQ ID NO: 13637 - DNA, 20 bp, synthetic construct
  misc_feature 1..20: note = CRISPR gRNA sequence
  source 1..20: mol_type = other DNA
cagagtttgactccaggatc

SEQ ID NO: 13638 - DNA, 20 bp, synthetic construct
  misc_feature 1..20: note = CRISPR gRNA sequence
  source 1..20: mol_type = other DNA
tgactccaggatctggcatt

SEQ ID NO: 13639 - DNA, 20 bp, synthetic construct
  misc_feature 1..20: note = CRISPR gRNA sequence
  source 1..20: mol_type = other DNA
tggcatttggctccctgcta

SEQ ID NO: 13640 - DNA, 20 bp, synthetic construct
  misc_feature 1..20: note = CRISPR gRNA sequence
  source 1..20: mol_type = other DNA
ggcatttggctccctgctaa

SEQ ID NO: 13641 - DNA, 20 bp, synthetic construct
  misc_feature 1..20: note = CRISPR gRNA sequence
  source 1..20: mol_type = other DNA
tggctccctgctaaaggcct

SEQ ID NO: 13642 - DNA, 20 bp, synthetic construct
  misc_feature 1..20: note = CRISPR gRNA sequence
  source 1..20: mol_type = other DNA
tggcaaatcccttcaccctt

SEQ ID NO: 13643 - DNA, 20 bp, synthetic construct
  misc_feature 1..20: note = CRISPR gRNA sequence
  source 1..20: mol_type = other DNA
aatatttcaccccaatctta

SEQ ID NO: 13644 - DNA, 20 bp, synthetic construct
  misc_feature 1..20: note = CRISPR gRNA sequence
  source 1..20: mol_type = other DNA
atatttcaccccaatcttat

SEQ ID NO: 13645 - DNA, 20 bp, synthetic construct
  misc_feature 1..20: note = CRISPR gRNA sequence
  source 1..20: mol_type = other DNA
tatttcaccccaatcttatg

SEQ ID NO: 13646 - DNA, 20 bp, synthetic construct
  misc_feature 1..20: note = CRISPR gRNA sequence
  source 1..20: mol_type = other DNA
atttcaccccaatcttatgg

SEQ ID NO: 13647 - DNA, 20 bp, synthetic construct
  misc_feature 1..20: note = CRISPR gRNA sequence
  source 1..20: mol_type = other DNA
cccaatcttatgggggttct

SEQ ID NO: 13648 - DNA, 20 bp, synthetic construct
  misc_feature 1..20: note = CRISPR gRNA sequence
  source 1..20: mol_type = other DNA
cttatgggggttcttggatt

SEQ ID NO: 13649 - DNA, 20 bp, synthetic construct
  misc_feature 1..20: note = CRISPR gRNA sequence
  source 1..20: mol_type = other DNA
ttatgggggttcttggatta

SEQ ID NO: 13650 - DNA, 20 bp, synthetic construct
  misc_feature 1..20: note = CRISPR gRNA sequence
  source 1..20: mol_type = other DNA
accgcttgcctactatgtgc

SEQ ID NO: 13651 - DNA, 20 bp, synthetic construct
  misc_feature 1..20: note = CRISPR gRNA sequence
  source 1..20: mol_type = other DNA
ccgcttgcctactatgtgcc

SEQ ID NO: 13652 - DNA, 20 bp, synthetic construct
  misc_feature 1..20: note = CRISPR gRNA sequence
  source 1..20: mol_type = other DNA
tgcctactatgtgccaggcc

SEQ ID NO: 13653 - DNA, 20 bp, synthetic construct
  misc_feature 1..20: note = CRISPR gRNA sequence
  source 1..20: mol_type = other DNA
gcctactatgtgccaggccc

SEQ ID NO: 13654 - DNA, 20 bp, synthetic construct
  misc_feature 1..20: note = CRISPR gRNA sequence
  source 1..20: mol_type = other DNA
cctactatgtgccaggccca

SEQ ID NO: 13655 - DNA, 20 bp, synthetic construct
  misc_feature 1..20: note = CRISPR gRNA sequence
  source 1..20: mol_type = other DNA
tactatgtgccaggcccagg

SEQ ID NO: 13656 - DNA, 20 bp, synthetic construct
  misc_feature 1..20: note = CRISPR gRNA sequence
  source 1..20: mol_type = other DNA
actatgtgccaggcccaggg

SEQ ID NO: 13657 - DNA, 20 bp, synthetic construct
  misc_feature 1..20: note = CRISPR gRNA sequence
  source 1..20: mol_type = other DNA
tgtgccaggcccagggagga

SEQ ID NO: 13658 - DNA, 20 bp, synthetic construct
  misc_feature 1..20: note = CRISPR gRNA sequence
  source 1..20: mol_type = other DNA
aggcccagggaggaaagttg

SEQ ID NO: 13659 - DNA, 20 bp, synthetic construct
  misc_feature 1..20: note = CRISPR gRNA sequence
  source 1..20: mol_type = other DNA
ggcccagggaggaaagttgt

SEQ ID NO: 13660 - DNA, 20 bp, synthetic construct
  misc_feature 1..20: note = CRISPR gRNA sequence
  source 1..20: mol_type = other DNA
gaggaaagttgtgggccaaa

SEQ ID NO: 13661 - DNA, 20 bp, synthetic construct
  misc_feature 1..20: note = CRISPR gRNA sequence
  source 1..20: mol_type = other DNA
agacgaaaatccctgccttc

SEQ ID NO: 13662 - DNA, 20 bp, synthetic construct
  misc_feature 1..20: note = CRISPR gRNA sequence
  source 1..20: mol_type = other DNA
gacgaaaatccctgccttct

SEQ ID NO: 13663 - DNA, 20 bp, synthetic construct
  misc_feature 1..20: note = CRISPR gRNA sequence
  source 1..20: mol_type = other DNA
ccttctgggtgctgacattc

SEQ ID NO: 13664 - DNA, 20 bp, synthetic construct
  misc_feature 1..20: note = CRISPR gRNA sequence
  source 1..20: mol_type = other DNA
cttctgggtgctgacattcc

SEQ ID NO: 13665 - DNA, 20 bp, synthetic construct
  misc_feature 1..20: note = CRISPR gRNA sequence
  source 1..20: mol_type = other DNA
ttctgggtgctgacattcca

SEQ ID NO: 13666 - DNA, 20 bp, synthetic construct
  misc_feature 1..20: note = CRISPR gRNA sequence
  source 1..20: mol_type = other DNA
tctgggtgctgacattccag

SEQ ID NO: 13667 - DNA, 20 bp, synthetic construct
  misc_feature 1..20: note = CRISPR gRNA sequence
  source 1..20: mol_type = other DNA
ctgggtgctgacattccagg

SEQ ID NO: 13668 - DNA, 20 bp, synthetic construct
  misc_feature 1..20: note = CRISPR gRNA sequence
  source 1..20: mol_type = other DNA
tgggtgctgacattccaggg

SEQ ID NO: 13669 - DNA, 20 bp, synthetic construct
  misc_feature 1..20: note = CRISPR gRNA sequence
  source 1..20: mol_type = other DNA
gtgctgacattccagggggg

SEQ ID NO: 13670 - DNA, 20 bp, synthetic construct
  misc_feature 1..20: note = CRISPR gRNA sequence
  source 1..20: mol_type = other DNA
tgacattccaggggggaaga

SEQ ID NO: 13671 - DNA, 20 bp, synthetic construct
  misc_feature 1..20: note = CRISPR gRNA sequence
  source 1..20: mol_type = other DNA
attccaggggggaagataga

SEQ ID NO: 13672 - DNA, 20 bp, synthetic construct
  misc_feature 1..20: note = CRISPR gRNA sequence
  source 1..20: mol_type = other DNA
ggaagatagacagataatca

SEQ ID NO: 13673 - DNA, 20 bp, synthetic construct
  misc_feature 1..20: note = CRISPR gRNA sequence
  source 1..20: mol_type = other DNA
agacagataatcaaagaaat

SEQ ID NO: 13674 - DNA, 20 bp, synthetic construct
  misc_feature 1..20: note = CRISPR gRNA sequence
  source 1..20: mol_type = other DNA
agataatcaaagaaatcgga

SEQ ID NO: 13675 - DNA, 20 bp, synthetic construct
  misc_feature 1..20: note = CRISPR gRNA sequence
  source 1..20: mol_type = other DNA
aatcaaagaaatcggaaagc

SEQ ID NO: 13676 - DNA, 20 bp, synthetic construct
  misc_feature 1..20: note = CRISPR gRNA sequence
  source 1..20: mol_type = other DNA
cggaaagcaagctgatgtct

SEQ ID NO: 13677 - DNA, 20 bp, synthetic construct
  misc_feature 1..20: note = CRISPR gRNA sequence
  source 1..20: mol_type = other DNA
gtctgagacaatgaatcata

SEQ ID NO: 13678 - DNA, 20 bp, synthetic construct
  misc_feature 1..20: note = CRISPR gRNA sequence
  source 1..20: mol_type = other DNA
atgaatcatatggaaatata

SEQ ID NO: 13679 - DNA, 20 bp, synthetic construct
  misc_feature 1..20: note = CRISPR gRNA sequence
  source 1..20: mol_type = other DNA
aatcatatggaaatatacag

SEQ ID NO: 13680 - DNA, 20 bp, synthetic construct
  misc_feature 1..20: note = CRISPR gRNA sequence
  source 1..20: mol_type = other DNA
atatggaaatatacagtggt

SEQ ID NO: 13681 - DNA, 20 bp, synthetic construct
  misc_feature 1..20: note = CRISPR gRNA sequence
  source 1..20: mol_type = other DNA
tatggaaatatacagtggtg

SEQ ID NO: 13682 - DNA, 20 bp, synthetic construct
  misc_feature 1..20: note = CRISPR gRNA sequence
  source 1..20: mol_type = other DNA
atggaaatatacagtggtga

SEQ ID NO: 13683 - DNA, 20 bp, synthetic construct
  misc_feature 1..20: note = CRISPR gRNA sequence
  source 1..20: mol_type = other DNA
tggaaatatacagtggtgag

SEQ ID NO: 13684 - DNA, 20 bp, synthetic construct
  misc_feature 1..20: note = CRISPR gRNA sequence
  source 1..20: mol_type = other DNA
ggaaatatacagtggtgagg

SEQ ID NO: 13685 - DNA, 20 bp, synthetic construct
  misc_feature 1..20: note = CRISPR gRNA sequence
  source 1..20: mol_type = other DNA
atatacagtggtgaggggga

SEQ ID NO: 13686 - DNA, 20 bp, synthetic construct
  misc_feature 1..20: note = CRISPR gRNA sequence
  source 1..20: mol_type = other DNA
atacagtggtgagggggatg

SEQ ID NO: 13687 - DNA, 20 bp, synthetic construct
  misc_feature 1..20: note = CRISPR gRNA sequence
  source 1..20: mol_type = other DNA
ggagttttttttttaaccat

SEQ ID NO: 13688 - DNA, 20 bp, synthetic construct
  misc_feature 1..20: note = CRISPR gRNA sequence
  source 1..20: mol_type = other DNA
gagttttttttttaaccatg

SEQ ID NO: 13689 - DNA, 20 bp, synthetic construct
  misc_feature 1..20: note = CRISPR gRNA sequence
  source 1..20: mol_type = other DNA
agttttttttttaaccatga

SEQ ID NO: 13690 - DNA, 20 bp, synthetic construct
  misc_feature 1..20: note = CRISPR gRNA sequence
  source 1..20: mol_type = other DNA
gttttttttttaaccatgag

SEQ ID NO: 13691 - DNA, 20 bp, synthetic construct
  misc_feature 1..20: note = CRISPR gRNA sequence
  source 1..20: mol_type = other DNA
ttttttaaccatgaggggaa

SEQ ID NO: 13692 - DNA, 20 bp, synthetic construct
  misc_feature 1..20: note = CRISPR gRNA sequence
  source 1..20: mol_type = other DNA
ttttaaccatgaggggaatg

SEQ ID NO: 13693 - DNA, 20 bp, synthetic construct
  misc_feature 1..20: note = CRISPR gRNA sequence
  source 1..20: mol_type = other DNA
ttatttatttatttattttt

SEQ ID NO: 13694 - DNA, 20 bp, synthetic construct
  misc_feature 1..20: note = CRISPR gRNA sequence
  source 1..20: mol_type = other DNA
ttatttatttatttttgaga

SEQ ID NO: 13695 - DNA, 20 bp, synthetic construct
  misc_feature 1..20: note = CRISPR gRNA sequence
  source 1..20: mol_type = other DNA
tatttatttatttttgagat

SEQ ID NO: 13696 - DNA, 20 bp, synthetic construct
  misc_feature 1..20: note = CRISPR gRNA sequence
  source 1..20: mol_type = other DNA
atttatttatttttgagatg

SEQ ID NO: 13697 - DNA, 20 bp, synthetic construct
  misc_feature 1..20: note = CRISPR gRNA sequence
  source 1..20: mol_type = other DNA
ggggtctcactctgtcatcc

SEQ ID NO: 13698 - DNA, 20 bp, synthetic construct
  misc_feature 1..20: note = CRISPR gRNA sequence
  source 1..20: mol_type = other DNA
tctcactctgtcatccaagc

SEQ ID NO: 13699 - DNA, 20 bp, synthetic construct
  misc_feature 1..20: note = CRISPR gRNA sequence
  source 1..20: mol_type = other DNA
ctgtcatccaagctggactg

SEQ ID NO: 13700 - DNA, 20 bp, synthetic construct
  misc_feature 1..20: note = CRISPR gRNA sequence
  source 1..20: mol_type = other DNA
tcatccaagctggactgcag

SEQ ID NO: 13701 - DNA, 20 bp, synthetic construct
  misc_feature 1..20: note = CRISPR gRNA sequence
  source 1..20: mol_type = other DNA
ggactgcagtggcgtgatct

SEQ ID NO: 13702 - DNA, 20 bp, synthetic construct
  misc_feature 1..20: note = CRISPR gRNA sequence
  source 1..20: mol_type = other DNA
tcaccgcaacctccgcctcc

SEQ ID NO: 13703 - DNA, 20 bp, synthetic construct
  misc_feature 1..20: note = CRISPR gRNA sequence
  source 1..20: mol_type = other DNA
ttcaaatgattctcctgcct

SEQ ID NO: 13704 - DNA, 20 bp, synthetic construct
  misc_feature 1..20: note = CRISPR gRNA sequence
  source 1..20: mol_type = other DNA
ttctcctgcctcagcctccc

SEQ ID NO: 13705 - DNA, 20 bp, synthetic construct
  misc_feature 1..20: note = CRISPR gRNA sequence
  source 1..20: mol_type = other DNA
tcctgcctcagcctcccaag

SEQ ID NO: 13706 - DNA, 20 bp, synthetic construct
  misc_feature 1..20: note = CRISPR gRNA sequence
  source 1..20: mol_type = other DNA
ctcccaagtagctgtgacta

SEQ ID NO: 13707 - DNA, 20 bp, synthetic construct
  misc_feature 1..20: note = CRISPR gRNA sequence
  source 1..20: mol_type = other DNA
tcccaagtagctgtgactac

SEQ ID NO: 13708 - DNA, 20 bp, synthetic construct
  misc_feature 1..20: note = CRISPR gRNA sequence
  source 1..20: mol_type = other DNA
caggcacctgccaccatgcc

SEQ ID NO: 13709 - DNA, 20 bp, synthetic construct
  misc_feature 1..20: note = CRISPR gRNA sequence
  source 1..20: mol_type = other DNA
gctaatttgttttgtatatt

SEQ ID NO: 13710 - DNA, 20 bp, synthetic construct
  misc_feature 1..20: note = CRISPR gRNA sequence
  source 1..20: mol_type = other DNA
aatttgttttgtatatttag

SEQ ID NO: 13711 - DNA, 20 bp, synthetic construct
  misc_feature 1..20: note = CRISPR gRNA sequence
  source 1..20: mol_type = other DNA
tttgttttgtatatttagta

SEQ ID NO: 13712 - DNA, 20 bp, synthetic construct
  misc_feature 1..20: note = CRISPR gRNA sequence
  source 1..20: mol_type = other DNA
ttttgtatatttagtagaga

SEQ ID NO: 13713 - DNA, 20 bp, synthetic construct
  misc_feature 1..20: note = CRISPR gRNA sequence
  source 1..20: mol_type = other DNA
tttgtatatttagtagagat

SEQ ID NO: 13714 - DNA, 20 bp, synthetic construct
  misc_feature 1..20: note = CRISPR gRNA sequence
  source 1..20: mol_type = other DNA
ttgtatatttagtagagatg

SEQ ID NO: 13715 - DNA, 20 bp, synthetic construct
  misc_feature 1..20: note = CRISPR gRNA sequence
  source 1..20: mol_type = other DNA
gagatggggtttcactatgt

SEQ ID NO: 13716 - DNA, 20 bp, synthetic construct
  misc_feature 1..20: note = CRISPR gRNA sequence
  source 1..20: mol_type = other DNA
tggggtttcactatgttggc

SEQ ID NO: 13717 - DNA, 20 bp, synthetic construct
  misc_feature 1..20: note = CRISPR gRNA sequence
  source 1..20: mol_type = other DNA
ggggtttcactatgttggcc

SEQ ID NO: 13718 - DNA, 20 bp, synthetic construct
  misc_feature 1..20: note = CRISPR gRNA sequence
  source 1..20: mol_type = other DNA
tttcactatgttggccaggc

SEQ ID NO: 13719 - DNA, 20 bp, synthetic construct
  misc_feature 1..20: note = CRISPR gRNA sequence
  source 1..20: mol_type = other DNA
ccaggctggtctcaaactcc

SEQ ID NO: 13720 - DNA, 20 bp, synthetic construct
  misc_feature 1..20: note = CRISPR gRNA sequence
  source 1..20: mol_type = other DNA
gccttgtgatccacctgcct

SEQ ID NO: 13721 - DNA, 20 bp, synthetic construct
  misc_feature 1..20: note = CRISPR gRNA sequence
  source 1..20: mol_type = other DNA
ccacctgcctcggcctccca

SEQ ID NO: 13722 - DNA, 20 bp, synthetic construct
  misc_feature 1..20: note = CRISPR gRNA sequence
  source 1..20: mol_type = other DNA
gcctcggcctcccaaagtgc

SEQ ID NO: 13723 - DNA, 20 bp, synthetic construct
  misc_feature 1..20: note = CRISPR gRNA sequence
  source 1..20: mol_type = other DNA
cctcggcctcccaaagtgct

SEQ ID NO: 13724 - DNA, 20 bp, synthetic construct
  misc_feature 1..20: note = CRISPR gRNA sequence
  source 1..20: mol_type = other DNA
ctcccaaagtgctgggatta

SEQ ID NO: 13725 - DNA, 20 bp, synthetic construct
  misc_feature 1..20: note = CRISPR gRNA sequence
  source 1..20: mol_type = other DNA
tcccaaagtgctgggattac

SEQ ID NO: 13726 - DNA, 20 bp, synthetic construct
  misc_feature 1..20: note = CRISPR gRNA sequence
  source 1..20: mol_type = other DNA
agtgctgggattacaggcat

SEQ ID NO: 13727 - DNA, 20 bp, synthetic construct
  misc_feature 1..20: note = CRISPR gRNA sequence
  source 1..20: mol_type = other DNA
caggcataagccactgcgcc

SEQ ID NO: 13728 - DNA, 20 bp, synthetic construct
  misc_feature 1..20: note = CRISPR gRNA sequence
  source 1..20: mol_type = other DNA
cataagccactgcgcctggc

SEQ ID NO: 13729 - DNA, 20 bp, synthetic construct
  misc_feature 1..20: note = CRISPR gRNA sequence
  source 1..20: mol_type = other DNA
taagccactgcgcctggcca

SEQ ID NO: 13730 - DNA, 20 bp, synthetic construct
  misc_feature 1..20: note = CRISPR gRNA sequence
  source 1..20: mol_type = other DNA
agagttttatttttaactgt

SEQ ID NO: 13731 - DNA, 20 bp, synthetic construct
  misc_feature 1..20: note = CRISPR gRNA sequence
  source 1..20: mol_type = other DNA
gagttttatttttaactgtg

SEQ ID NO: 13732 - DNA, 20 bp, synthetic construct
  misc_feature 1..20: note = CRISPR gRNA sequence
  source 1..20: mol_type = other DNA
agttttatttttaactgtga

SEQ ID NO: 13733 - DNA, 20 bp, synthetic construct
  misc_feature 1..20: note = CRISPR gRNA sequence
  source 1..20: mol_type = other DNA
ttatttttaactgtgagggt

SEQ ID NO: 13734 - DNA, 20 bp, synthetic construct
  misc_feature 1..20: note = CRISPR gRNA sequence
  source 1..20: mol_type = other DNA
tttaactgtgagggtcagaa

SEQ ID NO: 13735 - DNA, 20 bp, synthetic construct
  misc_feature 1..20: note = CRISPR gRNA sequence
  source 1..20: mol_type = other DNA
gggtcagaaaagacctcact

SEQ ID NO: 13736 - DNA, 20 bp, synthetic construct
  misc_feature 1..20: note = CRISPR gRNA sequence
  source 1..20: mol_type = other DNA
ggtcagaaaagacctcactg

SEQ ID NO: 13737 - DNA, 20 bp, synthetic construct
  misc_feature 1..20: note = CRISPR gRNA sequence
  source 1..20: mol_type = other DNA
agaaaagacctcactgaggc

SEQ ID NO: 13738 - DNA, 20 bp, synthetic construct
  misc_feature 1..20: note = CRISPR gRNA sequence
  source 1..20: mol_type = other DNA
gaaaagacctcactgaggcc

SEQ ID NO: 13739 - DNA, 20 bp, synthetic construct
  misc_feature 1..20: note = CRISPR gRNA sequence
  source 1..20: mol_type = other DNA
gacctcactgaggccgggtg

SEQ ID NO: 13740 - DNA, 20 bp, synthetic construct
  misc_feature 1..20: note = CRISPR gRNA sequence
  source 1..20: mol_type = other DNA
ctcactgaggccgggtgtgg

SEQ ID NO: 13741 - DNA, 20 bp, synthetic construct
  misc_feature 1..20: note = CRISPR gRNA sequence
  source 1..20: mol_type = other DNA
gtggctcacgcctgtaatcc

SEQ ID NO: 13742 - DNA, 20 bp, synthetic construct
  misc_feature 1..20: note = CRISPR gRNA sequence
  source 1..20: mol_type = other DNA
cgcctgtaatcccagcactt

SEQ ID NO: 13743 - DNA, 20 bp, synthetic construct
  misc_feature 1..20: note = CRISPR gRNA sequence
  source 1..20: mol_type = other DNA
gcctgtaatcccagcacttt

SEQ ID NO: 13744 - DNA, 20 bp, synthetic construct
  misc_feature 1..20: note = CRISPR gRNA sequence
  source 1..20: mol_type = other DNA
ctgtaatcccagcactttgg

SEQ ID NO: 13745 - DNA, 20 bp, synthetic construct
  misc_feature 1..20: note = CRISPR gRNA sequence
  source 1..20: mol_type = other DNA
tgtaatcccagcactttggg

SEQ ID NO: 13746 - DNA, 20 bp, synthetic construct
  misc_feature 1..20: note = CRISPR gRNA sequence
  source 1..20: mol_type = other DNA
tcccagcactttgggaggcc

SEQ ID NO: 13747 - DNA, 20 bp, synthetic construct
  misc_feature 1..20: note = CRISPR gRNA sequence
  source 1..20: mol_type = other DNA
cccagcactttgggaggccg

SEQ ID NO: 13748 - DNA, 20 bp, synthetic construct
  misc_feature 1..20: note = CRISPR gRNA sequence
  source 1..20: mol_type = other DNA
agcactttgggaggccgagg

SEQ ID NO: 13749 - DNA, 20 bp, synthetic construct
  misc_feature 1..20: note = CRISPR gRNA sequence
  source 1..20: mol_type = other DNA
gcactttgggaggccgaggt

SEQ ID NO: 13750 - DNA, 20 bp, synthetic construct
  misc_feature 1..20: note = CRISPR gRNA sequence
  source 1..20: mol_type = other DNA
cactttgggaggccgaggtg

SEQ ID NO: 13751 - DNA, 20 bp, synthetic construct
  misc_feature 1..20: note = CRISPR gRNA sequence
  source 1..20: mol_type = other DNA
actttgggaggccgaggtgg

SEQ ID NO: 13752 - DNA, 20 bp, synthetic construct
  misc_feature 1..20: note = CRISPR gRNA sequence
  source 1..20: mol_type = other DNA
ctttgggaggccgaggtggg

SEQ ID NO: 13753 - DNA, 20 bp, synthetic construct
  misc_feature 1..20: note = CRISPR gRNA sequence
  source 1..20: mol_type = other DNA
ggccgaggtggggggatcac

SEQ ID NO: 13754 - DNA, 20 bp, synthetic construct
  misc_feature 1..20: note = CRISPR gRNA sequence
  source 1..20: mol_type = other DNA
gccgaggtggggggatcacg

SEQ ID NO: 13755 - DNA, 20 bp, synthetic construct
  misc_feature 1..20: note = CRISPR gRNA sequence
  source 1..20: mol_type = other DNA
aggtggggggatcacgaggt

SEQ ID NO: 13756 - DNA, 20 bp, synthetic construct
  misc_feature 1..20: note = CRISPR gRNA sequence
  source 1..20: mol_type = other DNA
tggggggatcacgaggtcag

SEQ ID NO: 13757 - DNA, 20 bp, synthetic construct
  misc_feature 1..20: note = CRISPR gRNA sequence
  source 1..20: mol_type = other DNA
gatcacgaggtcagaagatt

SEQ ID NO: 13758 - DNA, 20 bp, synthetic construct
  misc_feature 1..20: note = CRISPR gRNA sequence
  source 1..20: mol_type = other DNA
tcagaagattgagaccatcc

SEQ ID NO: 13759 - DNA, 20 bp, synthetic construct
  misc_feature 1..20: note = CRISPR gRNA sequence
  source 1..20: mol_type = other DNA
tgagaccatcctggctaaca

SEQ ID NO: 13760 - DNA, 20 bp, synthetic construct
  misc_feature 1..20: note = CRISPR gRNA sequence
  source 1..20: mol_type = other DNA
ctactaaaaatacaaaaaat

SEQ ID NO: 13761 - DNA, 20 bp, synthetic construct
  misc_feature 1..20: note = CRISPR gRNA sequence
  source 1..20: mol_type = other DNA
taaaaatacaaaaaattagc

SEQ ID NO: 13762 - DNA, 20 bp, synthetic construct
  misc_feature 1..20: note = CRISPR gRNA sequence
  source 1..20: mol_type = other DNA
tacaaaaaattagccagatg

SEQ ID NO: 13763 - DNA, 20 bp, synthetic construct
  misc_feature 1..20: note = CRISPR gRNA sequence
  source 1..20: mol_type = other DNA
gatgtggtgacatgtgcctg

SEQ ID NO: 13764 - DNA, 20 bp, synthetic construct
  misc_feature 1..20: note = CRISPR gRNA sequence
  source 1..20: mol_type = other DNA
gtgacatgtgcctgtagtcc

SEQ ID NO: 13765 - DNA, 20 bp, synthetic construct
  misc_feature 1..20: note = CRISPR gRNA sequence
  source 1..20: mol_type = other DNA
tgcctgtagtcccagctact

SEQ ID NO: 13766 - DNA, 20 bp, synthetic construct
  misc_feature 1..20: note = CRISPR gRNA sequence
  source 1..20: mol_type = other DNA
gcctgtagtcccagctactc

SEQ ID NO: 13767 - DNA, 20 bp, synthetic construct
  misc_feature 1..20: note = CRISPR gRNA sequence
  source 1..20: mol_type = other DNA
ctgtagtcccagctactcgg

SEQ ID NO: 13768 - DNA, 20 bp, synthetic construct
  misc_feature 1..20: note = CRISPR gRNA sequence
  source 1..20: mol_type = other DNA
tgtagtcccagctactcggg

SEQ ID NO: 13769 - DNA, 20 bp, synthetic construct
  misc_feature 1..20: note = CRISPR gRNA sequence
  source 1..20: mol_type = other DNA
tcccagctactcgggaggct

SEQ ID NO: 13770 - DNA, 20 bp, synthetic construct
  misc_feature 1..20: note = CRISPR gRNA sequence
  source 1..20: mol_type = other DNA
cccagctactcgggaggctg

SEQ ID NO: 13771 - DNA, 20 bp, synthetic construct
  misc_feature 1..20: note = CRISPR gRNA sequence
  source 1..20: mol_type = other DNA
gctactcgggaggctgaggc

SEQ ID NO: 13772 - DNA, 20 bp, synthetic construct
  misc_feature 1..20: note = CRISPR gRNA sequence
  source 1..20: mol_type = other DNA
tactcgggaggctgaggcaa

SEQ ID NO: 13773 - DNA, 20 bp, synthetic construct
  misc_feature 1..20: note = CRISPR gRNA sequence
  source 1..20: mol_type = other DNA
gctgaggcaagagaatcact

SEQ ID NO: 13774 - DNA, 20 bp, synthetic construct
  misc_feature 1..20: note = CRISPR gRNA sequence
  source 1..20: mol_type = other DNA
gcaagagaatcacttggact

SEQ ID NO: 13775 - DNA, 20 bp, synthetic construct
  misc_feature 1..20: note = CRISPR gRNA sequence
  source 1..20: mol_type = other DNA
caagagaatcacttggactt

SEQ ID NO: 13776 - DNA, 20 bp, synthetic construct
  misc_feature 1..20: note = CRISPR gRNA sequence
  source 1..20: mol_type = other DNA
agagaatcacttggacttgg

SEQ ID NO: 13777 - DNA, 20 bp, synthetic construct
  misc_feature 1..20: note = CRISPR gRNA sequence
  source 1..20: mol_type = other DNA
gagaatcacttggacttggg

SEQ ID NO: 13778 - DNA, 20 bp, synthetic construct
  misc_feature 1..20: note = CRISPR gRNA sequence
  source 1..20: mol_type = other DNA
gaatcacttggacttgggag

SEQ ID NO: 13779 - DNA, 20 bp, synthetic construct
  misc_feature 1..20: note = CRISPR gRNA sequence
  source 1..20: mol_type = other DNA
aatcacttggacttgggagg

SEQ ID NO: 13780 - DNA, 20 bp, synthetic construct
  misc_feature 1..20: note = CRISPR gRNA sequence
  source 1..20: mol_type = other DNA
tcacttggacttgggaggag

SEQ ID NO: 13781 - DNA, 20 bp, synthetic construct
  misc_feature 1..20: note = CRISPR gRNA sequence
  source 1..20: mol_type = other DNA
cacttggacttgggaggagg

SEQ ID NO: 13782 - DNA, 20 bp, synthetic construct
  misc_feature 1..20: note = CRISPR gRNA sequence
  source 1..20: mol_type = other DNA
gacttgggaggaggaggttg

SEQ ID NO: 13783 - DNA, 20 bp, synthetic construct
  misc_feature 1..20: note = CRISPR gRNA sequence
  source 1..20: mol_type = other DNA
tgggaggaggaggttgcagt

SEQ ID NO: 13784 - DNA, 20 bp, synthetic construct
  misc_feature 1..20: note = CRISPR gRNA sequence
  source 1..20: mol_type = other DNA
ggaggaggttgcagtgagtc

SEQ ID NO: 13785 - DNA, 20 bp, synthetic construct
  misc_feature 1..20: note = CRISPR gRNA sequence
  source 1..20: mol_type = other DNA
gagattgtgccactgcactc

SEQ ID NO: 13786 - DNA, 20 bp, synthetic construct
  misc_feature 1..20: note = CRISPR gRNA sequence
  source 1..20: mol_type = other DNA
tgtgccactgcactccagcc

SEQ ID NO: 13787 - DNA, 20 bp, synthetic construct
  misc_feature 1..20: note = CRISPR gRNA sequence
  source 1..20: mol_type = other DNA
gtgccactgcactccagcct

SEQ ID NO: 13788 - DNA, 20 bp, synthetic construct
  misc_feature 1..20: note = CRISPR gRNA sequence
  source 1..20: mol_type = other DNA
ctgcactccagcctgggtga

SEQ ID NO: 13789 - DNA, 20 bp, synthetic construct
  misc_feature 1..20: note = CRISPR gRNA sequence
  source 1..20: mol_type = other DNA
gcactccagcctgggtgaca

SEQ ID NO: 13790 - DNA, 20 bp, synthetic construct
  misc_feature 1..20: note = CRISPR gRNA sequence
  source 1..20: mol_type = other DNA
tccagcctgggtgacagagc

SEQ ID NO: 13791 - DNA, 20 bp, synthetic construct
  misc_feature 1..20: note = CRISPR gRNA sequence
  source 1..20: mol_type = other DNA
gcgagactccacctcaaaaa

SEQ ID NO: 13792 - DNA, 20 bp, synthetic construct
  misc_feature 1..20: note = CRISPR gRNA sequence
  source 1..20: mol_type = other DNA
ctccacctcaaaaaaagaaa

SEQ ID NO: 13793 - DNA, 20 bp, synthetic construct
  misc_feature 1..20: note = CRISPR gRNA sequence
  source 1..20: mol_type = other DNA
tcaaaaaaagaaaaagaaaa

SEQ ID NO: 13794 - DNA, 20 bp, synthetic construct
  misc_feature 1..20: note = CRISPR gRNA sequence
  source 1..20: mol_type = other DNA
caaaaaaagaaaaagaaaaa

SEQ ID NO: 13795 - DNA, 20 bp, synthetic construct
  misc_feature 1..20: note = CRISPR gRNA sequence
  source 1..20: mol_type = other DNA
aagaaaaagaaaaaaggaaa

SEQ ID NO: 13796 - DNA, 20 bp, synthetic construct
  misc_feature 1..20: note = CRISPR gRNA sequence
  source 1..20: mol_type = other DNA
aaaagaaaaaaggaaaaaga

SEQ ID NO: 13797 - DNA, 20 bp, synthetic construct
  misc_feature 1..20: note = CRISPR gRNA sequence
  source 1..20: mol_type = other DNA
gaaaaaaggaaaaagaaaga

SEQ ID NO: 13798 - DNA, 20 bp, synthetic construct
  misc_feature 1..20: note = CRISPR gRNA sequence
  source 1..20: mol_type = other DNA
aaaggaaaaagaaagaaaga

SEQ ID NO: 13799 - DNA, 20 bp, synthetic construct
  misc_feature 1..20: note = CRISPR gRNA sequence
  source 1..20: mol_type = other DNA
aaggaaaaagaaagaaagaa

SEQ ID NO: 13800 - DNA, 20 bp, synthetic construct
  misc_feature 1..20: note = CRISPR gRNA sequence
  source 1..20: mol_type = other DNA
aggaaaaagaaagaaagaaa

SEQ ID NO: 13801 - DNA, 20 bp, synthetic construct
  misc_feature 1..20: note = CRISPR gRNA sequence
  source 1..20: mol_type = other DNA
aaaagaaagaaagaaaggga

SEQ ID NO: 13802 - DNA, 20 bp, synthetic construct
  misc_feature 1..20: note = CRISPR gRNA sequence
  source 1..20: mol_type = other DNA
gaaagaaagaaagggaaaga

SEQ ID NO: 13803 - DNA, 20 bp, synthetic construct
  misc_feature 1..20: note = CRISPR gRNA sequence
  source 1..20: mol_type = other DNA
gaaagaaagggaaagaaaga

SEQ ID NO: 13804 - DNA, 20 bp, synthetic construct
  misc_feature 1..20: note = CRISPR gRNA sequence
  source 1..20: mol_type = other DNA
gaaagggaaagaaagaaaga

SEQ ID NO: 13805 - DNA, 20 bp, synthetic construct
  misc_feature 1..20: note = CRISPR gRNA sequence
  source 1..20: mol_type = other DNA
aaagggaaagaaagaaagaa

SEQ ID NO: 13806 - DNA, 20 bp, synthetic construct
  misc_feature 1..20: note = CRISPR gRNA sequence
  source 1..20: mol_type = other DNA
agggaaagaaagaaagaaag

SEQ ID NO: 13807 - DNA, 20 bp, synthetic construct
  misc_feature 1..20: note = CRISPR gRNA sequence
  source 1..20: mol_type = other DNA
gggaaagaaagaaagaaagg

SEQ ID NO: 13808 - DNA, 20 bp, synthetic construct
  misc_feature 1..20: note = CRISPR gRNA sequence
  source 1..20: mol_type = other DNA
ggaaagaaagaaagaaagga

SEQ ID NO: 13809 - DNA, 20 bp, synthetic construct
  misc_feature 1..20: note = CRISPR gRNA sequence
  source 1..20: mol_type = other DNA
agaaagaaagaaaggaggga

SEQ ID NO: 13810 - DNA, 20 bp, synthetic construct
  misc_feature 1..20: note = CRISPR gRNA sequence
  source 1..20: mol_type = other DNA
agaaagaaaggagggaaaga

SEQ ID NO: 13811 - DNA, 20 bp, synthetic construct
  misc_feature 1..20: note = CRISPR gRNA sequence
  source 1..20: mol_type = other DNA
agaaaggagggaaagaaaga

SEQ ID NO: 13812 - DNA, 20 bp, synthetic construct
  misc_feature 1..20: note = CRISPR gRNA sequence
  source 1..20: mol_type = other DNA
aggagggaaagaaagaaaga

SEQ ID NO: 13813 - DNA, 20 bp, synthetic construct
  misc_feature 1..20: note = CRISPR gRNA sequence
  source 1..20: mol_type = other DNA
gaaagaaagaaagaaagaaa

SEQ ID NO: 13814 - DNA, 20 bp, synthetic construct
  misc_feature 1..20: note = CRISPR gRNA sequence
  source 1..20: mol_type = other DNA
aaagaaagaaagaaagaaac

SEQ ID NO: 13815 - DNA, 20 bp, synthetic construct
  misc_feature 1..20: note = CRISPR gRNA sequence
  source 1..20: mol_type = other DNA
aagaaagaaagaaagaaaca

SEQ ID NO: 13816 - DNA, 20 bp, synthetic construct
  misc_feature 1..20: note = CRISPR gRNA sequence
  source 1..20: mol_type = other DNA
aagaaagaaagaaacaggga

SEQ ID NO: 13817 - DNA, 20 bp, synthetic construct
  misc_feature 1..20: note = CRISPR gRNA sequence
  source 1..20: mol_type = other DNA
aagaaagaaacagggaaaga

SEQ ID NO: 13818 - DNA, 20 bp, synthetic construct
  misc_feature 1..20: note = CRISPR gRNA sequence
  source 1..20: mol_type = other DNA
agaaacagggaaagaaagaa

SEQ ID NO: 13819 - DNA, 20 bp, synthetic construct
  misc_feature 1..20: note = CRISPR gRNA sequence
  source 1..20: mol_type = other DNA
cagggaaagaaagaaaagaa

SEQ ID NO: 13820 - DNA, 20 bp, synthetic construct
  misc_feature 1..20: note = CRISPR gRNA sequence
  source 1..20: mol_type = other DNA
agggaaagaaagaaaagaaa

SEQ ID NO: 13821 - DNA, 20 bp, synthetic construct
  misc_feature 1..20: note = CRISPR gRNA sequence
  source 1..20: mol_type = other DNA
agaaaagaaaaggcctcact

SEQ ID NO: 13822 - DNA, 20 bp, synthetic construct
  misc_feature 1..20: note = CRISPR gRNA sequence
  source 1..20: mol_type = other DNA
agaaaaggcctcactgagta

SEQ ID NO: 13823 - DNA, 20 bp, synthetic construct
  misc_feature 1..20: note = CRISPR gRNA sequence
  source 1..20: mol_type = other DNA
aggcctcactgagtaaagac

SEQ ID NO: 13824 - DNA, 20 bp, synthetic construct
  misc_feature 1..20: note = CRISPR gRNA sequence
  source 1..20: mol_type = other DNA
gcctcactgagtaaagacca

SEQ ID NO: 13825 - DNA, 20 bp, synthetic construct
  misc_feature 1..20: note = CRISPR gRNA sequence
  source 1..20: mol_type = other DNA
cctcactgagtaaagaccag

SEQ ID NO: 13826 - DNA, 20 bp, synthetic construct
  misc_feature 1..20: note = CRISPR gRNA sequence
  source 1..20: mol_type = other DNA
tcactgagtaaagaccagag

SEQ ID NO: 13827 - DNA, 20 bp, synthetic construct
  misc_feature 1..20: note = CRISPR gRNA sequence
  source 1..20: mol_type = other DNA
cactgagtaaagaccagagg

SEQ ID NO: 13828 - DNA, 20 bp, synthetic construct
  misc_feature 1..20: note = CRISPR gRNA sequence
  source 1..20: mol_type = other DNA
agtaaagaccagaggaggtg

SEQ ID NO: 13829 - DNA, 20 bp, synthetic construct
  misc_feature 1..20: note = CRISPR gRNA sequence
  source 1..20: mol_type = other DNA
gtaaagaccagaggaggtga

SEQ ID NO: 13830 - DNA, 20 bp, synthetic construct
  misc_feature 1..20: note = CRISPR gRNA sequence
  source 1..20: mol_type = other DNA
accagaggaggtgaaggcat

SEQ ID NO: 13831 - DNA, 20 bp, synthetic construct
  misc_feature 1..20: note = CRISPR gRNA sequence
  source 1..20: mol_type = other DNA
aggtgaaggcatgagccatg

SEQ ID NO: 13832 - DNA, 20 bp, synthetic construct
  misc_feature 1..20: note = CRISPR gRNA sequence
  source 1..20: mol_type = other DNA
gcatgagccatgcagatatc

SEQ ID NO: 13833 - DNA, 20 bp, synthetic construct
  misc_feature 1..20: note = CRISPR gRNA sequence
  source 1..20: mol_type = other DNA
catgagccatgcagatatct

SEQ ID NO: 13834 - DNA, 20 bp, synthetic construct
  misc_feature 1..20: note = CRISPR gRNA sequence
  source 1..20: mol_type = other DNA
atgagccatgcagatatctg

SEQ ID NO: 13835 - DNA, 20 bp, synthetic construct
  misc_feature 1..20: note = CRISPR gRNA sequence
  source 1..20: mol_type = other DNA
gagccatgcagatatctggg

SEQ ID NO: 13836 - DNA, 20 bp, synthetic construct
  misc_feature 1..20: note = CRISPR gRNA sequence
  source 1..20: mol_type = other DNA
ccatgcagatatctggggag

SEQ ID NO: 13837 - DNA, 20 bp, synthetic construct
  misc_feature 1..20: note = CRISPR gRNA sequence
  source 1..20: mol_type = other DNA
atatctggggagaagtattc

SEQ ID NO: 13838 - DNA, 20 bp, synthetic construct
  misc_feature 1..20: note = CRISPR gRNA sequence
  source 1..20: mol_type = other DNA
tatctggggagaagtattcc

SEQ ID NO: 13839 - DNA, 20 bp, synthetic construct
  misc_feature 1..20: note = CRISPR gRNA sequence
  source 1..20: mol_type = other DNA
ctggggagaagtattccagg

SEQ ID NO: 13840 - DNA, 20 bp, synthetic construct
  misc_feature 1..20: note = CRISPR gRNA sequence
  source 1..20: mol_type = other DNA
ggggagaagtattccaggca

SEQ ID NO: 13841 - DNA, 20 bp, synthetic construct
  misc_feature 1..20: note = CRISPR gRNA sequence
  source 1..20: mol_type = other DNA
gggagaagtattccaggcag

SEQ ID NO: 13842 - DNA, 20 bp, synthetic construct
  misc_feature 1..20: note = CRISPR gRNA sequence
  source 1..20: mol_type = other DNA
ggagaagtattccaggcaga

SEQ ID NO: 13843 - DNA, 20 bp, synthetic construct
  misc_feature 1..20: note = CRISPR gRNA sequence
  source 1..20: mol_type = other DNA
agtattccaggcagagggca

SEQ ID NO: 13844 - DNA, 20 bp, synthetic construct
  misc_feature 1..20: note = CRISPR gRNA sequence
  source 1..20: mol_type = other DNA
ttccaggcagagggcacagc

SEQ ID NO: 13845 - DNA, 20 bp, synthetic construct
  misc_feature 1..20: note = CRISPR gRNA sequence
  source 1..20: mol_type = other DNA
cagagggcacagccggtgca

SEQ ID NO: 13846 - DNA, 20 bp, synthetic construct
  misc_feature 1..20: note = CRISPR gRNA sequence
  source 1..20: mol_type = other DNA
agagggcacagccggtgcaa

SEQ ID NO: 13847 - DNA, 20 bp, synthetic construct
  misc_feature 1..20: note = CRISPR gRNA sequence
  source 1..20: mol_type = other DNA
gcacagccggtgcaaaggcc

SEQ ID NO: 13848 - DNA, 20 bp, synthetic construct
  misc_feature 1..20: note = CRISPR gRNA sequence
  source 1..20: mol_type = other DNA
acagccggtgcaaaggcctg

SEQ ID NO: 13849 - DNA, 20 bp, synthetic construct
  misc_feature 1..20: note = CRISPR gRNA sequence
  source 1..20: mol_type = other DNA
cagccggtgcaaaggcctgg

SEQ ID NO: 13850 - DNA, 20 bp, synthetic construct
  misc_feature 1..20: note = CRISPR gRNA sequence
  source 1..20: mol_type = other DNA
ccggtgcaaaggcctggagg

SEQ ID NO: 13851 - DNA, 20 bp, synthetic construct
  misc_feature 1..20: note = CRISPR gRNA sequence
  source 1..20: mol_type = other DNA
gtgcaaaggcctggaggcag

SEQ ID NO: 13852 - DNA, 20 bp, synthetic construct
  misc_feature 1..20: note = CRISPR gRNA sequence
  source 1..20: mol_type = other DNA
cctggaggcagaagcatgcc

SEQ ID NO: 13853 - DNA, 20 bp, synthetic construct
  misc_feature 1..20: note = CRISPR gRNA sequence
  source 1..20: mol_type = other DNA
ctggaggcagaagcatgcct

SEQ ID NO: 13854 - DNA, 20 bp, synthetic construct
  misc_feature 1..20: note = CRISPR gRNA sequence
  source 1..20: mol_type = other DNA
ggaggcagaagcatgcctag

SEQ ID NO: 13855 - DNA, 20 bp, synthetic construct
  misc_feature 1..20: note = CRISPR gRNA sequence
  source 1..20: mol_type = other DNA
gaggcagaagcatgcctagg

SEQ ID NO: 13856 - DNA, 20 bp, synthetic construct
  misc_feature 1..20: note = CRISPR gRNA sequence
  source 1..20: mol_type = other DNA
aagcatgcctaggaggttga

SEQ ID NO: 13857 - DNA, 20 bp, synthetic construct
  misc_feature 1..20: note = CRISPR gRNA sequence
  source 1..20: mol_type = other DNA
atgcctaggaggttgaaagc

SEQ ID NO: 13858 - DNA, 20 bp, synthetic construct
  misc_feature 1..20: note = CRISPR gRNA sequence
  source 1..20: mol_type = other DNA
ctaggaggttgaaagccagc

SEQ ID NO: 13859 - DNA, 20 bp, synthetic construct
  misc_feature 1..20: note = CRISPR gRNA sequence
  source 1..20: mol_type = other DNA
taggaggttgaaagccagca

SEQ ID NO: 13860 - DNA, 20 bp, synthetic construct
  misc_feature 1..20: note = CRISPR gRNA sequence
  source 1..20: mol_type = other DNA
ggaggttgaaagccagcaag

SEQ ID NO: 13861 - DNA, 20 bp, synthetic construct
  misc_feature 1..20: note = CRISPR gRNA sequence
  source 1..20: mol_type = other DNA
gaggttgaaagccagcaagg

SEQ ID NO: 13862 - DNA, 20 bp, synthetic construct
  misc_feature 1..20: note = CRISPR gRNA sequence
  source 1..20: mol_type = other DNA
aagccagcaaggaggccctg

SEQ ID NO: 13863 - DNA, 20 bp, synthetic construct
  misc_feature 1..20: note = CRISPR gRNA sequence
  source 1..20: mol_type = other DNA
cagcaaggaggccctgtggc

SEQ ID NO: 13864 - DNA, 20 bp, synthetic construct
  misc_feature 1..20: note = CRISPR gRNA sequence
  source 1..20: mol_type = other DNA
aggaggccctgtggctggaa

SEQ ID NO: 13865 - DNA, 20 bp, synthetic construct
  misc_feature 1..20: note = CRISPR gRNA sequence
  source 1..20: mol_type = other DNA
gaggccctgtggctggaatg

SEQ ID NO: 13866 - DNA, 20 bp, synthetic construct
  misc_feature 1..20: note = CRISPR gRNA sequence
  source 1..20: mol_type = other DNA
ggccctgtggctggaatgga

SEQ ID NO: 13867 - DNA, 20 bp, synthetic construct
  misc_feature 1..20: note = CRISPR gRNA sequence
  source 1..20: mol_type = other DNA
ccctgtggctggaatggaga

SEQ ID NO: 13868 - DNA, 20 bp, synthetic construct
  misc_feature 1..20: note = CRISPR gRNA sequence
  source 1..20: mol_type = other DNA
gctggaatggagagagcacc

SEQ ID NO: 13869 - DNA, 20 bp, synthetic construct
  misc_feature 1..20: note = CRISPR gRNA sequence
  source 1..20: mol_type = other DNA
gaatggagagagcacccagc

SEQ ID NO: 13870 - DNA, 20 bp, synthetic construct
  misc_feature 1..20: note = CRISPR gRNA sequence
  source 1..20: mol_type = other DNA
gagagagcacccagcgagtg

SEQ ID NO: 13871 - DNA, 20 bp, synthetic construct
  misc_feature 1..20: note = CRISPR gRNA sequence
  source 1..20: mol_type = other DNA
agagagcacccagcgagtgt

SEQ ID NO: 13872 - DNA, 20 bp, synthetic construct
  misc_feature 1..20: note = CRISPR gRNA sequence
  source 1..20: mol_type = other DNA
agagcacccagcgagtgtag

SEQ ID NO: 13873 - DNA, 20 bp, synthetic construct
  misc_feature 1..20: note = CRISPR gRNA sequence
  source 1..20: mol_type = other DNA
acccagcgagtgtaggagat

SEQ ID NO: 13874 - DNA, 20 bp, synthetic construct
  misc_feature 1..20: note = CRISPR gRNA sequence
  source 1..20: mol_type = other DNA
cccagcgagtgtaggagata

SEQ ID NO: 13875 - DNA, 20 bp, synthetic construct
  misc_feature 1..20: note = CRISPR gRNA sequence
  source 1..20: mol_type = other DNA
ccagcgagtgtaggagataa

SEQ ID NO: 13876 - DNA, 20 bp, synthetic construct
  misc_feature 1..20: note = CRISPR gRNA sequence
  source 1..20: mol_type = other DNA
gtgtaggagataagggtgaa

SEQ ID NO: 13877 - DNA, 20 bp, synthetic construct
  misc_feature 1..20: note = CRISPR gRNA sequence
  source 1..20: mol_type = other DNA
tgtaggagataagggtgaac

SEQ ID NO: 13878 - DNA, 20 bp, synthetic construct
  misc_feature 1..20: note = CRISPR gRNA sequence
  source 1..20: mol_type = other DNA
ggagataagggtgaacaggt

SEQ ID NO: 13879 - DNA, 20 bp, synthetic construct
  misc_feature 1..20: note = CRISPR gRNA sequence
  source 1..20: mol_type = other DNA
gataagggtgaacaggtgag

SEQ ID NO: 13880 - DNA, 20 bp, synthetic construct
  misc_feature 1..20: note = CRISPR gRNA sequence
  source 1..20: mol_type = other DNA
ataagggtgaacaggtgagt

SEQ ID NO: 13881 - DNA, 20 bp, synthetic construct
  misc_feature 1..20: note = CRISPR gRNA sequence
  source 1..20: mol_type = other DNA
taagggtgaacaggtgagtg

SEQ ID NO: 13882 - DNA, 20 bp, synthetic construct
  misc_feature 1..20: note = CRISPR gRNA sequence
  source 1..20: mol_type = other DNA
caggtgagtggggactgaac

SEQ ID NO: 13883 - DNA, 20 bp, synthetic construct
  misc_feature 1..20: note = CRISPR gRNA sequence
  source 1..20: mol_type = other DNA
aggtgagtggggactgaact

SEQ ID NO: 13884 - DNA, 20 bp, synthetic construct
  misc_feature 1..20: note = CRISPR gRNA sequence
  source 1..20: mol_type = other DNA
ggtgagtggggactgaactg

SEQ ID NO: 13885 - DNA, 20 bp, synthetic construct
  misc_feature 1..20: note = CRISPR gRNA sequence
  source 1..20: mol_type = other DNA
gagtggggactgaactgggg

SEQ ID NO: 13886 - DNA, 20 bp, synthetic construct
  misc_feature 1..20: note = CRISPR gRNA sequence
  source 1..20: mol_type = other DNA
agtggggactgaactgggga

SEQ ID NO: 13887 - DNA, 20 bp, synthetic construct
  misc_feature 1..20: note = CRISPR gRNA sequence
  source 1..20: mol_type = other DNA
aaggactctgtgtacaaacg

SEQ ID NO: 13888 - DNA, 20 bp, synthetic construct
  misc_feature 1..20: note = CRISPR gRNA sequence
  source 1..20: mol_type = other DNA
gtgtacaaacgaagtccctg

SEQ ID NO: 13889 - DNA, 20 bp, synthetic construct
  misc_feature 1..20: note = CRISPR gRNA sequence
  source 1..20: mol_type = other DNA
tgtacaaacgaagtccctgt

SEQ ID NO: 13890 - DNA, 20 bp, synthetic construct
  misc_feature 1..20: note = CRISPR gRNA sequence
  source 1..20: mol_type = other DNA
gtacaaacgaagtccctgta

SEQ ID NO: 13891 - DNA, 20 bp, synthetic construct
  misc_feature 1..20: note = CRISPR gRNA sequence
  source 1..20: mol_type = other DNA
cgaagtccctgtagggttgt

SEQ ID NO: 13892 - DNA, 20 bp, synthetic construct
  misc_feature 1..20: note = CRISPR gRNA sequence
  source 1..20: mol_type = other DNA
agtccctgtagggttgtgag

SEQ ID NO: 13893 - DNA, 20 bp, synthetic construct
  misc_feature 1..20: note = CRISPR gRNA sequence
  source 1..20: mol_type = other DNA
ctgtagggttgtgagtggct

SEQ ID NO: 13894 - DNA, 20 bp, synthetic construct
  misc_feature 1..20: note = CRISPR gRNA sequence
  source 1..20: mol_type = other DNA
ggctaagaaccctgatttga

SEQ ID NO: 13895 - DNA, 20 bp, synthetic construct
  misc_feature 1..20: note = CRISPR gRNA sequence
  source 1..20: mol_type = other DNA
aagaaccctgatttgacaga

SEQ ID NO: 13896 - DNA, 20 bp, synthetic construct
  misc_feature 1..20: note = CRISPR gRNA sequence
  source 1..20: mol_type = other DNA
ccctgatttgacagacagat

SEQ ID NO: 13897 - DNA, 20 bp, synthetic construct
  misc_feature 1..20: note = CRISPR gRNA sequence
  source 1..20: mol_type = other DNA
cctgatttgacagacagatg

SEQ ID NO: 13898 - DNA, 20 bp, synthetic construct
  misc_feature 1..20: note = CRISPR gRNA sequence
  source 1..20: mol_type = other DNA
tgacagacagatgaggtcta

SEQ ID NO: 13899 - DNA, 20 bp, synthetic construct
  misc_feature 1..20: note = CRISPR gRNA sequence
  source 1..20: mol_type = other DNA
gacagacagatgaggtctac

SEQ ID NO: 13900 - DNA, 20 bp, synthetic construct
  misc_feature 1..20: note = CRISPR gRNA sequence
  source 1..20: mol_type = other DNA
acagacagatgaggtctaca

SEQ ID NO: 13901 - DNA, 20 bp, synthetic construct
  misc_feature 1..20: note = CRISPR gRNA sequence
  source 1..20: mol_type = other DNA
gatgaggtctacagggtgcc

SEQ ID NO: 13902 - DNA, 20 bp, synthetic construct
  misc_feature 1..20: note = CRISPR gRNA sequence
  source 1..20: mol_type = other DNA
atgaggtctacagggtgcct

SEQ ID NO: 13903 - DNA, 20 bp, synthetic construct
  misc_feature 1..20: note = CRISPR gRNA sequence
  source 1..20: mol_type = other DNA
gtctacagggtgcctgggca

SEQ ID NO: 13904 - DNA, 20 bp, synthetic construct
  misc_feature 1..20: note = CRISPR gRNA sequence
  source 1..20: mol_type = other DNA
tacagggtgcctgggcacag

SEQ ID NO: 13905 - DNA, 20 bp, synthetic construct
  misc_feature 1..20: note = CRISPR gRNA sequence
  source 1..20: mol_type = other DNA
agggtgcctgggcacagtag

SEQ ID NO: 13906 - DNA, 20 bp, synthetic construct
  misc_feature 1..20: note = CRISPR gRNA sequence
  source 1..20: mol_type = other DNA
cctgggcacagtagaagcct

SEQ ID NO: 13907 - DNA, 20 bp, synthetic construct
  misc_feature 1..20: note = CRISPR gRNA sequence
  source 1..20: mol_type = other DNA
gtagaagcctgagaaaatgc

SEQ ID NO: 13908 - DNA, 20 bp, synthetic construct
  misc_feature 1..20: note = CRISPR gRNA sequence
  source 1..20: mol_type = other DNA
gcctgagaaaatgccagaaa

SEQ ID NO: 13909 - DNA, 20 bp, synthetic construct
  misc_feature 1..20: note = CRISPR gRNA sequence
  source 1..20: mol_type = other DNA
tccttccttccttccttcct

SEQ ID NO: 13910 - DNA, 20 bp, synthetic construct
  misc_feature 1..20: note = CRISPR gRNA sequence
  source 1..20: mol_type = other DNA
ttccttcctcagaacctcct

SEQ ID NO: 13911 - DNA, 20 bp, synthetic construct
  misc_feature 1..20: note = CRISPR gRNA sequence
  source 1..20: mol_type = other DNA
tccttcctcagaacctcctc

SEQ ID NO: 13912 - DNA, 20 bp, synthetic construct
  misc_feature 1..20: note = CRISPR gRNA sequence
  source 1..20: mol_type = other DNA
ccttcctcagaacctcctcg

SEQ ID NO: 13913 - DNA, 20 bp, synthetic construct
  misc_feature 1..20: note = CRISPR gRNA sequence
  source 1..20: mol_type = other DNA
cttcctcagaacctcctcgg

SEQ ID NO: 13914 - DNA, 20 bp, synthetic construct
  misc_feature 1..20: note = CRISPR gRNA sequence
  source 1..20: mol_type = other DNA
agaacctcctcgggggcttc

SEQ ID NO: 13915 - DNA, 20 bp, synthetic construct
  misc_feature 1..20: note = CRISPR gRNA sequence
  source 1..20: mol_type = other DNA
cctcgggggcttccggtctc

SEQ ID NO: 13916 - DNA, 20 bp, synthetic construct
  misc_feature 1..20: note = CRISPR gRNA sequence
  source 1..20: mol_type = other DNA
ctcgggggcttccggtctcc

SEQ ID NO: 13917 - DNA, 20 bp, synthetic construct
  misc_feature 1..20: note = CRISPR gRNA sequence
  source 1..20: mol_type = other DNA
gggggcttccggtctccagg

SEQ ID NO: 13918 - DNA, 20 bp, synthetic construct
  misc_feature 1..20: note = CRISPR gRNA sequence
  source 1..20: mol_type = other DNA
tctccaggtggctgatcacc

SEQ ID NO: 13919 - DNA, 20 bp, synthetic construct
  misc_feature 1..20: note = CRISPR gRNA sequence
  source 1..20: mol_type = other DNA
ggtggctgatcacccggctc

SEQ ID NO: 13920 - DNA, 20 bp, synthetic construct
  misc_feature 1..20: note = CRISPR gRNA sequence
  source 1..20: mol_type = other DNA
gtggctgatcacccggctct

SEQ ID NO: 13921 - DNA, 20 bp, synthetic construct
  misc_feature 1..20: note = CRISPR gRNA sequence
  source 1..20: mol_type = other DNA
ctctaggctgttccacccca

SEQ ID NO: 13922 - DNA, 20 bp, synthetic construct
  misc_feature 1..20: note = CRISPR gRNA sequence
  source 1..20: mol_type = other DNA
accccatggccgctgttccc

SEQ ID NO: 13923 - DNA, 20 bp, synthetic construct
  misc_feature 1..20: note = CRISPR gRNA sequence
  source 1..20: mol_type = other DNA
cccatggccgctgttcccca

SEQ ID NO: 13924 - DNA, 20 bp, synthetic construct
  misc_feature 1..20: note = CRISPR gRNA sequence
  source 1..20: mol_type = other DNA
ggccgctgttccccagagcg

SEQ ID NO: 13925 - DNA, 20 bp, synthetic construct
  misc_feature 1..20: note = CRISPR gRNA sequence
  source 1..20: mol_type = other DNA
gcgcagttccgatcttgaac

SEQ ID NO: 13926 - DNA, 20 bp, synthetic construct
  misc_feature 1..20: note = CRISPR gRNA sequence
  source 1..20: mol_type = other DNA
cgcagttccgatcttgaact

SEQ ID NO: 13927 - DNA, 20 bp, synthetic construct
  misc_feature 1..20: note = CRISPR gRNA sequence
  source 1..20: mol_type = other DNA
gcagttccgatcttgaacta

SEQ ID NO: 13928 - DNA, 20 bp, synthetic construct
  misc_feature 1..20: note = CRISPR gRNA sequence
  source 1..20: mol_type = other DNA
cagttccgatcttgaactag

SEQ ID NO: 13929 - DNA, 20 bp, synthetic construct
  misc_feature 1..20: note = CRISPR gRNA sequence
  source 1..20: mol_type = other DNA
tcttgaactaggggcttttt

SEQ ID NO: 13930 - DNA, 20 bp, synthetic construct
  misc_feature 1..20: note = CRISPR gRNA sequence
  source 1..20: mol_type = other DNA
ttttcagctgaaaataattt

SEQ ID NO: 13931 - DNA, 20 bp, synthetic construct
  misc_feature 1..20: note = CRISPR gRNA sequence
  source 1..20: mol_type = other DNA
tttcagctgaaaataattta

SEQ ID NO: 13932 - DNA, 20 bp, synthetic construct
  misc_feature 1..20: note = CRISPR gRNA sequence
  source 1..20: mol_type = other DNA
agctgaaaataatttaaggc

SEQ ID NO: 13933 - DNA, 20 bp, synthetic construct
  misc_feature 1..20: note = CRISPR gRNA sequence
  source 1..20: mol_type = other DNA
gaaaataatttaaggccaga

SEQ ID NO: 13934 - DNA, 20 bp, synthetic construct
  misc_feature 1..20: note = CRISPR gRNA sequence
  source 1..20: mol_type = other DNA
aaaataatttaaggccagaa

SEQ ID NO: 13935 - DNA, 20 bp, synthetic construct
  misc_feature 1..20: note = CRISPR gRNA sequence
  source 1..20: mol_type = other DNA
aaataatttaaggccagaaa

SEQ ID NO: 13936 - DNA, 20 bp, synthetic construct
  misc_feature 1..20: note = CRISPR gRNA sequence
  source 1..20: mol_type = other DNA
ttaaggccagaaagggccct

SEQ ID NO: 13937 - DNA, 20 bp, synthetic construct
  misc_feature 1..20: note = CRISPR gRNA sequence
  source 1..20: mol_type = other DNA
gggccctcagttattgtttt

SEQ ID NO: 13938 - DNA, 20 bp, synthetic construct
  misc_feature 1..20: note = CRISPR gRNA sequence
  source 1..20: mol_type = other DNA
tttcagacatttcccctttt

SEQ ID NO: 13939 - DNA, 20 bp, synthetic construct
  misc_feature 1..20: note = CRISPR gRNA sequence
  source 1..20: mol_type = other DNA
ttcagcatcatttttacctc

SEQ ID NO: 13940 - DNA, 20 bp, synthetic construct
  misc_feature 1..20: note = CRISPR gRNA sequence
  source 1..20: mol_type = other DNA
tttttacctctggacaaatt

SEQ ID NO: 13941 - DNA, 20 bp, synthetic construct
  misc_feature 1..20: note = CRISPR gRNA sequence
  source 1..20: mol_type = other DNA
accttgtctctgttcaaaac

SEQ ID NO: 13942 - DNA, 20 bp, synthetic construct
  misc_feature 1..20: note = CRISPR gRNA sequence
  source 1..20: mol_type = other DNA
cttgtctctgttcaaaacaa

SEQ ID NO: 13943 - DNA, 20 bp, synthetic construct
  misc_feature 1..20: note = CRISPR gRNA sequence
  source 1..20: mol_type = other DNA
ctgttcaaaacaagagacac

SEQ ID NO: 13944 - DNA, 20 bp, synthetic construct
  misc_feature 1..20: note = CRISPR gRNA sequence
  source 1..20: mol_type = other DNA
aagagacactggcttttttc

SEQ ID NO: 13945 - DNA, 20 bp, synthetic construct
  misc_feature 1..20: note = CRISPR gRNA sequence
  source 1..20: mol_type = other DNA
agagacactggcttttttct

SEQ ID NO: 13946 - DNA, 20 bp, synthetic construct
  misc_feature 1..20: note = CRISPR gRNA sequence
  source 1..20: mol_type = other DNA
gagacactggcttttttctg

SEQ ID NO: 13947 - DNA, 20 bp, synthetic construct
  misc_feature 1..20: note = CRISPR gRNA sequence
  source 1..20: mol_type = other DNA
actggcttttttctggggca

SEQ ID NO: 13948 - DNA, 20 bp, synthetic construct
  misc_feature 1..20: note = CRISPR gRNA sequence
  source 1..20: mol_type = other DNA
ctggcttttttctggggcac

SEQ ID NO: 13949 - DNA, 20 bp, synthetic construct
  misc_feature 1..20: note = CRISPR gRNA sequence
  source 1..20: mol_type = other DNA
tggcttttttctggggcaca

SEQ ID NO: 13950 - DNA, 20 bp, synthetic construct
  misc_feature 1..20: note = CRISPR gRNA sequence
  source 1..20: mol_type = other DNA
ggcttttttctggggcacag

SEQ ID NO: 13951 - DNA, 20 bp, synthetic construct
  misc_feature 1..20: note = CRISPR gRNA sequence
  source 1..20: mol_type = other DNA
cttttttctggggcacaggg

SEQ ID NO: 13952 - DNA, 20 bp, synthetic construct
  misc_feature 1..20: note = CRISPR gRNA sequence
  source 1..20: mol_type = other DNA
ttttctggggcacaggggag

SEQ ID NO: 13953 - DNA, 20 bp, synthetic construct
  misc_feature 1..20: note = CRISPR gRNA sequence
  source 1..20: mol_type = other DNA
gggcacaggggagcagtgat

SEQ ID NO: 13954 - DNA, 20 bp, synthetic construct
  misc_feature 1..20: note = CRISPR gRNA sequence
  source 1..20: mol_type = other DNA
ggcacaggggagcagtgatc

SEQ ID NO: 13955 - DNA, 20 bp, synthetic construct
  misc_feature 1..20: note = CRISPR gRNA sequence
  source 1..20: mol_type = other DNA
gcacaggggagcagtgatca

SEQ ID NO: 13956 - DNA, 20 bp, synthetic construct
  misc_feature 1..20: note = CRISPR gRNA sequence
  source 1..20: mol_type = other DNA
acaggggagcagtgatcagg

SEQ ID NO: 13957 - DNA, 20 bp, synthetic construct
  misc_feature 1..20: note = CRISPR gRNA sequence
  source 1..20: mol_type = other DNA
aggggagcagtgatcaggga

SEQ ID NO: 13958 - DNA, 20 bp, synthetic construct
  misc_feature 1..20: note = CRISPR gRNA sequence
  source 1..20: mol_type = other DNA
cagtgatcagggagagctga

SEQ ID NO: 13959 - DNA, 20 bp, synthetic construct
  misc_feature 1..20: note = CRISPR gRNA sequence
  source 1..20: mol_type = other DNA
cagggagagctgatagcttg

SEQ ID NO: 13960 - DNA, 20 bp, synthetic construct
  misc_feature 1..20: note = CRISPR gRNA sequence
  source 1..20: mol_type = other DNA
agggagagctgatagcttgt

SEQ ID NO: 13961 - DNA, 20 bp, synthetic construct
  misc_feature 1..20: note = CRISPR gRNA sequence
  source 1..20: mol_type = other DNA
gctgatagcttgtgggtgac

SEQ ID NO: 13962 - DNA, 20 bp, synthetic construct
  misc_feature 1..20: note = CRISPR gRNA sequence
  source 1..20: mol_type = other DNA
atagcttgtgggtgaccagc

SEQ ID NO: 13963 - DNA, 20 bp, synthetic construct
  misc_feature 1..20: note = CRISPR gRNA sequence
  source 1..20: mol_type = other DNA
tagcttgtgggtgaccagct

SEQ ID NO: 13964 - DNA, 20 bp, synthetic construct
  misc_feature 1..20: note = CRISPR gRNA sequence
  source 1..20: mol_type = other DNA
agcttgtgggtgaccagctg

SEQ ID NO: 13965 - DNA, 20 bp, synthetic construct
  misc_feature 1..20: note = CRISPR gRNA sequence
  source 1..20: mol_type = other DNA
gcttgtgggtgaccagctgg

SEQ ID NO: 13966 - DNA, 20 bp, synthetic construct
  misc_feature 1..20: note = CRISPR gRNA sequence
  source 1..20: mol_type = other DNA
ggtgaccagctgggggacca

SEQ ID NO: 13967 - DNA, 20 bp, synthetic construct
  misc_feature 1..20: note = CRISPR gRNA sequence
  source 1..20: mol_type = other DNA
gtgaccagctgggggaccac

SEQ ID NO: 13968 - DNA, 20 bp, synthetic construct
  misc_feature 1..20: note = CRISPR gRNA sequence
  source 1..20: mol_type = other DNA
ccagctgggggaccacgggc

SEQ ID NO: 13969 - DNA, 20 bp, synthetic construct
  misc_feature 1..20: note = CRISPR gRNA sequence
  source 1..20: mol_type = other DNA
ggcaagtcacttaacctcac

SEQ ID NO: 13970 - DNA, 20 bp, synthetic construct
  misc_feature 1..20: note = CRISPR gRNA sequence
  source 1..20: mol_type = other DNA
gcaagtcacttaacctcacc

SEQ ID NO: 13971 - DNA, 20 bp, synthetic construct
  misc_feature 1..20: note = CRISPR gRNA sequence
  source 1..20: mol_type = other DNA
ccgtctcctcatctgtaaaa

SEQ ID NO: 13972 - DNA, 20 bp, synthetic construct
  misc_feature 1..20: note = CRISPR gRNA sequence
  source 1..20: mol_type = other DNA
cgtctcctcatctgtaaaat

SEQ ID NO: 13973 - DNA, 20 bp, synthetic construct
  misc_feature 1..20: note = CRISPR gRNA sequence
  source 1..20: mol_type = other DNA
gtctcctcatctgtaaaatg

SEQ ID NO: 13974 - DNA, 20 bp, synthetic construct
  misc_feature 1..20: note = CRISPR gRNA sequence
  source 1..20: mol_type = other DNA
tcctcatctgtaaaatgggg

SEQ ID NO: 13975 - DNA, 20 bp, synthetic construct
  misc_feature 1..20: note = CRISPR gRNA sequence
  source 1..20: mol_type = other DNA
tgatgactgtctgtcttcca

SEQ ID NO: 13976 - DNA, 20 bp, synthetic construct
  misc_feature 1..20: note = CRISPR gRNA sequence
  source 1..20: mol_type = other DNA
tgactgtctgtcttccacag

SEQ ID NO: 13977 - DNA, 20 bp, synthetic construct
  misc_feature 1..20: note = CRISPR gRNA sequence
  source 1..20: mol_type = other DNA
tgtcttccacagtagctctt

SEQ ID NO: 13978 - DNA, 20 bp, synthetic construct
  misc_feature 1..20: note = CRISPR gRNA sequence
  source 1..20: mol_type = other DNA
cagtagctcttgagattaat

SEQ ID NO: 13979 - DNA, 20 bp, synthetic construct
  misc_feature 1..20: note = CRISPR gRNA sequence
  source 1..20: mol_type = other DNA
tataaaatgcactgaattat

SEQ ID NO: 13980 - DNA, 20 bp, synthetic construct
  misc_feature 1..20: note = CRISPR gRNA sequence
  source 1..20: mol_type = other DNA
aaatgcactgaattataagc

SEQ ID NO: 13981 - DNA, 20 bp, synthetic construct
  misc_feature 1..20: note = CRISPR gRNA sequence
  source 1..20: mol_type = other DNA
aatgcactgaattataagct

SEQ ID NO: 13982 - DNA, 20 bp, synthetic construct
  misc_feature 1..20: note = CRISPR gRNA sequence
  source 1..20: mol_type = other DNA
actgaattataagctgggca

SEQ ID NO: 13983 - DNA, 20 bp, synthetic construct
  misc_feature 1..20: note = CRISPR gRNA sequence
  source 1..20: mol_type = other DNA
gaattataagctgggcatgg

SEQ ID NO: 13984 - DNA, 20 bp, synthetic construct
  misc_feature 1..20: note = CRISPR gRNA sequence
  source 1..20: mol_type = other DNA
gtggcttacacctgtaatcc

SEQ ID NO: 13985 - DNA, 20 bp, synthetic construct
  misc_feature 1..20: note = CRISPR gRNA sequence
  source 1..20: mol_type = other DNA
cacctgtaatcccagcactt

SEQ ID NO: 13986 - DNA, 20 bp, synthetic construct
  misc_feature 1..20: note = CRISPR gRNA sequence
  source 1..20: mol_type = other DNA
acctgtaatcccagcacttt

SEQ ID NO: 13987 - DNA, 20 bp, synthetic construct
  misc_feature 1..20: note = CRISPR gRNA sequence
  source 1..20: mol_type = other DNA
ctgtaatcccagcactttgg

SEQ ID NO: 13988 - DNA, 20 bp, synthetic construct
  misc_feature 1..20: note = CRISPR gRNA sequence
  source 1..20: mol_type = other DNA
tgtaatcccagcactttggg

SEQ ID NO: 13989 - DNA, 20 bp, synthetic construct
  misc_feature 1..20: note = CRISPR gRNA sequence
  source 1..20: mol_type = other DNA
tcccagcactttgggaggct

SEQ ID NO: 13990 - DNA, 20 bp, synthetic construct
  misc_feature 1..20: note = CRISPR gRNA sequence
  source 1..20: mol_type = other DNA
cccagcactttgggaggctg

SEQ ID NO: 13991 - DNA, 20 bp, synthetic construct
  misc_feature 1..20: note = CRISPR gRNA sequence
  source 1..20: mol_type = other DNA
agcactttgggaggctgagg

SEQ ID NO: 13992 - DNA, 20 bp, synthetic construct
  misc_feature 1..20: note = CRISPR gRNA sequence
  source 1..20: mol_type = other DNA
gcactttgggaggctgaggt

SEQ ID NO: 13993 - DNA, 20 bp, synthetic construct
  misc_feature 1..20: note = CRISPR gRNA sequence
  source 1..20: mol_type = other DNA
actttgggaggctgaggtgg

SEQ ID NO: 13994 - DNA, 20 bp, synthetic construct
  misc_feature 1..20: note = CRISPR gRNA sequence
  source 1..20: mol_type = other DNA
ctttgggaggctgaggtggg

SEQ ID NO: 13995 - DNA, 20 bp, synthetic construct
  misc_feature 1..20: note = CRISPR gRNA sequence
  source 1..20: mol_type = other DNA
ctgaggtgggaggaacatct

SEQ ID NO: 13996 - DNA, 20 bp, synthetic construct
  misc_feature 1..20: note = CRISPR gRNA sequence
  source 1..20: mol_type = other DNA
tgaggtgggaggaacatctg

SEQ ID NO: 13997 - DNA, 20 bp, synthetic construct
  misc_feature 1..20: note = CRISPR gRNA sequence
  source 1..20: mol_type = other DNA
gtgggaggaacatctgaggc

SEQ ID NO: 13998 - DNA, 20 bp, synthetic construct
  misc_feature 1..20: note = CRISPR gRNA sequence
  source 1..20: mol_type = other DNA
tgggaggaacatctgaggcc

SEQ ID NO: 13999 - DNA, 20 bp, synthetic construct
  misc_feature 1..20: note = CRISPR gRNA sequence
  source 1..20: mol_type = other DNA
ggaggaacatctgaggccag

SEQ ID NO: 14000 - DNA, 20 bp, synthetic construct
  misc_feature 1..20: note = CRISPR gRNA sequence
  source 1..20: mol_type = other DNA
acatctgaggccaggagttc

SEQ ID NO: 14001 - DNA, 20 bp, synthetic construct
  misc_feature 1..20: note = CRISPR gRNA sequence
  source 1..20: mol_type = other DNA
tgaggccaggagttcaagac

SEQ ID NO: 14002 - DNA, 20 bp, synthetic construct
  misc_feature 1..20: note = CRISPR gRNA sequence
  source 1..20: mol_type = other DNA
ccaggagttcaagaccagcc

SEQ ID NO: 14003 - DNA, 20 bp, synthetic construct
  misc_feature 1..20: note = CRISPR gRNA sequence
  source 1..20: mol_type = other DNA
caagaccagcctggccaaca

SEQ ID NO: 14004 - DNA, 20 bp, synthetic construct
  misc_feature 1..20: note = CRISPR gRNA sequence
  source 1..20: mol_type = other DNA
cagcctggccaacatggtta

SEQ ID NO: 14005 - DNA, 20 bp, synthetic construct
  misc_feature 1..20: note = CRISPR gRNA sequence
  source 1..20: mol_type = other DNA
tctactaaaaatacaaaaat

SEQ ID NO: 14006 - DNA, 20 bp, synthetic construct
  misc_feature 1..20: note = CRISPR gRNA sequence
  source 1..20: mol_type = other DNA
ctaaaaatacaaaaattagc

SEQ ID NO: 14007 - DNA, 20 bp, synthetic construct
  misc_feature 1..20: note = CRISPR gRNA sequence
  source 1..20: mol_type = other DNA
taaaaatacaaaaattagcc

SEQ ID NO: 14008 - DNA, 20 bp, synthetic construct
  misc_feature 1..20: note = CRISPR gRNA sequence
  source 1..20: mol_type = other DNA
atacaaaaattagccaggtg

SEQ ID NO: 14009 - DNA, 20 bp, synthetic construct
  misc_feature 1..20: note = CRISPR gRNA sequence
  source 1..20: mol_type = other DNA
caaaaattagccaggtgtag

SEQ ID NO: 14010 - DNA, 20 bp, synthetic construct
  misc_feature 1..20: note = CRISPR gRNA sequence
  source 1..20: mol_type = other DNA
gtggtgtacacctgtaatcc

SEQ ID NO: 14011 - DNA, 20 bp, synthetic construct
  misc_feature 1..20: note = CRISPR gRNA sequence
  source 1..20: mol_type = other DNA
cacctgtaatcccagctact

SEQ ID NO: 14012 - DNA, 20 bp, synthetic construct
  misc_feature 1..20: note = CRISPR gRNA sequence
  source 1..20: mol_type = other DNA
acctgtaatcccagctactc

SEQ ID NO: 14013 - DNA, 20 bp, synthetic construct
  misc_feature 1..20: note = CRISPR gRNA sequence
  source 1..20: mol_type = other DNA
ctgtaatcccagctactcgg

SEQ ID NO: 14014 - DNA, 20 bp, synthetic construct
  misc_feature 1..20: note = CRISPR gRNA sequence
  source 1..20: mol_type = other DNA
tgtaatcccagctactcggg

SEQ ID NO: 14015 - DNA, 20 bp, synthetic construct
  misc_feature 1..20: note = CRISPR gRNA sequence
  source 1..20: mol_type = other DNA
tcccagctactcgggaggct

SEQ ID NO: 14016 - DNA, 20 bp, synthetic construct
  misc_feature 1..20: note = CRISPR gRNA sequence
  source 1..20: mol_type = other DNA
cccagctactcgggaggctg

SEQ ID NO: 14017 - DNA, 20 bp, synthetic construct
  misc_feature 1..20: note = CRISPR gRNA sequence
  source 1..20: mol_type = other DNA
agctactcgggaggctgagg

SEQ ID NO: 14018 - DNA, 20 bp, synthetic construct
  misc_feature 1..20: note = CRISPR gRNA sequence
  source 1..20: mol_type = other DNA
gctactcgggaggctgaggc

SEQ ID NO: 14019 - DNA, 20 bp, synthetic construct
  misc_feature 1..20: note = CRISPR gRNA sequence
  source 1..20: mol_type = other DNA
gcaggaaaattgcttgaacc

SEQ ID NO: 14020 - DNA, 20 bp, synthetic construct
  misc_feature 1..20: note = CRISPR gRNA sequence
  source 1..20: mol_type = other DNA
aggaaaattgcttgaaccga

SEQ ID NO: 14021 - DNA, 20 bp, synthetic construct
  misc_feature 1..20: note = CRISPR gRNA sequence
  source 1..20: mol_type = other DNA
ggaaaattgcttgaaccgag

SEQ ID NO: 14022 - DNA, 20 bp, synthetic construct
  misc_feature 1..20: note = CRISPR gRNA sequence
  source 1..20: mol_type = other DNA
aaattgcttgaaccgagagg

SEQ ID NO: 14023 - DNA, 20 bp, synthetic construct
  misc_feature 1..20: note = CRISPR gRNA sequence
  source 1..20: mol_type = other DNA
attgcttgaaccgagaggtg

SEQ ID NO: 14024 - DNA, 20 bp, synthetic construct
  misc_feature 1..20: note = CRISPR gRNA sequence
  source 1..20: mol_type = other DNA
gaaccgagaggtggagattg

SEQ ID NO: 14025 - DNA, 20 bp, synthetic construct
  misc_feature 1..20: note = CRISPR gRNA sequence
  source 1..20: mol_type = other DNA
cgagaggtggagattgcagt

SEQ ID NO: 14026 - DNA, 20 bp, synthetic construct
  misc_feature 1..20: note = CRISPR gRNA sequence
  source 1..20: mol_type = other DNA
ggtggagattgcagtgagcc

SEQ ID NO: 14027 - DNA, 20 bp, synthetic construct
  misc_feature 1..20: note = CRISPR gRNA sequence
  source 1..20: mol_type = other DNA
aagatcataccactgcattc

SEQ ID NO: 14028 - DNA, 20 bp, synthetic construct
  misc_feature 1..20: note = CRISPR gRNA sequence
  source 1..20: mol_type = other DNA
cataccactgcattctagcc

SEQ ID NO: 14029 - DNA, 20 bp, synthetic construct
  misc_feature 1..20: note = CRISPR gRNA sequence
  source 1..20: mol_type = other DNA
ataccactgcattctagcct

SEQ ID NO: 14030 - DNA, 20 bp, synthetic construct
  misc_feature 1..20: note = CRISPR gRNA sequence
  source 1..20: mol_type = other DNA
ctgcattctagcctgggtga

SEQ ID NO: 14031 - DNA, 20 bp, synthetic construct
  misc_feature 1..20: note = CRISPR gRNA sequence
  source 1..20: mol_type = other DNA
gcattctagcctgggtgaca

SEQ ID NO: 14032 - DNA, 20 bp, synthetic construct
  misc_feature 1..20: note = CRISPR gRNA sequence
  source 1..20: mol_type = other DNA
tctagcctgggtgacagagc

SEQ ID NO: 14033 - DNA, 20 bp, synthetic construct
  misc_feature 1..20: note = CRISPR gRNA sequence
  source 1..20: mol_type = other DNA
accccatctccaaaaaaaaa

SEQ ID NO: 14034 - DNA, 20 bp, synthetic construct
  misc_feature 1..20: note = CRISPR gRNA sequence
  source 1..20: mol_type = other DNA
aaacagcaccgaatatacca

SEQ ID NO: 14035 - DNA, 20 bp, synthetic construct
  misc_feature 1..20: note = CRISPR gRNA sequence
  source 1..20: mol_type = other DNA
aacagcaccgaatataccac

SEQ ID NO: 14036 - DNA, 20 bp, synthetic construct
  misc_feature 1..20: note = CRISPR gRNA sequence
  source 1..20: mol_type = other DNA
aacaactccttcctaatcat

SEQ ID NO: 14037 - DNA, 20 bp, synthetic construct
  misc_feature 1..20: note = CRISPR gRNA sequence
  source 1..20: mol_type = other DNA
ttcctaatcattagatgatc

SEQ ID NO: 14038 - DNA, 20 bp, synthetic construct
  misc_feature 1..20: note = CRISPR gRNA sequence
  source 1..20: mol_type = other DNA
agatgatctagacccctacc

SEQ ID NO: 14039 - DNA, 20 bp, synthetic construct
  misc_feature 1..20: note = CRISPR gRNA sequence
  source 1..20: mol_type = other DNA
gatgatctagacccctacca

SEQ ID NO: 14040 - DNA, 20 bp, synthetic construct
  misc_feature 1..20: note = CRISPR gRNA sequence
  source 1..20: mol_type = other DNA
ccaaggaacaaacattcatt

SEQ ID NO: 14041 - DNA, 20 bp, synthetic construct
  misc_feature 1..20: note = CRISPR gRNA sequence
  source 1..20: mol_type = other DNA
cattcatttagctttttctg

SEQ ID NO: 14042 - DNA, 20 bp, synthetic construct
  misc_feature 1..20: note = CRISPR gRNA sequence
  source 1..20: mol_type = other DNA
tcatttagctttttctgtgg

SEQ ID NO: 14043 - DNA, 20 bp, synthetic construct
  misc_feature 1..20: note = CRISPR gRNA sequence
  source 1..20: mol_type = other DNA
catttagctttttctgtgga

SEQ ID NO: 14044 - DNA, 20 bp, synthetic construct
  misc_feature 1..20: note = CRISPR gRNA sequence
  source 1..20: mol_type = other DNA
tttagctttttctgtggaag

SEQ ID NO: 14045 - DNA, 20 bp, synthetic construct
  misc_feature 1..20: note = CRISPR gRNA sequence
  source 1..20: mol_type = other DNA
ctttttctgtggaaggagct

SEQ ID NO: 14046 - DNA, 20 bp, synthetic construct
  misc_feature 1..20: note = CRISPR gRNA sequence
  source 1..20: mol_type = other DNA
tttttctgtggaaggagctt

SEQ ID NO: 14047 - DNA, 20 bp, synthetic construct
  misc_feature 1..20: note = CRISPR gRNA sequence
  source 1..20: mol_type = other DNA
ttttctgtggaaggagctta

SEQ ID NO: 14048 - DNA, 20 bp, synthetic construct
  misc_feature 1..20: note = CRISPR gRNA sequence
  source 1..20: mol_type = other DNA
ctgtggaaggagcttagggc

SEQ ID NO: 14049 - DNA, 20 bp, synthetic construct
  misc_feature 1..20: note = CRISPR gRNA sequence
  source 1..20: mol_type = other DNA
tgtggaaggagcttagggcc

SEQ ID NO: 14050 - DNA, 20 bp, synthetic construct
  misc_feature 1..20: note = CRISPR gRNA sequence
  source 1..20: mol_type = other DNA
tgacctgacctttatgactt

SEQ ID NO: 14051 - DNA, 20 bp, synthetic construct
  misc_feature 1..20: note = CRISPR gRNA sequence
  source 1..20: mol_type = other DNA
gactttggataaacaattta

SEQ ID NO: 14052 - DNA, 20 bp, synthetic construct
  misc_feature 1..20: note = CRISPR gRNA sequence
  source 1..20: mol_type = other DNA
aatttaaagtctcttgttct

SEQ ID NO: 14053 - DNA, 20 bp, synthetic construct
  misc_feature 1..20: note = CRISPR gRNA sequence
  source 1..20: mol_type = other DNA
cagcattgccatttgtacaa

SEQ ID NO: 14054 - DNA, 20 bp, synthetic construct
  misc_feature 1..20: note = CRISPR gRNA sequence
  source 1..20: mol_type = other DNA
agcattgccatttgtacaat

SEQ ID NO: 14055 - DNA, 20 bp, synthetic construct
  misc_feature 1..20: note = CRISPR gRNA sequence
  source 1..20: mol_type = other DNA
gcattgccatttgtacaatg

SEQ ID NO: 14056 - DNA, 20 bp, synthetic construct
  misc_feature 1..20: note = CRISPR gRNA sequence
  source 1..20: mol_type = other DNA
attgccatttgtacaatggg

SEQ ID NO: 14057 - DNA, 20 bp, synthetic construct
  misc_feature 1..20: note = CRISPR gRNA sequence
  source 1..20: mol_type = other DNA
ggagatgatgacaatgcctg

SEQ ID NO: 14058 - DNA, 20 bp, synthetic construct
  misc_feature 1..20: note = CRISPR gRNA sequence
  source 1..20: mol_type = other DNA
agatgatgacaatgcctgta

SEQ ID NO: 14059 - DNA, 20 bp, synthetic construct
  misc_feature 1..20: note = CRISPR gRNA sequence
  source 1..20: mol_type = other DNA
gatgatgacaatgcctgtag

SEQ ID NO: 14060 - DNA, 20 bp, synthetic construct
  misc_feature 1..20: note = CRISPR gRNA sequence
  source 1..20: mol_type = other DNA
tgatgacaatgcctgtagag

SEQ ID NO: 14061 - DNA, 20 bp, synthetic construct
  misc_feature 1..20: note = CRISPR gRNA sequence
  source 1..20: mol_type = other DNA
gatgacaatgcctgtagagg

SEQ ID NO: 14062 - DNA, 20 bp, synthetic construct
  misc_feature 1..20: note = CRISPR gRNA sequence
  source 1..20: mol_type = other DNA
atgacaatgcctgtagagga

SEQ ID NO: 14063 - DNA, 20 bp, synthetic construct
  misc_feature 1..20: note = CRISPR gRNA sequence
  source 1..20: mol_type = other DNA
acaatgcctgtagaggaggg

SEQ ID NO: 14064 - DNA, 20 bp, synthetic construct
  misc_feature 1..20: note = CRISPR gRNA sequence
  source 1..20: mol_type = other DNA
cctgtagaggagggtggcct

SEQ ID NO: 14065 - DNA, 20 bp, synthetic construct
  misc_feature 1..20: note = CRISPR gRNA sequence
  source 1..20: mol_type = other DNA
gagggtggcctgagataatt

SEQ ID NO: 14066 - DNA, 20 bp, synthetic construct
  misc_feature 1..20: note = CRISPR gRNA sequence
  source 1..20: mol_type = other DNA
gtggcctgagataattgaga

SEQ ID NO: 14067 - DNA, 20 bp, synthetic construct
  misc_feature 1..20: note = CRISPR gRNA sequence
  source 1..20: mol_type = other DNA
gcctgagataattgagatgg

SEQ ID NO: 14068 - DNA, 20 bp, synthetic construct
  misc_feature 1..20: note = CRISPR gRNA sequence
  source 1..20: mol_type = other DNA
cctgagataattgagatgga

SEQ ID NO: 14069 - DNA, 20 bp, synthetic construct
  misc_feature 1..20: note = CRISPR gRNA sequence
  source 1..20: mol_type = other DNA
agataattgagatggaaggt

SEQ ID NO: 14070 - DNA, 20 bp, synthetic construct
  misc_feature 1..20: note = CRISPR gRNA sequence
  source 1..20: mol_type = other DNA
aaggtgagctgcaaatttaa

SEQ ID NO: 14071 - DNA, 20 bp, synthetic construct
  misc_feature 1..20: note = CRISPR gRNA sequence
  source 1..20: mol_type = other DNA
gcaaatttaaaagcctgttc

SEQ ID NO: 14072 - DNA, 20 bp, synthetic construct
  misc_feature 1..20: note = CRISPR gRNA sequence
  source 1..20: mol_type = other DNA
atttaaaagcctgttctggc

SEQ ID NO: 14073 - DNA, 20 bp, synthetic construct
  misc_feature 1..20: note = CRISPR gRNA sequence
  source 1..20: mol_type = other DNA
tttaaaagcctgttctggcc

SEQ ID NO: 14074 - DNA, 20 bp, synthetic construct
  misc_feature 1..20: note = CRISPR gRNA sequence
  source 1..20: mol_type = other DNA
aagcctgttctggccaggtg

SEQ ID NO: 14075 - DNA, 20 bp, synthetic construct
  misc_feature 1..20: note = CRISPR gRNA sequence
  source 1..20: mol_type = other DNA
agcctgttctggccaggtgc

SEQ ID NO: 14076 - DNA, 20 bp, synthetic construct
  misc_feature 1..20: note = CRISPR gRNA sequence
  source 1..20: mol_type = other DNA
cctgttctggccaggtgcgg

SEQ ID NO: 14077 - DNA, 20 bp, synthetic construct
  misc_feature 1..20: note = CRISPR gRNA sequence
  source 1..20: mol_type = other DNA
ggagctcgcacctgtaatcc

SEQ ID NO: 14078 - DNA, 20 bp, synthetic construct
  misc_feature 1..20: note = CRISPR gRNA sequence
  source 1..20: mol_type = other DNA
cacctgtaatcctagcactt

SEQ ID NO: 14079 - DNA, 20 bp, synthetic construct
  misc_feature 1..20: note = CRISPR gRNA sequence
  source 1..20: mol_type = other DNA
acctgtaatcctagcacttt

SEQ ID NO: 14080 - DNA, 20 bp, synthetic construct
  misc_feature 1..20: note = CRISPR gRNA sequence
  source 1..20: mol_type = other DNA
ctgtaatcctagcactttgg

SEQ ID NO: 14081 - DNA, 20 bp, synthetic construct
  misc_feature 1..20: note = CRISPR gRNA sequence
  source 1..20: mol_type = other DNA
tgtaatcctagcactttggg

SEQ ID NO: 14082 - DNA, 20 bp, synthetic construct
  misc_feature 1..20: note = CRISPR gRNA sequence
  source 1..20: mol_type = other DNA
tcctagcactttgggaggct

SEQ ID NO: 14083 - DNA, 20 bp, synthetic construct
  misc_feature 1..20: note = CRISPR gRNA sequence
  source 1..20: mol_type = other DNA
cctagcactttgggaggctg

SEQ ID NO: 14084 - DNA, 20 bp, synthetic construct
  misc_feature 1..20: note = CRISPR gRNA sequence
  source 1..20: mol_type = other DNA
agcactttgggaggctgagg

SEQ ID NO: 14085 - DNA, 20 bp, synthetic construct
  misc_feature 1..20: note = CRISPR gRNA sequence
  source 1..20: mol_type = other DNA
gcactttgggaggctgaggt

SEQ ID NO: 14086 - DNA, 20 bp, synthetic construct
  misc_feature 1..20: note = CRISPR gRNA sequence
  source 1..20: mol_type = other DNA
actttgggaggctgaggtgg

SEQ ID NO: 14087 - DNA, 20 bp, synthetic construct
  misc_feature 1..20: note = CRISPR gRNA sequence
  source 1..20: mol_type = other DNA
ctttgggaggctgaggtggg

SEQ ID NO: 14088 - DNA, 20 bp, synthetic construct
  misc_feature 1..20: note = CRISPR gRNA sequence
  source 1..20: mol_type = other DNA
ctgaggtgggaggattgctt

SEQ ID NO: 14089 - DNA, 20 bp, synthetic construct
  misc_feature 1..20: note = CRISPR gRNA sequence
  source 1..20: mol_type = other DNA
gtgggaggattgcttgagcc

SEQ ID NO: 14090 - DNA, 20 bp, synthetic construct
  misc_feature 1..20: note = CRISPR gRNA sequence
  source 1..20: mol_type = other DNA
tgggaggattgcttgagccc

SEQ ID NO: 14091 - DNA, 20 bp, synthetic construct
  misc_feature 1..20: note = CRISPR gRNA sequence
  source 1..20: mol_type = other DNA
ggaggattgcttgagcccag

SEQ ID NO: 14092 - DNA, 20 bp, synthetic construct
  misc_feature 1..20: note = CRISPR gRNA sequence
  source 1..20: mol_type = other DNA
ttgcttgagcccaggagctc

SEQ ID NO: 14093 - DNA, 20 bp, synthetic construct
  misc_feature 1..20: note = CRISPR gRNA sequence
  source 1..20: mol_type = other DNA
tgagcccaggagctcgagac

SEQ ID NO: 14094 - DNA, 20 bp, synthetic construct
  misc_feature 1..20: note = CRISPR gRNA sequence
  source 1..20: mol_type = other DNA
ccaggagctcgagaccagac

SEQ ID NO: 14095 - DNA, 20 bp, synthetic construct
  misc_feature 1..20: note = CRISPR gRNA sequence
  source 1..20: mol_type = other DNA
caggagctcgagaccagact

SEQ ID NO: 14096 - DNA, 20 bp, synthetic construct
  misc_feature 1..20: note = CRISPR gRNA sequence
  source 1..20: mol_type = other DNA
cgagaccagactgggcaaca

SEQ ID NO: 14097 - DNA, 20 bp, synthetic construct
  misc_feature 1..20: note = CRISPR gRNA sequence
  source 1..20: mol_type = other DNA
tctacaaaaaatacaaaaat

SEQ ID NO: 14098 - DNA, 20 bp, synthetic construct
  misc_feature 1..20: note = CRISPR gRNA sequence
  source 1..20: mol_type = other DNA
caaaaaatacaaaaattagt

SEQ ID NO: 14099 - DNA, 20 bp, synthetic construct
  misc_feature 1..20: note = CRISPR gRNA sequence
  source 1..20: mol_type = other DNA
aaaaaatacaaaaattagtc

SEQ ID NO: 14100 - DNA, 20 bp, synthetic construct
  misc_feature 1..20: note = CRISPR gRNA sequence
  source 1..20: mol_type = other DNA
aaatacaaaaattagtcagg

SEQ ID NO: 14101 - DNA, 20 bp, synthetic construct
  misc_feature 1..20: note = CRISPR gRNA sequence
  source 1..20: mol_type = other DNA
aatacaaaaattagtcaggt

SEQ ID NO: 14102 - DNA, 20 bp, synthetic construct
  misc_feature 1..20: note = CRISPR gRNA sequence
  source 1..20: mol_type = other DNA
atacaaaaattagtcaggtg

SEQ ID NO: 14103 - DNA, 20 bp, synthetic construct
  misc_feature 1..20: note = CRISPR gRNA sequence
  source 1..20: mol_type = other DNA
agtcaggtggggcatgcctg

SEQ ID NO: 14104 - DNA, 20 bp, synthetic construct
  misc_feature 1..20: note = CRISPR gRNA sequence
  source 1..20: mol_type = other DNA
gtggggcatgcctgtagtcc

SEQ ID NO: 14105 - DNA, 20 bp, synthetic construct
  misc_feature 1..20: note = CRISPR gRNA sequence
  source 1..20: mol_type = other DNA
atgcctgtagtcccagctac

SEQ ID NO: 14106 - DNA, 20 bp, synthetic construct
  misc_feature 1..20: note = CRISPR gRNA sequence
  source 1..20: mol_type = other DNA
tgcctgtagtcccagctact

SEQ ID NO: 14107 - DNA, 20 bp, synthetic construct
  misc_feature 1..20: note = CRISPR gRNA sequence
  source 1..20: mol_type = other DNA
gcctgtagtcccagctacta

SEQ ID NO: 14108 - DNA, 20 bp, synthetic construct
  misc_feature 1..20: note = CRISPR gRNA sequence
  source 1..20: mol_type = other DNA
ctgtagtcccagctactagg

SEQ ID NO: 14109 - DNA, 20 bp, synthetic construct
  misc_feature 1..20: note = CRISPR gRNA sequence
  source 1..20: mol_type = other DNA
tgtagtcccagctactaggg

SEQ ID NO: 14110 - DNA, 20 bp, synthetic construct
  misc_feature 1..20: note = CRISPR gRNA sequence
  source 1..20: mol_type = other DNA
tcccagctactagggaggct

SEQ ID NO: 14111 - DNA, 20 bp, synthetic construct
  misc_feature 1..20: note = CRISPR gRNA sequence
  source 1..20: mol_type = other DNA
cccagctactagggaggctg

SEQ ID NO: 14112 - DNA, 20 bp, synthetic construct
  misc_feature 1..20: note = CRISPR gRNA sequence
  source 1..20: mol_type = other DNA
agctactagggaggctgagg

SEQ ID NO: 14113 - DNA, 20 bp, synthetic construct
  misc_feature 1..20: note = CRISPR gRNA sequence
  source 1..20: mol_type = other DNA
gctactagggaggctgaggt

SEQ ID NO: 14114 - DNA, 20 bp, synthetic construct
  misc_feature 1..20: note = CRISPR gRNA sequence
  source 1..20: mol_type = other DNA
tactagggaggctgaggtgg

SEQ ID NO: 14115 - DNA, 20 bp, synthetic construct
  misc_feature 1..20: note = CRISPR gRNA sequence
  source 1..20: mol_type = other DNA
actagggaggctgaggtggg

SEQ ID NO: 14116 - DNA, 20 bp, synthetic construct
  misc_feature 1..20: note = CRISPR gRNA sequence
  source 1..20: mol_type = other DNA
ctgaggtgggaggatcactt

SEQ ID NO: 14117 - DNA, 20 bp, synthetic construct
  misc_feature 1..20: note = CRISPR gRNA sequence
  source 1..20: mol_type = other DNA
gtgggaggatcacttgagcc

SEQ ID NO: 14118 - DNA, 20 bp, synthetic construct
  misc_feature 1..20: note = CRISPR gRNA sequence
  source 1..20: mol_type = other DNA
tgggaggatcacttgagcct

SEQ ID NO: 14119 - DNA, 20 bp, synthetic construct
  misc_feature 1..20: note = CRISPR gRNA sequence
  source 1..20: mol_type = other DNA
gggaggatcacttgagccta

SEQ ID NO: 14120 - DNA, 20 bp, synthetic construct
  misc_feature 1..20: note = CRISPR gRNA sequence
  source 1..20: mol_type = other DNA
gaggatcacttgagcctagg

SEQ ID NO: 14121 - DNA, 20 bp, synthetic construct
  misc_feature 1..20: note = CRISPR gRNA sequence
  source 1..20: mol_type = other DNA
aggatcacttgagcctaggg

SEQ ID NO: 14122 - DNA, 20 bp, synthetic construct
  misc_feature 1..20: note = CRISPR gRNA sequence
  source 1..20: mol_type = other DNA
cacttgagcctagggaggtt

SEQ ID NO: 14123 - DNA, 20 bp, synthetic construct
  misc_feature 1..20: note = CRISPR gRNA sequence
  source 1..20: mol_type = other DNA
acttgagcctagggaggttg

SEQ ID NO: 14124 - DNA, 20 bp, synthetic construct
  misc_feature 1..20: note = CRISPR gRNA sequence
  source 1..20: mol_type = other DNA
gcctagggaggttgaggctg

SEQ ID NO: 14125 - DNA, 20 bp, synthetic construct
  misc_feature 1..20: note = CRISPR gRNA sequence
  source 1..20: mol_type = other DNA
agggaggttgaggctgtggt

SEQ ID NO: 14126 - DNA, 20 bp, synthetic construct
  misc_feature 1..20: note = CRISPR gRNA sequence
  source 1..20: mol_type = other DNA
gtgattgtgccactgaactc

SEQ ID NO: 14127 - DNA, 20 bp, synthetic construct
  misc_feature 1..20: note = CRISPR gRNA sequence
  source 1..20: mol_type = other DNA
gtgccactgaactccagcct

SEQ ID NO: 14128 - DNA, 20 bp, synthetic construct
  misc_feature 1..20: note = CRISPR gRNA sequence
  source 1..20: mol_type = other DNA
tgccactgaactccagcctg

SEQ ID NO: 14129 - DNA, 20 bp, synthetic construct
  misc_feature 1..20: note = CRISPR gRNA sequence
  source 1..20: mol_type = other DNA
gccactgaactccagcctga

SEQ ID NO: 14130 - DNA, 20 bp, synthetic construct
  misc_feature 1..20: note = CRISPR gRNA sequence
  source 1..20: mol_type = other DNA
ctgaactccagcctgaggga

SEQ ID NO: 14131 - DNA, 20 bp, synthetic construct
  misc_feature 1..20: note = CRISPR gRNA sequence
  source 1..20: mol_type = other DNA
gaactccagcctgagggaca

SEQ ID NO: 14132 - DNA, 20 bp, synthetic construct
  misc_feature 1..20: note = CRISPR gRNA sequence
  source 1..20: mol_type = other DNA
tccagcctgagggacagagt

SEQ ID NO: 14133 - DNA, 20 bp, synthetic construct
  misc_feature 1..20: note = CRISPR gRNA sequence
  source 1..20: mol_type = other DNA
acagagtaagactctgcctc

SEQ ID NO: 14134 - DNA, 20 bp, synthetic construct
  misc_feature 1..20: note = CRISPR gRNA sequence
  source 1..20: mol_type = other DNA
agtaagactctgcctcaaga

SEQ ID NO: 14135 - DNA, 20 bp, synthetic construct
  misc_feature 1..20: note = CRISPR gRNA sequence
  source 1..20: mol_type = other DNA
gactctgcctcaagaaagaa

SEQ ID NO: 14136 - DNA, 20 bp, synthetic construct
  misc_feature 1..20: note = CRISPR gRNA sequence
  source 1..20: mol_type = other DNA
tgcctcaagaaagaaaagaa

SEQ ID NO: 14137 - DNA, 20 bp, synthetic construct
  misc_feature 1..20: note = CRISPR gRNA sequence
  source 1..20: mol_type = other DNA
gcctcaagaaagaaaagaaa

SEQ ID NO: 14138 - DNA, 20 bp, synthetic construct
  misc_feature 1..20: note = CRISPR gRNA sequence
  source 1..20: mol_type = other DNA
caagaaagaaaagaaaagga

SEQ ID NO: 14139 - DNA, 20 bp, synthetic construct
  misc_feature 1..20: note = CRISPR gRNA sequence
  source 1..20: mol_type = other DNA
aagaaaagaaaaggaaagaa

SEQ ID NO: 14140 - DNA, 20 bp, synthetic construct
  misc_feature 1..20: note = CRISPR gRNA sequence
  source 1..20: mol_type = other DNA
agaaaagaaaaggaaagaaa

SEQ ID NO: 14141 - DNA, 20 bp, synthetic construct
  misc_feature 1..20: note = CRISPR gRNA sequence
  source 1..20: mol_type = other DNA
aagaaaaggaaagaaaagga

SEQ ID NO: 14142 - DNA, 20 bp, synthetic construct
  misc_feature 1..20: note = CRISPR gRNA sequence
  source 1..20: mol_type = other DNA
agaaaaggaaagaaaaggaa

SEQ ID NO: 14143 - DNA, 20 bp, synthetic construct
  misc_feature 1..20: note = CRISPR gRNA sequence
  source 1..20: mol_type = other DNA
ggaaagaaaaggaaaggaaa

SEQ ID NO: 14144 - DNA, 20 bp, synthetic construct
  misc_feature 1..20: note = CRISPR gRNA sequence
  source 1..20: mol_type = other DNA
aagaaaaggaaaggaaaaag

SEQ ID NO: 14145 - DNA, 20 bp, synthetic construct
  misc_feature 1..20: note = CRISPR gRNA sequence
  source 1..20: mol_type = other DNA
agaaaaggaaaggaaaaaga

SEQ ID NO: 14146 - DNA, 20 bp, synthetic construct
  misc_feature 1..20: note = CRISPR gRNA sequence
  source 1..20: mol_type = other DNA
aaaggaaaggaaaaagaagg

SEQ ID NO: 14147 - DNA, 20 bp, synthetic construct
  misc_feature 1..20: note = CRISPR gRNA sequence
  source 1..20: mol_type = other DNA
aaggaaaggaaaaagaagga

SEQ ID NO: 14148 - DNA, 20 bp, synthetic construct
  misc_feature 1..20: note = CRISPR gRNA sequence
  source 1..20: mol_type = other DNA
gaaaggaaaaagaaggaagg

SEQ ID NO: 14149 - DNA, 20 bp, synthetic construct
  misc_feature 1..20: note = CRISPR gRNA sequence
  source 1..20: mol_type = other DNA
aaggaaaaagaaggaaggaa

SEQ ID NO: 14150 - DNA, 20 bp, synthetic construct
  misc_feature 1..20: note = CRISPR gRNA sequence
  source 1..20: mol_type = other DNA
gaaaaagaaggaaggaagag

SEQ ID NO: 14151 - DNA, 20 bp, synthetic construct
  misc_feature 1..20: note = CRISPR gRNA sequence
  source 1..20: mol_type = other DNA
aaaaagaaggaaggaagaga

SEQ ID NO: 14152 - DNA, 20 bp, synthetic construct
  misc_feature 1..20: note = CRISPR gRNA sequence
  source 1..20: mol_type = other DNA
aagaaggaaggaagagaagg

SEQ ID NO: 14153 - DNA, 20 bp, synthetic construct
  misc_feature 1..20: note = CRISPR gRNA sequence
  source 1..20: mol_type = other DNA
agaaggaaggaagagaagga

SEQ ID NO: 14154 - DNA, 20 bp, synthetic construct
  misc_feature 1..20: note = CRISPR gRNA sequence
  source 1..20: mol_type = other DNA
gaaggaaggaagagaaggaa

SEQ ID NO: 14155 - DNA, 20 bp, synthetic construct
  misc_feature 1..20: note = CRISPR gRNA sequence
  source 1..20: mol_type = other DNA
aggaaggaagagaaggaagg

SEQ ID NO: 14156 - DNA, 20 bp, synthetic construct
  misc_feature 1..20: note = CRISPR gRNA sequence
  source 1..20: mol_type = other DNA
ggaaggaagagaaggaaggg

SEQ ID NO: 14157 - DNA, 20 bp, synthetic construct
  misc_feature 1..20: note = CRISPR gRNA sequence
  source 1..20: mol_type = other DNA
gaaggaagagaaggaaggga

SEQ ID NO: 14158 - DNA, 20 bp, synthetic construct
  misc_feature 1..20: note = CRISPR gRNA sequence
  source 1..20: mol_type = other DNA
ggaagagaaggaagggaggg

SEQ ID NO: 14159 - DNA, 20 bp, synthetic construct
  misc_feature 1..20: note = CRISPR gRNA sequence
  source 1..20: mol_type = other DNA
gaagagaaggaagggaggga

SEQ ID NO: 14160 - DNA, 20 bp, synthetic construct
  misc_feature 1..20: note = CRISPR gRNA sequence
  source 1..20: mol_type = other DNA
agaaggaagggagggaagga

SEQ ID NO: 14161 - DNA, 20 bp, synthetic construct
  misc_feature 1..20: note = CRISPR gRNA sequence
  source 1..20: mol_type = other DNA
aaggaagggagggaaggaaa

SEQ ID NO: 14162 - DNA, 20 bp, synthetic construct
  misc_feature 1..20: note = CRISPR gRNA sequence
  source 1..20: mol_type = other DNA
aagggagggaaggaaagaga

SEQ ID NO: 14163 - DNA, 20 bp, synthetic construct
  misc_feature 1..20: note = CRISPR gRNA sequence
  source 1..20: mol_type = other DNA
gagggaaggaaagagaaaga

SEQ ID NO: 14164 - DNA, 20 bp, synthetic construct
  misc_feature 1..20: note = CRISPR gRNA sequence
  source 1..20: mol_type = other DNA
gggaaggaaagagaaagaaa

SEQ ID NO: 14165 - DNA, 20 bp, synthetic construct
  misc_feature 1..20: note = CRISPR gRNA sequence
  source 1..20: mol_type = other DNA
ggaaagagaaagaaagagaa

SEQ ID NO: 14166 - DNA, 20 bp, synthetic construct
  misc_feature 1..20: note = CRISPR gRNA sequence
  source 1..20: mol_type = other DNA
agagaaagaaagagaatgga

SEQ ID NO: 14167 - DNA, 20 bp, synthetic construct
  misc_feature 1..20: note = CRISPR gRNA sequence
  source 1..20: mol_type = other DNA
aaagaaagagaatggaaaga

SEQ ID NO: 14168 - DNA, 20 bp, synthetic construct
  misc_feature 1..20: note = CRISPR gRNA sequence
  source 1..20: mol_type = other DNA
aaagagaatggaaagaaaga

SEQ ID NO: 14169 - DNA, 20 bp, synthetic construct
  misc_feature 1..20: note = CRISPR gRNA sequence
  source 1..20: mol_type = other DNA
agagaatggaaagaaagaaa

SEQ ID NO: 14170 - DNA, 20 bp, synthetic construct
  misc_feature 1..20: note = CRISPR gRNA sequence
  source 1..20: mol_type = other DNA
aatggaaagaaagaaagaga

SEQ ID NO: 14171 - DNA, 20 bp, synthetic construct
  misc_feature 1..20: note = CRISPR gRNA sequence
  source 1..20: mol_type = other DNA
atggaaagaaagaaagagaa

SEQ ID NO: 14172 - DNA, 20 bp, synthetic construct
  misc_feature 1..20: note = CRISPR gRNA sequence
  source 1..20: mol_type = other DNA
ggaaagaaagaaagagaaag

SEQ ID NO: 14173 - DNA, 20 bp, synthetic construct
  misc_feature 1..20: note = CRISPR gRNA sequence
  source 1..20: mol_type = other DNA
aaagaaagaaagagaaagga

SEQ ID NO: 14174 - DNA, 20 bp, synthetic construct
  misc_feature 1..20: note = CRISPR gRNA sequence
  source 1..20: mol_type = other DNA
aaagaaagagaaaggagaga

SEQ ID NO: 14175 - DNA, 20 bp, synthetic construct
  misc_feature 1..20: note = CRISPR gRNA sequence
  source 1..20: mol_type = other DNA
aagaaagagaaaggagagaa

SEQ ID NO: 14176 - DNA, 20 bp, synthetic construct
  misc_feature 1..20: note = CRISPR gRNA sequence
  source 1..20: mol_type = other DNA
aagagaaaggagagaaagga

SEQ ID NO: 14177 - DNA, 20 bp, synthetic construct
  misc_feature 1..20: note = CRISPR gRNA sequence
  source 1..20: mol_type = other DNA
gaaaggagagaaaggaaaga

SEQ ID NO: 14178 - DNA, 20 bp, synthetic construct
  misc_feature 1..20: note = CRISPR gRNA sequence
  source 1..20: mol_type = other DNA
gagagaaaggaaagaaagaa

SEQ ID NO: 14179 - DNA, 20 bp, synthetic construct
  misc_feature 1..20: note = CRISPR gRNA sequence
  source 1..20: mol_type = other DNA
agaaaggaaagaaagaaaag

SEQ ID NO: 14180 - DNA, 20 bp, synthetic construct
  misc_feature 1..20: note = CRISPR gRNA sequence
  source 1..20: mol_type = other DNA
gaaaggaaagaaagaaaaga

SEQ ID NO: 14181 - DNA, 20 bp, synthetic construct
  misc_feature 1..20: note = CRISPR gRNA sequence
  source 1..20: mol_type = other DNA
ggaaagaaagaaaagaagga

SEQ ID NO: 14182 - DNA, 20 bp, synthetic construct
  misc_feature 1..20: note = CRISPR gRNA sequence
  source 1..20: mol_type = other DNA
agaaagaaaagaaggaaaga

SEQ ID NO: 14183 - DNA, 20 bp, synthetic construct
  misc_feature 1..20: note = CRISPR gRNA sequence
  source 1..20: mol_type = other DNA
agaaaagaaggaaagaaaga

SEQ ID NO: 14184 - DNA, 20 bp, synthetic construct
  misc_feature 1..20: note = CRISPR gRNA sequence
  source 1..20: mol_type = other DNA
aagaaggaaagaaagaaaga

SEQ ID NO: 14185 - DNA, 20 bp, synthetic construct
  misc_feature 1..20: note = CRISPR gRNA sequence
  source 1..20: mol_type = other DNA
gaaggaaagaaagaaagaaa

SEQ ID NO: 14186 - DNA, 20 bp, synthetic construct
  misc_feature 1..20: note = CRISPR gRNA sequence
  source 1..20: mol_type = other DNA
aggaaagaaagaaagaaaga

SEQ ID NO: 14187 - DNA, 20 bp, synthetic construct
  misc_feature 1..20: note = CRISPR gRNA sequence
  source 1..20: mol_type = other DNA
gaaagaaagaaagaaagaga

SEQ ID NO: 14188 - DNA, 20 bp, synthetic construct
  misc_feature 1..20: note = CRISPR gRNA sequence
  source 1..20: mol_type = other DNA
gaaagaaagaaagagagaga

SEQ ID NO: 14189 - DNA, 20 bp, synthetic construct
  misc_feature 1..20: note = CRISPR gRNA sequence
  source 1..20: mol_type = other DNA
aaagaaagaaagagagagat

SEQ ID NO: 14190 - DNA, 20 bp, synthetic construct
  misc_feature 1..20: note = CRISPR gRNA sequence
  source 1..20: mol_type = other DNA
aagaaagaaagagagagata

SEQ ID NO: 14191 - DNA, 20 bp, synthetic construct
  misc_feature 1..20: note = CRISPR gRNA sequence
  source 1..20: mol_type = other DNA
gaaagaaagagagagatagg

SEQ ID NO: 14192 - DNA, 20 bp, synthetic construct
  misc_feature 1..20: note = CRISPR gRNA sequence
  source 1..20: mol_type = other DNA
aaagaaagagagagataggg

SEQ ID NO: 14193 - DNA, 20 bp, synthetic construct
  misc_feature 1..20: note = CRISPR gRNA sequence
  source 1..20: mol_type = other DNA
aagaaagagagagataggga

SEQ ID NO: 14194 - DNA, 20 bp, synthetic construct
  misc_feature 1..20: note = CRISPR gRNA sequence
  source 1..20: mol_type = other DNA
gaaagagagagatagggagg

SEQ ID NO: 14195 - DNA, 20 bp, synthetic construct
  misc_feature 1..20: note = CRISPR gRNA sequence
  source 1..20: mol_type = other DNA
aaagagagagatagggaggg

SEQ ID NO: 14196 - DNA, 20 bp, synthetic construct
  misc_feature 1..20: note = CRISPR gRNA sequence
  source 1..20: mol_type = other DNA
gagagagatagggagggagg

SEQ ID NO: 14197 - DNA, 20 bp, synthetic construct
  misc_feature 1..20: note = CRISPR gRNA sequence
  source 1..20: mol_type = other DNA
agagagatagggagggagga

SEQ ID NO: 14198 - DNA, 20 bp, synthetic construct
  misc_feature 1..20: note = CRISPR gRNA sequence
  source 1..20: mol_type = other DNA
gagatagggagggaggaagg

SEQ ID NO: 14199 - DNA, 20 bp, synthetic construct
  misc_feature 1..20: note = CRISPR gRNA sequence
  source 1..20: mol_type = other DNA
agatagggagggaggaagga

SEQ ID NO: 14200 - DNA, 20 bp, synthetic construct
  misc_feature 1..20: note = CRISPR gRNA sequence
  source 1..20: mol_type = other DNA
gatagggagggaggaaggaa

SEQ ID NO: 14201 - DNA, 20 bp, synthetic construct
  misc_feature 1..20: note = CRISPR gRNA sequence
  source 1..20: mol_type = other DNA
tagggagggaggaaggaagg

SEQ ID NO: 14202 - DNA, 20 bp, synthetic construct
  misc_feature 1..20: note = CRISPR gRNA sequence
  source 1..20: mol_type = other DNA
gggagggaggaaggaaggga

SEQ ID NO: 14203 - DNA, 20 bp, synthetic construct
  misc_feature 1..20: note = CRISPR gRNA sequence
  source 1..20: mol_type = other DNA
gagggaggaaggaagggaga

SEQ ID NO: 14204 - DNA, 20 bp, synthetic construct
  misc_feature 1..20: note = CRISPR gRNA sequence
  source 1..20: mol_type = other DNA
gggaggaaggaagggagaga

SEQ ID NO: 14205 - DNA, 20 bp, synthetic construct
  misc_feature 1..20: note = CRISPR gRNA sequence
  source 1..20: mol_type = other DNA
gaggaaggaagggagagaga

SEQ ID NO: 14206 - DNA, 20 bp, synthetic construct
  misc_feature 1..20: note = CRISPR gRNA sequence
  source 1..20: mol_type = other DNA
ggaaggaagggagagagaga

SEQ ID NO: 14207 - DNA, 20 bp, synthetic construct
  misc_feature 1..20: note = CRISPR gRNA sequence
  source 1..20: mol_type = other DNA
ggaagggagagagagagaga

SEQ ID NO: 14208 - DNA, 20 bp, synthetic construct
  misc_feature 1..20: note = CRISPR gRNA sequence
  source 1..20: mol_type = other DNA
gggagagagagagagaaaga

SEQ ID NO: 14209 - DNA, 20 bp, synthetic construct
  misc_feature 1..20: note = CRISPR gRNA sequence
  source 1..20: mol_type = other DNA
gagagagagagaaagaaaga

SEQ ID NO: 14210 - DNA, 20 bp, synthetic construct
  misc_feature 1..20: note = CRISPR gRNA sequence
  source 1..20: mol_type = other DNA
gagagaaagaaagaaagaaa

SEQ ID NO: 14211 - DNA, 20 bp, synthetic construct
  misc_feature 1..20: note = CRISPR gRNA sequence
  source 1..20: mol_type = other DNA
gagaaagaaagaaagaaaca

SEQ ID NO: 14212 - DNA, 20 bp, synthetic construct
  misc_feature 1..20: note = CRISPR gRNA sequence
  source 1..20: mol_type = other DNA
gaaagaaagaaagaaacaga

SEQ ID NO: 14213 - DNA, 20 bp, synthetic construct
  misc_feature 1..20: note = CRISPR gRNA sequence
  source 1..20: mol_type = other DNA
gaaagaaagaaacagagaga

SEQ ID NO: 14214 - DNA, 20 bp, synthetic construct
  misc_feature 1..20: note = CRISPR gRNA sequence
  source 1..20: mol_type = other DNA
aagaaacagagagaaagaaa

SEQ ID NO: 14215 - DNA, 20 bp, synthetic construct
  misc_feature 1..20: note = CRISPR gRNA sequence
  source 1..20: mol_type = other DNA
aaacagagagaaagaaaaag

SEQ ID NO: 14216 - DNA, 20 bp, synthetic construct
  misc_feature 1..20: note = CRISPR gRNA sequence
  source 1..20: mol_type = other DNA
gagagaaagaaaaagaagaa

SEQ ID NO: 14217 - DNA, 20 bp, synthetic construct
  misc_feature 1..20: note = CRISPR gRNA sequence
  source 1..20: mol_type = other DNA
agagaaagaaaaagaagaaa

SEQ ID NO: 14218 - DNA, 20 bp, synthetic construct
  misc_feature 1..20: note = CRISPR gRNA sequence
  source 1..20: mol_type = other DNA
gagaaagaaaaagaagaaaa

SEQ ID NO: 14219 - DNA, 20 bp, synthetic construct
  misc_feature 1..20: note = CRISPR gRNA sequence
  source 1..20: mol_type = other DNA
agaaagaaaaagaagaaaag

SEQ ID NO: 14220 - DNA, 20 bp, synthetic construct
  misc_feature 1..20: note = CRISPR gRNA sequence
  source 1..20: mol_type = other DNA
gaaagaaaaagaagaaaagg

SEQ ID NO: 14221 - DNA, 20 bp, synthetic construct
  misc_feature 1..20: note = CRISPR gRNA sequence
  source 1..20: mol_type = other DNA
agaaaaagaagaaaaggggg

SEQ ID NO: 14222 - DNA, 20 bp, synthetic construct
  misc_feature 1..20: note = CRISPR gRNA sequence
  source 1..20: mol_type = other DNA
aaaagaagaaaagggggaag

SEQ ID NO: 14223 - DNA, 20 bp, synthetic construct
  misc_feature 1..20: note = CRISPR gRNA sequence
  source 1..20: mol_type = other DNA
aaagaagaaaagggggaaga

SEQ ID NO: 14224 - DNA, 20 bp, synthetic construct
  misc_feature 1..20: note = CRISPR gRNA sequence
  source 1..20: mol_type = other DNA
aagaagaaaagggggaagaa

SEQ ID NO: 14225 - DNA, 20 bp, synthetic construct
  misc_feature 1..20: note = CRISPR gRNA sequence
  source 1..20: mol_type = other DNA
gaagaaaagggggaagaagg

SEQ ID NO: 14226 - DNA, 20 bp, synthetic construct
  misc_feature 1..20: note = CRISPR gRNA sequence
  source 1..20: mol_type = other DNA
aagaaaagggggaagaaggg

SEQ ID NO: 14227 - DNA, 20 bp, synthetic construct
  misc_feature 1..20: note = CRISPR gRNA sequence
  source 1..20: mol_type = other DNA
agaaaagggggaagaaggga

SEQ ID NO: 14228 - DNA, 20 bp, synthetic construct
  misc_feature 1..20: note = CRISPR gRNA sequence
  source 1..20: mol_type = other DNA
aaaagggggaagaagggagg

SEQ ID NO: 14229 - DNA, 20 bp, synthetic construct
  misc_feature 1..20: note = CRISPR gRNA sequence
  source 1..20: mol_type = other DNA
aaagggggaagaagggaggg

SEQ ID NO: 14230 - DNA, 20 bp, synthetic construct
  misc_feature 1..20: note = CRISPR gRNA sequence
  source 1..20: mol_type = other DNA
aagggggaagaagggaggga

SEQ ID NO: 14231 - DNA, 20 bp, synthetic construct
  misc_feature 1..20: note = CRISPR gRNA sequence
  source 1..20: mol_type = other DNA
ggggaagaagggagggaggg

SEQ ID NO: 14232 - DNA, 20 bp, synthetic construct
  misc_feature 1..20: note = CRISPR gRNA sequence
  source 1..20: mol_type = other DNA
gggaagaagggagggaggga

SEQ ID NO: 14233 - DNA, 20 bp, synthetic construct
  misc_feature 1..20: note = CRISPR gRNA sequence
  source 1..20: mol_type = other DNA
aagaagggagggagggaagg

SEQ ID NO: 14234 - DNA, 20 bp, synthetic construct
  misc_feature 1..20: note = CRISPR gRNA sequence
  source 1..20: mol_type = other DNA
agaagggagggagggaagga

SEQ ID NO: 14235 - DNA, 20 bp, synthetic construct
  misc_feature 1..20: note = CRISPR gRNA sequence
  source 1..20: mol_type = other DNA
agggagggagggaaggaagg

SEQ ID NO: 14236 - DNA, 20 bp, synthetic construct
  misc_feature 1..20: note = CRISPR gRNA sequence
  source 1..20: mol_type = other DNA
gggagggagggaaggaagga

SEQ ID NO: 14237 - DNA, 20 bp, synthetic construct
  misc_feature 1..20: note = CRISPR gRNA sequence
  source 1..20: mol_type = other DNA
gagggagggaaggaaggaag

SEQ ID NO: 14238 - DNA, 20 bp, synthetic construct
  misc_feature 1..20: note = CRISPR gRNA sequence
  source 1..20: mol_type = other DNA
agggagggaaggaaggaagg

SEQ ID NO: 14239 - DNA, 20 bp, synthetic construct
  misc_feature 1..20: note = CRISPR gRNA sequence
  source 1..20: mol_type = other DNA
gggagggaaggaaggaagga

SEQ ID NO: 14240 - DNA, 20 bp, synthetic construct
  misc_feature 1..20: note = CRISPR gRNA sequence
  source 1..20: mol_type = other DNA
gagggaaggaaggaaggagg

SEQ ID NO: 14241 - DNA, 20 bp, synthetic construct
  misc_feature 1..20: note = CRISPR gRNA sequence
  source 1..20: mol_type = other DNA
agggaaggaaggaaggaggg

SEQ ID NO: 14242 - DNA, 20 bp, synthetic construct
  misc_feature 1..20: note = CRISPR gRNA sequence
  source 1..20: mol_type = other DNA
gggaaggaaggaaggaggga

SEQ ID NO: 14243 - DNA, 20 bp, synthetic construct
  misc_feature 1..20: note = CRISPR gRNA sequence
  source 1..20: mol_type = other DNA
gaaggaaggaaggagggagg

SEQ ID NO: 14244 - DNA, 20 bp, synthetic construct
  misc_feature 1..20: note = CRISPR gRNA sequence
  source 1..20: mol_type = other DNA
aaggaaggaaggagggaggg

SEQ ID NO: 14245 - DNA, 20 bp, synthetic construct
  misc_feature 1..20: note = CRISPR gRNA sequence
  source 1..20: mol_type = other DNA
aggaaggaaggagggaggga

SEQ ID NO: 14246 - DNA, 20 bp, synthetic construct
  misc_feature 1..20: note = CRISPR gRNA sequence
  source 1..20: mol_type = other DNA
aaggaaggagggagggaggg

SEQ ID NO: 14247 - DNA, 20 bp, synthetic construct
  misc_feature 1..20: note = CRISPR gRNA sequence
  source 1..20: mol_type = other DNA
aggaaggagggagggaggga

SEQ ID NO: 14248 - DNA, 20 bp, synthetic construct
  misc_feature 1..20: note = CRISPR gRNA sequence
  source 1..20: mol_type = other DNA
aggagggagggagggaagga

SEQ ID NO: 14249 - DNA, 20 bp, synthetic construct
  misc_feature 1..20: note = CRISPR gRNA sequence
  source 1..20: mol_type = other DNA
ggagggagggaaggaaagaa

SEQ ID NO: 14250 - DNA, 20 bp, synthetic construct
  misc_feature 1..20: note = CRISPR gRNA sequence
  source 1..20: mol_type = other DNA
gagggagggaaggaaagaaa

SEQ ID NO: 14251 - DNA, 20 bp, synthetic construct
  misc_feature 1..20: note = CRISPR gRNA sequence
  source 1..20: mol_type = other DNA
ggagggaaggaaagaaaagg

SEQ ID NO: 14252 - DNA, 20 bp, synthetic construct
  misc_feature 1..20: note = CRISPR gRNA sequence
  source 1..20: mol_type = other DNA
gagggaaggaaagaaaagga

SEQ ID NO: 14253 - DNA, 20 bp, synthetic construct
  misc_feature 1..20: note = CRISPR gRNA sequence
  source 1..20: mol_type = other DNA
agggaaggaaagaaaaggaa

SEQ ID NO: 14254 - DNA, 20 bp, synthetic construct
  misc_feature 1..20: note = CRISPR gRNA sequence
  source 1..20: mol_type = other DNA
aaggaaagaaaaggaaggga

SEQ ID NO: 14255 - DNA, 20 bp, synthetic construct
  misc_feature 1..20: note = CRISPR gRNA sequence
  source 1..20: mol_type = other DNA
aggaaagaaaaggaagggaa

SEQ ID NO: 14256 - DNA, 20 bp, synthetic construct
  misc_feature 1..20: note = CRISPR gRNA sequence
  source 1..20: mol_type = other DNA
aagaaaaggaagggaaagga

SEQ ID NO: 14257 - DNA, 20 bp, synthetic construct
  misc_feature 1..20: note = CRISPR gRNA sequence
  source 1..20: mol_type = other DNA
aaaggaagggaaaggaaaga

SEQ ID NO: 14258 - DNA, 20 bp, synthetic construct
  misc_feature 1..20: note = CRISPR gRNA sequence
  source 1..20: mol_type = other DNA
aggaagggaaaggaaagaaa

SEQ ID NO: 14259 - DNA, 20 bp, synthetic construct
  misc_feature 1..20: note = CRISPR gRNA sequence
  source 1..20: mol_type = other DNA
ggaagggaaaggaaagaaag

SEQ ID NO: 14260 - DNA, 20 bp, synthetic construct
  misc_feature 1..20: note = CRISPR gRNA sequence
  source 1..20: mol_type = other DNA
gggaaaggaaagaaagagga

SEQ ID NO: 14261 - DNA, 20 bp, synthetic construct
  misc_feature 1..20: note = CRISPR gRNA sequence
  source 1..20: mol_type = other DNA
aaggaaagaaagaggaaaga

SEQ ID NO: 14262 - DNA, 20 bp, synthetic construct
  misc_feature 1..20: note = CRISPR gRNA sequence
  source 1..20: mol_type = other DNA
ggaaagaaagaggaaagaaa

SEQ ID NO: 14263 - DNA, 20 bp, synthetic construct
  misc_feature 1..20: note = CRISPR gRNA sequence
  source 1..20: mol_type = other DNA
aaagaaagaggaaagaaaga

SEQ ID NO: 14264 - DNA, 20 bp, synthetic construct
  misc_feature 1..20: note = CRISPR gRNA sequence
  source 1..20: mol_type = other DNA
aaagaggaaagaaagagaga

SEQ ID NO: 14265 - DNA, 20 bp, synthetic construct
  misc_feature 1..20: note = CRISPR gRNA sequence
  source 1..20: mol_type = other DNA
aggaaagaaagagagaaaga

SEQ ID NO: 14266 - DNA, 20 bp, synthetic construct
  misc_feature 1..20: note = CRISPR gRNA sequence
  source 1..20: mol_type = other DNA
aagaaagagagaaagaaaga

SEQ ID NO: 14267 - DNA, 20 bp, synthetic construct
  misc_feature 1..20: note = CRISPR gRNA sequence
  source 1..20: mol_type = other DNA
aaagagagaaagaaagaaag

SEQ ID NO: 14268 - DNA, 20 bp, synthetic construct
  misc_feature 1..20: note = CRISPR gRNA sequence
  source 1..20: mol_type = other DNA
agagaaagaaagaaagaaga

SEQ ID NO: 14269 - DNA, 20 bp, synthetic construct
  misc_feature 1..20: note = CRISPR gRNA sequence
  source 1..20: mol_type = other DNA
aaagaaagaaagaagaaaga

SEQ ID NO: 14270 - DNA, 20 bp, synthetic construct
  misc_feature 1..20: note = CRISPR gRNA sequence
  source 1..20: mol_type = other DNA
agaaagaagaaagaaagaaa

SEQ ID NO: 14271 - DNA, 20 bp, synthetic construct
  misc_feature 1..20: note = CRISPR gRNA sequence
  source 1..20: mol_type = other DNA
agaagaaagaaagaaaaaga

SEQ ID NO: 14272 - DNA, 20 bp, synthetic construct
  misc_feature 1..20: note = CRISPR gRNA sequence
  source 1..20: mol_type = other DNA
aagaaagaaagaaaaagaaa

SEQ ID NO: 14273 - DNA, 20 bp, synthetic construct
  misc_feature 1..20: note = CRISPR gRNA sequence
  source 1..20: mol_type = other DNA
gaaagaaagaaaaagaaaga

SEQ ID NO: 14274 - DNA, 20 bp, synthetic construct
  misc_feature 1..20: note = CRISPR gRNA sequence
  source 1..20: mol_type = other DNA
agaaagaaaaagaaagagag

SEQ ID NO: 14275 - DNA, 20 bp, synthetic construct
  misc_feature 1..20: note = CRISPR gRNA sequence
  source 1..20: mol_type = other DNA
agaaaaagaaagagagaaga

SEQ ID NO: 14276 - DNA, 20 bp, synthetic construct
  misc_feature 1..20: note = CRISPR gRNA sequence
  source 1..20: mol_type = other DNA
gaaaaagaaagagagaagaa

SEQ ID NO: 14277 - DNA, 20 bp, synthetic construct
  misc_feature 1..20: note = CRISPR gRNA sequence
  source 1..20: mol_type = other DNA
aagaaagagagaagaaagga

SEQ ID NO: 14278 - DNA, 20 bp, synthetic construct
  misc_feature 1..20: note = CRISPR gRNA sequence
  source 1..20: mol_type = other DNA
aagagagaagaaaggaaaga

SEQ ID NO: 14279 - DNA, 20 bp, synthetic construct
  misc_feature 1..20: note = CRISPR gRNA sequence
  source 1..20: mol_type = other DNA
gagaagaaaggaaagaaaga

SEQ ID NO: 14280 - DNA, 20 bp, synthetic construct
  misc_feature 1..20: note = CRISPR gRNA sequence
  source 1..20: mol_type = other DNA
gaaaggaaagaaagaaagaa

SEQ ID NO: 14281 - DNA, 20 bp, synthetic construct
  misc_feature 1..20: note = CRISPR gRNA sequence
  source 1..20: mol_type = other DNA
aaagaaaagctatattctga

SEQ ID NO: 14282 - DNA, 20 bp, synthetic construct
  misc_feature 1..20: note = CRISPR gRNA sequence
  source 1..20: mol_type = other DNA
taataattattgtgctttct

SEQ ID NO: 14283 - DNA, 20 bp, synthetic construct
  misc_feature 1..20: note = CRISPR gRNA sequence
  source 1..20: mol_type = other DNA
aataattattgtgctttctt

SEQ ID NO: 14284 - DNA, 20 bp, synthetic construct
  misc_feature 1..20: note = CRISPR gRNA sequence
  source 1..20: mol_type = other DNA
ataattattgtgctttcttg

SEQ ID NO: 14285 - DNA, 20 bp, synthetic construct
  misc_feature 1..20: note = CRISPR gRNA sequence
  source 1..20: mol_type = other DNA
gctttcttggggcccatgta

SEQ ID NO: 14286 - DNA, 20 bp, synthetic construct
  misc_feature 1..20: note = CRISPR gRNA sequence
  source 1..20: mol_type = other DNA
ttcttggggcccatgtatgg

SEQ ID NO: 14287 - DNA, 20 bp, synthetic construct
  misc_feature 1..20: note = CRISPR gRNA sequence
  source 1..20: mol_type = other DNA
tcttggggcccatgtatggt

SEQ ID NO: 14288 - DNA, 20 bp, synthetic construct
  misc_feature 1..20: note = CRISPR gRNA sequence
  source 1..20: mol_type = other DNA
tatggtgggctgcccctcct

SEQ ID NO: 14289 - DNA, 20 bp, synthetic construct
  misc_feature 1..20: note = CRISPR gRNA sequence
  source 1..20: mol_type = other DNA
gctgcccctcctcagtgacc

SEQ ID NO: 14290 - DNA, 20 bp, synthetic construct
  misc_feature 1..20: note = CRISPR gRNA sequence
  source 1..20: mol_type = other DNA
ctcagtgacccagacacaac

SEQ ID NO: 14291 - DNA, 20 bp, synthetic construct
  misc_feature 1..20: note = CRISPR gRNA sequence
  source 1..20: mol_type = other DNA
ccagacacaactggactccc

SEQ ID NO: 14292 - DNA, 20 bp, synthetic construct
  misc_feature 1..20: note = CRISPR gRNA sequence
  source 1..20: mol_type = other DNA
agacacaactggactcccta

SEQ ID NO: 14293 - DNA, 20 bp, synthetic construct
  misc_feature 1..20: note = CRISPR gRNA sequence
  source 1..20: mol_type = other DNA
ggactccctagagccttgcc

SEQ ID NO: 14294 - DNA, 20 bp, synthetic construct
  misc_feature 1..20: note = CRISPR gRNA sequence
  source 1..20: mol_type = other DNA
gactccctagagccttgcct

SEQ ID NO: 14295 - DNA, 20 bp, synthetic construct
  misc_feature 1..20: note = CRISPR gRNA sequence
  source 1..20: mol_type = other DNA
ggtctccatttctgtcaccc

SEQ ID NO: 14296 - DNA, 20 bp, synthetic construct
  misc_feature 1..20: note = CRISPR gRNA sequence
  source 1..20: mol_type = other DNA
gtcaccccagcaacactgcc

SEQ ID NO: 14297 - DNA, 20 bp, synthetic construct
  misc_feature 1..20: note = CRISPR gRNA sequence
  source 1..20: mol_type = other DNA
tcaccccagcaacactgcct

SEQ ID NO: 14298 - DNA, 20 bp, synthetic construct
  misc_feature 1..20: note = CRISPR gRNA sequence
  source 1..20: mol_type = other DNA
caccccagcaacactgccta

SEQ ID NO: 14299 - DNA, 20 bp, synthetic construct
  misc_feature 1..20: note = CRISPR gRNA sequence
  source 1..20: mol_type = other DNA
cagcaacactgcctagggtg

SEQ ID NO: 14300 - DNA, 20 bp, synthetic construct
  misc_feature 1..20: note = CRISPR gRNA sequence
  source 1..20: mol_type = other DNA
actgcctagggtgtggcccc

SEQ ID NO: 14301 - DNA, 20 bp, synthetic construct
  misc_feature 1..20: note = CRISPR gRNA sequence
  source 1..20: mol_type = other DNA
tagggtgtggcccccagccc

SEQ ID NO: 14302 - DNA, 20 bp, synthetic construct
  misc_feature 1..20: note = CRISPR gRNA sequence
  source 1..20: mol_type = other DNA
cccccagccctggccacaca

SEQ ID NO: 14303 - DNA, 20 bp, synthetic construct
  misc_feature 1..20: note = CRISPR gRNA sequence
  source 1..20: mol_type = other DNA
cccagccctggccacacata

SEQ ID NO: 14304 - DNA, 20 bp, synthetic construct
  misc_feature 1..20: note = CRISPR gRNA sequence
  source 1..20: mol_type = other DNA
catagagcaaccaactgtcc

SEQ ID NO: 14305 - DNA, 20 bp, synthetic construct
  misc_feature 1..20: note = CRISPR gRNA sequence
  source 1..20: mol_type = other DNA
accaactgtcccagtttgcc

SEQ ID NO: 14306 - DNA, 20 bp, synthetic construct
  misc_feature 1..20: note = CRISPR gRNA sequence
  source 1..20: mol_type = other DNA
ccaactgtcccagtttgcct

SEQ ID NO: 14307 - DNA, 20 bp, synthetic construct
  misc_feature 1..20: note = CRISPR gRNA sequence
  source 1..20: mol_type = other DNA
gtcccagtttgcctgggact

SEQ ID NO: 14308 - DNA, 20 bp, synthetic construct
  misc_feature 1..20: note = CRISPR gRNA sequence
  source 1..20: mol_type = other DNA
tcccagtttgcctgggacta

SEQ ID NO: 14309 - DNA, 20 bp, synthetic construct
  misc_feature 1..20: note = CRISPR gRNA sequence
  source 1..20: mol_type = other DNA
cccagtttgcctgggactaa

SEQ ID NO: 14310 - DNA, 20 bp, synthetic construct
  misc_feature 1..20: note = CRISPR gRNA sequence
  source 1..20: mol_type = other DNA
ccagtttgcctgggactaag

SEQ ID NO: 14311 - DNA, 20 bp, synthetic construct
  misc_feature 1..20: note = CRISPR gRNA sequence
  source 1..20: mol_type = other DNA
cctgggactaaggggcttct

SEQ ID NO: 14312 - DNA, 20 bp, synthetic construct
  misc_feature 1..20: note = CRISPR gRNA sequence
  source 1..20: mol_type = other DNA
ctgggactaaggggcttctt

SEQ ID NO: 14313 - DNA, 20 bp, synthetic construct
  misc_feature 1..20: note = CRISPR gRNA sequence
  source 1..20: mol_type = other DNA
taaggggcttcttgggatgc

SEQ ID NO: 14314 - DNA, 20 bp, synthetic construct
  misc_feature 1..20: note = CRISPR gRNA sequence
  source 1..20: mol_type = other DNA
ttcttgggatgcaagacttt

SEQ ID NO: 14315 - DNA, 20 bp, synthetic construct
  misc_feature 1..20: note = CRISPR gRNA sequence
  source 1..20: mol_type = other DNA
aagactttcagttttcaaac

SEQ ID NO: 14316 - DNA, 20 bp, synthetic construct
  misc_feature 1..20: note = CRISPR gRNA sequence
  source 1..20: mol_type = other DNA
agactttcagttttcaaacc

SEQ ID NO: 14317 - DNA, 20 bp, synthetic construct
  misc_feature 1..20: note = CRISPR gRNA sequence
  source 1..20: mol_type = other DNA
tttcagttttcaaaccagga

SEQ ID NO: 14318 - DNA, 20 bp, synthetic construct
  misc_feature 1..20: note = CRISPR gRNA sequence
  source 1..20: mol_type = other DNA
ttttcaaaccaggatagtcc

SEQ ID NO: 14319 - DNA, 20 bp, synthetic construct
  misc_feature 1..20: note = CRISPR gRNA sequence
  source 1..20: mol_type = other DNA
tttcaaaccaggatagtccc

SEQ ID NO: 14320 - DNA, 20 bp, synthetic construct
  misc_feature 1..20: note = CRISPR gRNA sequence
  source 1..20: mol_type = other DNA
aaaccaggatagtcccaggc

SEQ ID NO: 14321 - DNA, 20 bp, synthetic construct
  misc_feature 1..20: note = CRISPR gRNA sequence
  source 1..20: mol_type = other DNA
ccaggatagtcccaggcaag

SEQ ID NO: 14322 - DNA, 20 bp, synthetic construct
  misc_feature 1..20: note = CRISPR gRNA sequence
  source 1..20: mol_type = other DNA
caggatagtcccaggcaagt

SEQ ID NO: 14323 - DNA, 20 bp, synthetic construct
  misc_feature 1..20: note = CRISPR gRNA sequence
  source 1..20: mol_type = other DNA
aggatagtcccaggcaagta

SEQ ID NO: 14324 - DNA, 20 bp, synthetic construct
  misc_feature 1..20: note = CRISPR gRNA sequence
  source 1..20: mol_type = other DNA
gtagggttgctttttcatcc

SEQ ID NO: 14325 - DNA, 20 bp, synthetic construct
  misc_feature 1..20: note = CRISPR gRNA sequence
  source 1..20: mol_type = other DNA
tcatcctagctgcacatcaa

SEQ ID NO: 14326 - DNA, 20 bp, synthetic construct
  misc_feature 1..20: note = CRISPR gRNA sequence
  source 1..20: mol_type = other DNA
agctgcacatcaaaagctcc

SEQ ID NO: 14327 - DNA, 20 bp, synthetic construct
  misc_feature 1..20: note = CRISPR gRNA sequence
  source 1..20: mol_type = other DNA
gctgcacatcaaaagctcct

SEQ ID NO: 14328 - DNA, 20 bp, synthetic construct
  misc_feature 1..20: note = CRISPR gRNA sequence
  source 1..20: mol_type = other DNA
agctcctgggaatttcaaaa

SEQ ID NO: 14329 - DNA, 20 bp, synthetic construct
  misc_feature 1..20: note = CRISPR gRNA sequence
  source 1..20: mol_type = other DNA
gctcctgggaatttcaaaat

SEQ ID NO: 14330 - DNA, 20 bp, synthetic construct
  misc_feature 1..20: note = CRISPR gRNA sequence
  source 1..20: mol_type = other DNA
ctcctgggaatttcaaaatg

SEQ ID NO: 14331 - DNA, 20 bp, synthetic construct
  misc_feature 1..20: note = CRISPR gRNA sequence
  source 1..20: mol_type = other DNA
tcctgggaatttcaaaatgg

SEQ ID NO: 14332 - DNA, 20 bp, synthetic construct
  misc_feature 1..20: note = CRISPR gRNA sequence
  source 1..20: mol_type = other DNA
gggaatttcaaaatggggga

SEQ ID NO: 14333 - DNA, 20 bp, synthetic construct
  misc_feature 1..20: note = CRISPR gRNA sequence
  source 1..20: mol_type = other DNA
aatgggggaaagattctccc

SEQ ID NO: 14334 - DNA, 20 bp, synthetic construct
  misc_feature 1..20: note = CRISPR gRNA sequence
  source 1..20: mol_type = other DNA
atgggggaaagattctccct

SEQ ID NO: 14335 - DNA, 20 bp, synthetic construct
  misc_feature 1..20: note = CRISPR gRNA sequence
  source 1..20: mol_type = other DNA
tgggggaaagattctccctg

SEQ ID NO: 14336 - DNA, 20 bp, synthetic construct
  misc_feature 1..20: note = CRISPR gRNA sequence
  source 1..20: mol_type = other DNA
ggggaaagattctccctggg

SEQ ID NO: 14337 - DNA, 20 bp, synthetic construct
  misc_feature 1..20: note = CRISPR gRNA sequence
  source 1..20: mol_type = other DNA
gggaaagattctccctgggg

SEQ ID NO: 14338 - DNA, 20 bp, synthetic construct
  misc_feature 1..20: note = CRISPR gRNA sequence
  source 1..20: mol_type = other DNA
tccctggggaggccatccct

SEQ ID NO: 14339 - DNA, 20 bp, synthetic construct
  misc_feature 1..20: note = CRISPR gRNA sequence
  source 1..20: mol_type = other DNA
gggaggccatcccttggctg

SEQ ID NO: 14340 - DNA, 20 bp, synthetic construct
  misc_feature 1..20: note = CRISPR gRNA sequence
  source 1..20: mol_type = other DNA
aggccatcccttggctgtgg

SEQ ID NO: 14341 - DNA, 20 bp, synthetic construct
  misc_feature 1..20: note = CRISPR gRNA sequence
  source 1..20: mol_type = other DNA
ccttggctgtggaagtaaac

SEQ ID NO: 14342 - DNA, 20 bp, synthetic construct
  misc_feature 1..20: note = CRISPR gRNA sequence
  source 1..20: mol_type = other DNA
gctgtggaagtaaacaagct

SEQ ID NO: 14343 - DNA, 20 bp, synthetic construct
  misc_feature 1..20: note = CRISPR gRNA sequence
  source 1..20: mol_type = other DNA
ctgtggaagtaaacaagctc

SEQ ID NO: 14344 - DNA, 20 bp, synthetic construct
  misc_feature 1..20: note = CRISPR gRNA sequence
  source 1..20: mol_type = other DNA
aagtaaacaagctcaggcac

SEQ ID NO: 14345 - DNA, 20 bp, synthetic construct
  misc_feature 1..20: note = CRISPR gRNA sequence
  source 1..20: mol_type = other DNA
agtaaacaagctcaggcaca

SEQ ID NO: 14346 - DNA, 20 bp, synthetic construct
  misc_feature 1..20: note = CRISPR gRNA sequence
  source 1..20: mol_type = other DNA
gtaaacaagctcaggcacaa

SEQ ID NO: 14347 - DNA, 20 bp, synthetic construct
  misc_feature 1..20: note = CRISPR gRNA sequence
  source 1..20: mol_type = other DNA
caggcacaagggacgttgtg

SEQ ID NO: 14348 - DNA, 20 bp, synthetic construct
  misc_feature 1..20: note = CRISPR gRNA sequence
  source 1..20: mol_type = other DNA
aagggacgttgtgcagttcc

SEQ ID NO: 14349 - DNA, 20 bp, synthetic construct
  misc_feature 1..20: note = CRISPR gRNA sequence
  source 1..20: mol_type = other DNA
cgttgtgcagttcctggcca

SEQ ID NO: 14350 - DNA, 20 bp, synthetic construct
  misc_feature 1..20: note = CRISPR gRNA sequence
  source 1..20: mol_type = other DNA
gttgtgcagttcctggccac

SEQ ID NO: 14351 - DNA, 20 bp, synthetic construct
  misc_feature 1..20: note = CRISPR gRNA sequence
  source 1..20: mol_type = other DNA
tgtgcagttcctggccacag

SEQ ID NO: 14352 - DNA, 20 bp, synthetic construct
  misc_feature 1..20: note = CRISPR gRNA sequence
  source 1..20: mol_type = other DNA
gtgcagttcctggccacagg

SEQ ID NO: 14353 - DNA, 20 bp, synthetic construct
  misc_feature 1..20: note = CRISPR gRNA sequence
  source 1..20: mol_type = other DNA
tgcagttcctggccacagga

SEQ ID NO: 14354 - DNA, 20 bp, synthetic construct
  misc_feature 1..20: note = CRISPR gRNA sequence
  source 1..20: mol_type = other DNA
ttcctggccacaggagggaa

SEQ ID NO: 14355 - DNA, 20 bp, synthetic construct
  misc_feature 1..20: note = CRISPR gRNA sequence
  source 1..20: mol_type = other DNA
tcctggccacaggagggaaa

SEQ ID NO: 14356 - DNA, 20 bp, synthetic construct
  misc_feature 1..20: note = CRISPR gRNA sequence
  source 1..20: mol_type = other DNA
caggagggaaaaggactcca

SEQ ID NO: 14357 - DNA, 20 bp, synthetic construct
  misc_feature 1..20: note = CRISPR gRNA sequence
  source 1..20: mol_type = other DNA
ggaaaaggactccatagtca

SEQ ID NO: 14358 - DNA, 20 bp, synthetic construct
  misc_feature 1..20: note = CRISPR gRNA sequence
  source 1..20: mol_type = other DNA
aaaggactccatagtcatag

SEQ ID NO: 14359 - DNA, 20 bp, synthetic construct
  misc_feature 1..20: note = CRISPR gRNA sequence
  source 1..20: mol_type = other DNA
gtcatagtggcatcctccta

SEQ ID NO: 14360 - DNA, 20 bp, synthetic construct
  misc_feature 1..20: note = CRISPR gRNA sequence
  source 1..20: mol_type = other DNA
atagtggcatcctcctatgg

SEQ ID NO: 14361 - DNA, 20 bp, synthetic construct
  misc_feature 1..20: note = CRISPR gRNA sequence
  source 1..20: mol_type = other DNA
tagtggcatcctcctatgga

SEQ ID NO: 14362 - DNA, 20 bp, synthetic construct
  misc_feature 1..20: note = CRISPR gRNA sequence
  source 1..20: mol_type = other DNA
ggcatcctcctatggaaggt

SEQ ID NO: 14363 - DNA, 20 bp, synthetic construct
  misc_feature 1..20: note = CRISPR gRNA sequence
  source 1..20: mol_type = other DNA
gcatcctcctatggaaggtt

SEQ ID NO: 14364 - DNA, 20 bp, synthetic construct
  misc_feature 1..20: note = CRISPR gRNA sequence
  source 1..20: mol_type = other DNA
catcctcctatggaaggttg

SEQ ID NO: 14365 - DNA, 20 bp, synthetic construct
  misc_feature 1..20: note = CRISPR gRNA sequence
  source 1..20: mol_type = other DNA
atggaaggttggggacacat

SEQ ID NO: 14366 - DNA, 20 bp, synthetic construct
  misc_feature 1..20: note = CRISPR gRNA sequence
  source 1..20: mol_type = other DNA
tggaaggttggggacacatt

SEQ ID NO: 14367 - DNA, 20 bp, synthetic construct
  misc_feature 1..20: note = CRISPR gRNA sequence
  source 1..20: mol_type = other DNA
attgggccttttctgatccc

SEQ ID NO: 14368 - DNA, 20 bp, synthetic construct
  misc_feature 1..20: note = CRISPR gRNA sequence
  source 1..20: mol_type = other DNA
cctggcgaaattacaattcc

SEQ ID NO: 14369 - DNA, 20 bp, synthetic construct
  misc_feature 1..20: note = CRISPR gRNA sequence
  source 1..20: mol_type = other DNA
gcgaaattacaattcctgga

SEQ ID NO: 14370 - DNA, 20 bp, synthetic construct
  misc_feature 1..20: note = CRISPR gRNA sequence
  source 1..20: mol_type = other DNA
cttactcccctctccccact

SEQ ID NO: 14371 - DNA, 20 bp, synthetic construct
  misc_feature 1..20: note = CRISPR gRNA sequence
  source 1..20: mol_type = other DNA
ctcattccttatcctcactg

SEQ ID NO: 14372 - DNA, 20 bp, synthetic construct
  misc_feature 1..20: note = CRISPR gRNA sequence
  source 1..20: mol_type = other DNA
ccttatcctcactgaagctt

SEQ ID NO: 14373 - DNA, 20 bp, synthetic construct
  misc_feature 1..20: note = CRISPR gRNA sequence
  source 1..20: mol_type = other DNA
tcctcactgaagcttcagtg

SEQ ID NO: 14374 - DNA, 20 bp, synthetic construct
  misc_feature 1..20: note = CRISPR gRNA sequence
  source 1..20: mol_type = other DNA
agtgcagatatcacctcctc

SEQ ID NO: 14375 - DNA, 20 bp, synthetic construct
  misc_feature 1..20: note = CRISPR gRNA sequence
  source 1..20: mol_type = other DNA
gtgcagatatcacctcctcc

SEQ ID NO: 14376 - DNA, 20 bp, synthetic construct
  misc_feature 1..20: note = CRISPR gRNA sequence
  source 1..20: mol_type = other DNA
cagatatcacctcctccagg

SEQ ID NO: 14377 - DNA, 20 bp, synthetic construct
  misc_feature 1..20: note = CRISPR gRNA sequence
  source 1..20: mol_type = other DNA
gaagtccccctgacctcctc

SEQ ID NO: 14378 - DNA, 20 bp, synthetic construct
  misc_feature 1..20: note = CRISPR gRNA sequence
  source 1..20: mol_type = other DNA
agtccccctgacctcctcca

SEQ ID NO: 14379 - DNA, 20 bp, synthetic construct
  misc_feature 1..20: note = CRISPR gRNA sequence
  source 1..20: mol_type = other DNA
gtccccctgacctcctccag

SEQ ID NO: 14380 - DNA, 20 bp, synthetic construct
  misc_feature 1..20: note = CRISPR gRNA sequence
  source 1..20: mol_type = other DNA
tccccctgacctcctccaga

SEQ ID NO: 14381 - DNA, 20 bp, synthetic construct
  misc_feature 1..20: note = CRISPR gRNA sequence
  source 1..20: mol_type = other DNA
ccccctgacctcctccagag

SEQ ID NO: 14382 - DNA, 20 bp, synthetic construct
  misc_feature 1..20: note = CRISPR gRNA sequence
  source 1..20: mol_type = other DNA
ccctgacctcctccagaggg

SEQ ID NO: 14383 - DNA, 20 bp, synthetic construct
  misc_feature 1..20: note = CRISPR gRNA sequence
  source 1..20: mol_type = other DNA
tcctccagaggggagttgat

SEQ ID NO: 14384 - DNA, 20 bp, synthetic construct
  misc_feature 1..20: note = CRISPR gRNA sequence
  source 1..20: mol_type = other DNA
aggggagttgattagactgt

SEQ ID NO: 14385 - DNA, 20 bp, synthetic construct
  misc_feature 1..20: note = CRISPR gRNA sequence
  source 1..20: mol_type = other DNA
tgattagactgtcagctcat

SEQ ID NO: 14386 - DNA, 20 bp, synthetic construct
  misc_feature 1..20: note = CRISPR gRNA sequence
  source 1..20: mol_type = other DNA
gattagactgtcagctcatg

SEQ ID NO: 14387 - DNA, 20 bp, synthetic construct
  misc_feature 1..20: note = CRISPR gRNA sequence
  source 1..20: mol_type = other DNA
agactgtcagctcatgagga

SEQ ID NO: 14388 - DNA, 20 bp, synthetic construct
  misc_feature 1..20: note = CRISPR gRNA sequence
  source 1..20: mol_type = other DNA
ctgtcagctcatgaggacag

SEQ ID NO: 14389 - DNA, 20 bp, synthetic construct
  misc_feature 1..20: note = CRISPR gRNA sequence
  source 1..20: mol_type = other DNA
gctcatgaggacagcagcct

SEQ ID NO: 14390 - DNA, 20 bp, synthetic construct
  misc_feature 1..20: note = CRISPR gRNA sequence
  source 1..20: mol_type = other DNA
gacagcagcctcagtcattc

SEQ ID NO: 14391 - DNA, 20 bp, synthetic construct
  misc_feature 1..20: note = CRISPR gRNA sequence
  source 1..20: mol_type = other DNA
gctcaatacctctgttgaat

SEQ ID NO: 14392 - DNA, 20 bp, synthetic construct
  misc_feature 1..20: note = CRISPR gRNA sequence
  source 1..20: mol_type = other DNA
tacctctgttgaatgagtga

SEQ ID NO: 14393 - DNA, 20 bp, synthetic construct
  misc_feature 1..20: note = CRISPR gRNA sequence
  source 1..20: mol_type = other DNA
acctctgttgaatgagtgat

SEQ ID NO: 14394 - DNA, 20 bp, synthetic construct
  misc_feature 1..20: note = CRISPR gRNA sequence
  source 1..20: mol_type = other DNA
atgggaatgaccatgttaac

SEQ ID NO: 14395 - DNA, 20 bp, synthetic construct
  misc_feature 1..20: note = CRISPR gRNA sequence
  source 1..20: mol_type = other DNA
tgaccatgttaaccagcaaa

SEQ ID NO: 14396 - DNA, 20 bp, synthetic construct
  misc_feature 1..20: note = CRISPR gRNA sequence
  source 1..20: mol_type = other DNA
gaccatgttaaccagcaaac

SEQ ID NO: 14397 - DNA, 20 bp, synthetic construct
  misc_feature 1..20: note = CRISPR gRNA sequence
  source 1..20: mol_type = other DNA
taaccagcaaacgggtccat

SEQ ID NO: 14398 - DNA, 20 bp, synthetic construct
  misc_feature 1..20: note = CRISPR gRNA sequence
  source 1..20: mol_type = other DNA
ggtccattagcttcaaatct

SEQ ID NO: 14399 - DNA, 20 bp, synthetic construct
  misc_feature 1..20: note = CRISPR gRNA sequence
  source 1..20: mol_type = other DNA
gcttcaaatctgagaacctc

SEQ ID NO: 14400 - DNA, 20 bp, synthetic construct
  misc_feature 1..20: note = CRISPR gRNA sequence
  source 1..20: mol_type = other DNA
cctccagcatttgcccacac

SEQ ID NO: 14401 - DNA, 20 bp, synthetic construct
  misc_feature 1..20: note = CRISPR gRNA sequence
  source 1..20: mol_type = other DNA
tgcccacactggtcactttc

SEQ ID NO: 14402 - DNA, 20 bp, synthetic construct
  misc_feature 1..20: note = CRISPR gRNA sequence
  source 1..20: mol_type = other DNA
actggtcactttccagctgc

SEQ ID NO: 14403 - DNA, 20 bp, synthetic construct
  misc_feature 1..20: note = CRISPR gRNA sequence
  source 1..20: mol_type = other DNA
ggtcactttccagctgctgg

SEQ ID NO: 14404 - DNA, 20 bp, synthetic construct
  misc_feature 1..20: note = CRISPR gRNA sequence
  source 1..20: mol_type = other DNA
gctgctggaagctatttcca

SEQ ID NO: 14405 - DNA, 20 bp, synthetic construct
  misc_feature 1..20: note = CRISPR gRNA sequence
  source 1..20: mol_type = other DNA
gctggaagctatttccaaag

SEQ ID NO: 14406 - DNA, 20 bp, synthetic construct
  misc_feature 1..20: note = CRISPR gRNA sequence
  source 1..20: mol_type = other DNA
ggaagctatttccaaagtgg

SEQ ID NO: 14407 - DNA, 20 bp, synthetic construct
  misc_feature 1..20: note = CRISPR gRNA sequence
  source 1..20: mol_type = other DNA
gaagctatttccaaagtggt

SEQ ID NO: 14408 - DNA, 20 bp, synthetic construct
  misc_feature 1..20: note = CRISPR gRNA sequence
  source 1..20: mol_type = other DNA
ctatttccaaagtggtgggc

SEQ ID NO: 14409 - DNA, 20 bp, synthetic construct
  misc_feature 1..20: note = CRISPR gRNA sequence
  source 1..20: mol_type = other DNA
atttccaaagtggtgggcaa

SEQ ID NO: 14410 - DNA, 20 bp, synthetic construct
  misc_feature 1..20: note = CRISPR gRNA sequence
  source 1..20: mol_type = other DNA
tttccaaagtggtgggcaag

SEQ ID NO: 14411 - DNA, 20 bp, synthetic construct
  misc_feature 1..20: note = CRISPR gRNA sequence
  source 1..20: mol_type = other DNA
ttccaaagtggtgggcaaga

SEQ ID NO: 14412 - DNA, 20 bp, synthetic construct
  misc_feature 1..20: note = CRISPR gRNA sequence
  source 1..20: mol_type = other DNA
aaagtggtgggcaagagggt

SEQ ID NO: 14413 - DNA, 20 bp, synthetic construct
  misc_feature 1..20: note = CRISPR gRNA sequence
  source 1..20: mol_type = other DNA
caagagggtaagaatgattc

SEQ ID NO: 14414 - DNA, 20 bp, synthetic construct
  misc_feature 1..20: note = CRISPR gRNA sequence
  source 1..20: mol_type = other DNA
agagggtaagaatgattctg

SEQ ID NO: 14415 - DNA, 20 bp, synthetic construct
  misc_feature 1..20: note = CRISPR gRNA sequence
  source 1..20: mol_type = other DNA
tctggagatctatctccatt

SEQ ID NO: 14416 - DNA, 20 bp, synthetic construct
  misc_feature 1..20: note = CRISPR gRNA sequence
  source 1..20: mol_type = other DNA
ctggagatctatctccattc

SEQ ID NO: 14417 - DNA, 20 bp, synthetic construct
  misc_feature 1..20: note = CRISPR gRNA sequence
  source 1..20: mol_type = other DNA
gagatctatctccattcagg

SEQ ID NO: 14418 - DNA, 20 bp, synthetic construct
  misc_feature 1..20: note = CRISPR gRNA sequence
  source 1..20: mol_type = other DNA
tatctccattcaggtggtac

SEQ ID NO: 14419 - DNA, 20 bp, synthetic construct
  misc_feature 1..20: note = CRISPR gRNA sequence
  source 1..20: mol_type = other DNA
ccattcaggtggtacaagcc

SEQ ID NO: 14420 - DNA, 20 bp, synthetic construct
  misc_feature 1..20: note = CRISPR gRNA sequence
  source 1..20: mol_type = other DNA
tacaagcccagctaatgctg

SEQ ID NO: 14421 - DNA, 20 bp, synthetic construct
  misc_feature 1..20: note = CRISPR gRNA sequence
  source 1..20: mol_type = other DNA
acaagcccagctaatgctgc

SEQ ID NO: 14422 - DNA, 20 bp, synthetic construct
  misc_feature 1..20: note = CRISPR gRNA sequence
  source 1..20: mol_type = other DNA
caagcccagctaatgctgca

SEQ ID NO: 14423 - DNA, 20 bp, synthetic construct
  misc_feature 1..20: note = CRISPR gRNA sequence
  source 1..20: mol_type = other DNA
aagcccagctaatgctgcag

SEQ ID NO: 14424 - DNA, 20 bp, synthetic construct
  misc_feature 1..20: note = CRISPR gRNA sequence
  source 1..20: mol_type = other DNA
gctgcaggggaaaccttgcg

SEQ ID NO: 14425 - DNA, 20 bp, synthetic construct
  misc_feature 1..20: note = CRISPR gRNA sequence
  source 1..20: mol_type = other DNA
gaaaccttgcgcagacccac

SEQ ID NO: 14426 - DNA, 20 bp, synthetic construct
  misc_feature 1..20: note = CRISPR gRNA sequence
  source 1..20: mol_type = other DNA
ccctttgcttacgcaaactc

SEQ ID NO: 14427 - DNA, 20 bp, synthetic construct
  misc_feature 1..20: note = CRISPR gRNA sequence
  source 1..20: mol_type = other DNA
tacgcaaactccagtttctt

SEQ ID NO: 14428 - DNA, 20 bp, synthetic construct
  misc_feature 1..20: note = CRISPR gRNA sequence
  source 1..20: mol_type = other DNA
acgcaaactccagtttcttt

SEQ ID NO: 14429 - DNA, 20 bp, synthetic construct
  misc_feature 1..20: note = CRISPR gRNA sequence
  source 1..20: mol_type = other DNA
cagtttctttaggtcccgaa

SEQ ID NO: 14430 - DNA, 20 bp, synthetic construct
  misc_feature 1..20: note = CRISPR gRNA sequence
  source 1..20: mol_type = other DNA
tttctttaggtcccgaacag

SEQ ID NO: 14431 - DNA, 20 bp, synthetic construct
  misc_feature 1..20: note = CRISPR gRNA sequence
  source 1..20: mol_type = other DNA
ttctttaggtcccgaacagc

SEQ ID NO: 14432 - DNA, 20 bp, synthetic construct
  misc_feature 1..20: note = CRISPR gRNA sequence
  source 1..20: mol_type = other DNA
tctttaggtcccgaacagca

SEQ ID NO: 14433 - DNA, 20 bp, synthetic construct
  misc_feature 1..20: note = CRISPR gRNA sequence
  source 1..20: mol_type = other DNA
tttaggtcccgaacagcagg

SEQ ID NO: 14434 - DNA, 20 bp, synthetic construct
  misc_feature 1..20: note = CRISPR gRNA sequence
  source 1..20: mol_type = other DNA
ccgaacagcagggagctccc

SEQ ID NO: 14435 - DNA, 20 bp, synthetic construct
  misc_feature 1..20: note = CRISPR gRNA sequence
  source 1..20: mol_type = other DNA
gctccccagctgtgtcttcc

SEQ ID NO: 14436 - DNA, 20 bp, synthetic construct
  misc_feature 1..20: note = CRISPR gRNA sequence
  source 1..20: mol_type = other DNA
ctccccagctgtgtcttccg

SEQ ID NO: 14437 - DNA, 20 bp, synthetic construct
  misc_feature 1..20: note = CRISPR gRNA sequence
  source 1..20: mol_type = other DNA
ttccgaggaacttctcgtcc

SEQ ID NO: 14438 - DNA, 20 bp, synthetic construct
  misc_feature 1..20: note = CRISPR gRNA sequence
  source 1..20: mol_type = other DNA
ccgaggaacttctcgtcctg

SEQ ID NO: 14439 - DNA, 20 bp, synthetic construct
  misc_feature 1..20: note = CRISPR gRNA sequence
  source 1..20: mol_type = other DNA
gaggaacttctcgtcctgga

SEQ ID NO: 14440 - DNA, 20 bp, synthetic construct
  misc_feature 1..20: note = CRISPR gRNA sequence
  source 1..20: mol_type = other DNA
acttctcgtcctggagagaa

SEQ ID NO: 14441 - DNA, 20 bp, synthetic construct
  misc_feature 1..20: note = CRISPR gRNA sequence
  source 1..20: mol_type = other DNA
cttctcgtcctggagagaac

SEQ ID NO: 14442 - DNA, 20 bp, synthetic construct
  misc_feature 1..20: note = CRISPR gRNA sequence
  source 1..20: mol_type = other DNA
ctggagagaacaggcaatgt

SEQ ID NO: 14443 - DNA, 20 bp, synthetic construct
  misc_feature 1..20: note = CRISPR gRNA sequence
  source 1..20: mol_type = other DNA
tggagagaacaggcaatgtt

SEQ ID NO: 14444 - DNA, 20 bp, synthetic construct
  misc_feature 1..20: note = CRISPR gRNA sequence
  source 1..20: mol_type = other DNA
ggagagaacaggcaatgtta

SEQ ID NO: 14445 - DNA, 20 bp, synthetic construct
  misc_feature 1..20: note = CRISPR gRNA sequence
  source 1..20: mol_type = other DNA
gagagaacaggcaatgttag

SEQ ID NO: 14446 - DNA, 20 bp, synthetic construct
  misc_feature 1..20: note = CRISPR gRNA sequence
  source 1..20: mol_type = other DNA
agagaacaggcaatgttagg

SEQ ID NO: 14447 - DNA, 20 bp, synthetic construct
  misc_feature 1..20: note = CRISPR gRNA sequence
  source 1..20: mol_type = other DNA
agaacaggcaatgttagggg

SEQ ID NO: 14448 - DNA, 20 bp, synthetic construct
  misc_feature 1..20: note = CRISPR gRNA sequence
  source 1..20: mol_type = other DNA
acaggcaatgttagggggag

SEQ ID NO: 14449 - DNA, 20 bp, synthetic construct
  misc_feature 1..20: note = CRISPR gRNA sequence
  source 1..20: mol_type = other DNA
caggcaatgttagggggagc

SEQ ID NO: 14450 - DNA, 20 bp, synthetic construct
  misc_feature 1..20: note = CRISPR gRNA sequence
  source 1..20: mol_type = other DNA
gagcaggcactgctgtcact

SEQ ID NO: 14451 - DNA, 20 bp, synthetic construct
  misc_feature 1..20: note = CRISPR gRNA sequence
  source 1..20: mol_type = other DNA
tgtcactgagcccttaccca

SEQ ID NO: 14452 - DNA, 20 bp, synthetic construct
  misc_feature 1..20: note = CRISPR gRNA sequence
  source 1..20: mol_type = other DNA
gtcactgagcccttacccat

SEQ ID NO: 14453 - DNA, 20 bp, synthetic construct
  misc_feature 1..20: note = CRISPR gRNA sequence
  source 1..20: mol_type = other DNA
cttacccatgggtcccatga

SEQ ID NO: 14454 - DNA, 20 bp, synthetic construct
  misc_feature 1..20: note = CRISPR gRNA sequence
  source 1..20: mol_type = other DNA
gggtcccatgatggctgccc

SEQ ID NO: 14455 - DNA, 20 bp, synthetic construct
  misc_feature 1..20: note = CRISPR gRNA sequence
  source 1..20: mol_type = other DNA
ccccagtgccccaaattccc

SEQ ID NO: 14456 - DNA, 20 bp, synthetic construct
  misc_feature 1..20: note = CRISPR gRNA sequence
  source 1..20: mol_type = other DNA
cccagtgccccaaattcccc

SEQ ID NO: 14457 - DNA, 20 bp, synthetic construct
  misc_feature 1..20: note = CRISPR gRNA sequence
  source 1..20: mol_type = other DNA
ccagtgccccaaattcccca

SEQ ID NO: 14458 - DNA, 20 bp, synthetic construct
  misc_feature 1..20: note = CRISPR gRNA sequence
  source 1..20: mol_type = other DNA
cagtgccccaaattccccag

SEQ ID NO: 14459 - DNA, 20 bp, synthetic construct
  misc_feature 1..20: note = CRISPR gRNA sequence
  source 1..20: mol_type = other DNA
agtgccccaaattccccagg

SEQ ID NO: 14460 - DNA, 20 bp, synthetic construct
  misc_feature 1..20: note = CRISPR gRNA sequence
  source 1..20: mol_type = other DNA
cccagggggattgctttcct

SEQ ID NO: 14461 - DNA, 20 bp, synthetic construct
  misc_feature 1..20: note = CRISPR gRNA sequence
  source 1..20: mol_type = other DNA
ccagggggattgctttcctt

SEQ ID NO: 14462 - DNA, 20 bp, synthetic construct
  misc_feature 1..20: note = CRISPR gRNA sequence
  source 1..20: mol_type = other DNA
cagggggattgctttccttg

SEQ ID NO: 14463 - DNA, 20 bp, synthetic construct
  misc_feature 1..20: note = CRISPR gRNA sequence
  source 1..20: mol_type = other DNA
ttgtccccctcttaaaaaaa

SEQ ID NO: 14464 - DNA, 20 bp, synthetic construct
  misc_feature 1..20: note = CRISPR gRNA sequence
  source 1..20: mol_type = other DNA
cttaaaaaaaaagatctgtc

SEQ ID NO: 14465 - DNA, 20 bp, synthetic construct
  misc_feature 1..20: note = CRISPR gRNA sequence
  source 1..20: mol_type = other DNA
ttaaaaaaaaagatctgtct

SEQ ID NO: 14466 - DNA, 20 bp, synthetic construct
  misc_feature 1..20: note = CRISPR gRNA sequence
  source 1..20: mol_type = other DNA
aaaaaagatctgtctgggtg

SEQ ID NO: 14467 - DNA, 20 bp, synthetic construct
  misc_feature 1..20: note = CRISPR gRNA sequence
  source 1..20: mol_type = other DNA
ggtgcggtgcctcgtgactg

SEQ ID NO: 14468 - DNA, 20 bp, synthetic construct
  misc_feature 1..20: note = CRISPR gRNA sequence
  source 1..20: mol_type = other DNA
gtgcctcgtgactgtagtcc

SEQ ID NO: 14469 - DNA, 20 bp, synthetic construct
  misc_feature 1..20: note = CRISPR gRNA sequence
  source 1..20: mol_type = other DNA
tgactgtagtcccagcactt

SEQ ID NO: 14470 - DNA, 20 bp, synthetic construct
  misc_feature 1..20: note = CRISPR gRNA sequence
  source 1..20: mol_type = other DNA
gactgtagtcccagcacttt

SEQ ID NO: 14471 - DNA, 20 bp, synthetic construct
  misc_feature 1..20: note = CRISPR gRNA sequence
  source 1..20: mol_type = other DNA
ctgtagtcccagcactttgg

SEQ ID NO: 14472 - DNA, 20 bp, synthetic construct
  misc_feature 1..20: note = CRISPR gRNA sequence
  source 1..20: mol_type = other DNA
tgtagtcccagcactttggg

SEQ ID NO: 14473 - DNA, 20 bp, synthetic construct
  misc_feature 1..20: note = CRISPR gRNA sequence
  source 1..20: mol_type = other DNA
tcccagcactttgggaggct

SEQ ID NO: 14474 - DNA, 20 bp, synthetic construct
  misc_feature 1..20: note = CRISPR gRNA sequence
  source 1..20: mol_type = other DNA
cccagcactttgggaggctg

SEQ ID NO: 14475 - DNA, 20 bp, synthetic construct
  misc_feature 1..20: note = CRISPR gRNA sequence
  source 1..20: mol_type = other DNA
agcactttgggaggctgagg

SEQ ID NO: 14476 - DNA, 20 bp, synthetic construct
  misc_feature 1..20: note = CRISPR gRNA sequence
  source 1..20: mol_type = other DNA
gcactttgggaggctgaggc

SEQ ID NO: 14477 - DNA, 20 bp, synthetic construct
  misc_feature 1..20: note = CRISPR gRNA sequence
  source 1..20: mol_type = other DNA
actttgggaggctgaggcag

SEQ ID NO: 14478 - DNA, 20 bp, synthetic construct
  misc_feature 1..20: note = CRISPR gRNA sequence
  source 1..20: mol_type = other DNA
ctttgggaggctgaggcagg

SEQ ID NO: 14479 - DNA, 20 bp, synthetic construct
  misc_feature 1..20: note = CRISPR gRNA sequence
  source 1..20: mol_type = other DNA
ctgaggcaggaggattgctt

SEQ ID NO: 14480 - DNA, 20 bp, synthetic construct
  misc_feature 1..20: note = CRISPR gRNA sequence
  source 1..20: mol_type = other DNA
tgaggcaggaggattgcttg

SEQ ID NO: 14481 - DNA, 20 bp, synthetic construct
  misc_feature 1..20: note = CRISPR gRNA sequence
  source 1..20: mol_type = other DNA
gcaggaggattgcttgaggc

SEQ ID NO: 14482 - DNA, 20 bp, synthetic construct
  misc_feature 1..20: note = CRISPR gRNA sequence
  source 1..20: mol_type = other DNA
caggaggattgcttgaggcc

SEQ ID NO: 14483 - DNA, 20 bp, synthetic construct
  misc_feature 1..20: note = CRISPR gRNA sequence
  source 1..20: mol_type = other DNA
ggaggattgcttgaggccag

SEQ ID NO: 14484 - DNA, 20 bp, synthetic construct
  misc_feature 1..20: note = CRISPR gRNA sequence
  source 1..20: mol_type = other DNA
ttgcttgaggccaggagttc

SEQ ID NO: 14485 - DNA, 20 bp, synthetic construct
  misc_feature 1..20: note = CRISPR gRNA sequence
  source 1..20: mol_type = other DNA
tgaggccaggagttcaagac

SEQ ID NO: 14486 - DNA, 20 bp, synthetic construct
  misc_feature 1..20: note = CRISPR gRNA sequence
  source 1..20: mol_type = other DNA
ccaggagttcaagaccagcc

SEQ ID NO: 14487 - DNA, 20 bp, synthetic construct
  misc_feature 1..20: note = CRISPR gRNA sequence
  source 1..20: mol_type = other DNA
caggagttcaagaccagcct

SEQ ID NO: 14488 - DNA, 20 bp, synthetic construct
  misc_feature 1..20: note = CRISPR gRNA sequence
  source 1..20: mol_type = other DNA
caagaccagcctgggcaaca

SEQ ID NO: 14489 - DNA, 20 bp, synthetic construct
  misc_feature 1..20: note = CRISPR gRNA sequence
  source 1..20: mol_type = other DNA
accagcctgggcaacatagc

SEQ ID NO: 14490 - DNA, 20 bp, synthetic construct
  misc_feature 1..20: note = CRISPR gRNA sequence
  source 1..20: mol_type = other DNA
caaaaacttaaaaaatcatc

SEQ ID NO: 14491 - DNA, 20 bp, synthetic construct
  misc_feature 1..20: note = CRISPR gRNA sequence
  source 1..20: mol_type = other DNA
atgacgtgcacctataatcc

SEQ ID NO: 14492 - DNA, 20 bp, synthetic construct
  misc_feature 1..20: note = CRISPR gRNA sequence
  source 1..20: mol_type = other DNA
cacctataatcccagctact

SEQ ID NO: 14493 - DNA, 20 bp, synthetic construct
  misc_feature 1..20: note = CRISPR gRNA sequence
  source 1..20: mol_type = other DNA
acctataatcccagctactt

SEQ ID NO: 14494 - DNA, 20 bp, synthetic construct
  misc_feature 1..20: note = CRISPR gRNA sequence
  source 1..20: mol_type = other DNA
ctataatcccagctacttgg

SEQ ID NO: 14495 - DNA, 20 bp, synthetic construct
  misc_feature 1..20: note = CRISPR gRNA sequence
  source 1..20: mol_type = other DNA
tataatcccagctacttggg

SEQ ID NO: 14496 - DNA, 20 bp, synthetic construct
  misc_feature 1..20: note = CRISPR gRNA sequence
  source 1..20: mol_type = other DNA
tcccagctacttgggaggct

SEQ ID NO: 14497 - DNA, 20 bp, synthetic construct
  misc_feature 1..20: note = CRISPR gRNA sequence
  source 1..20: mol_type = other DNA
cccagctacttgggaggctg

SEQ ID NO: 14498 - DNA, 20 bp, synthetic construct
  misc_feature 1..20: note = CRISPR gRNA sequence
  source 1..20: mol_type = other DNA
agctacttgggaggctgagg

SEQ ID NO: 14499 - DNA, 20 bp, synthetic construct
  misc_feature 1..20: note = CRISPR gRNA sequence
  source 1..20: mol_type = other DNA
gctacttgggaggctgaggc

SEQ ID NO: 14500 - DNA, 20 bp, synthetic construct
  misc_feature 1..20: note = CRISPR gRNA sequence
  source 1..20: mol_type = other DNA
tacttgggaggctgaggcag

SEQ ID NO: 14501 - DNA, 20 bp, synthetic construct
  misc_feature 1..20: note = CRISPR gRNA sequence
  source 1..20: mol_type = other DNA
acttgggaggctgaggcagg

SEQ ID NO: 14502 - DNA, 20 bp, synthetic construct
  misc_feature 1..20: note = CRISPR gRNA sequence
  source 1..20: mol_type = other DNA
ctgaggcaggaggatcgctt

SEQ ID NO: 14503 - DNA, 20 bp, synthetic construct
  misc_feature 1..20: note = CRISPR gRNA sequence
  source 1..20: mol_type = other DNA
gcaggaggatcgcttgagct

SEQ ID NO: 14504 - DNA, 20 bp, synthetic construct
  misc_feature 1..20: note = CRISPR gRNA sequence
  source 1..20: mol_type = other DNA
caggaggatcgcttgagctc

SEQ ID NO: 14505 - DNA, 20 bp, synthetic construct
  misc_feature 1..20: note = CRISPR gRNA sequence
  source 1..20: mol_type = other DNA
ggaggatcgcttgagctcag

SEQ ID NO: 14506 - DNA, 20 bp, synthetic construct
  misc_feature 1..20: note = CRISPR gRNA sequence
  source 1..20: mol_type = other DNA
gcttgagctcaggagttccg

SEQ ID NO: 14507 - DNA, 20 bp, synthetic construct
  misc_feature 1..20: note = CRISPR gRNA sequence
  source 1..20: mol_type = other DNA
gctcaggagttccgaagcta

SEQ ID NO: 14508 - DNA, 20 bp, synthetic construct
  misc_feature 1..20: note = CRISPR gRNA sequence
  source 1..20: mol_type = other DNA
aggagttccgaagctacagt

SEQ ID NO: 14509 - DNA, 20 bp, synthetic construct
  misc_feature 1..20: note = CRISPR gRNA sequence
  source 1..20: mol_type = other DNA
atgatcgcactactgtattc

SEQ ID NO: 14510 - DNA, 20 bp, synthetic construct
  misc_feature 1..20: note = CRISPR gRNA sequence
  source 1..20: mol_type = other DNA
cgcactactgtattctagcc

SEQ ID NO: 14511 - DNA, 20 bp, synthetic construct
  misc_feature 1..20: note = CRISPR gRNA sequence
  source 1..20: mol_type = other DNA
actactgtattctagcctgg

SEQ ID NO: 14512 - DNA, 20 bp, synthetic construct
  misc_feature 1..20: note = CRISPR gRNA sequence
  source 1..20: mol_type = other DNA
gtattctagcctggtagaca

SEQ ID NO: 14513 - DNA, 20 bp, synthetic construct
  misc_feature 1..20: note = CRISPR gRNA sequence
  source 1..20: mol_type = other DNA
tctagcctggtagacacagc

SEQ ID NO: 14514 - DNA, 20 bp, synthetic construct
  misc_feature 1..20: note = CRISPR gRNA sequence
  source 1..20: mol_type = other DNA
cacagcgagaccctgtcttt

SEQ ID NO: 14515 - DNA, 20 bp, synthetic construct
  misc_feature 1..20: note = CRISPR gRNA sequence
  source 1..20: mol_type = other DNA
aataataaaaataaaaataa

SEQ ID NO: 14516 - DNA, 20 bp, synthetic construct
  misc_feature 1..20: note = CRISPR gRNA sequence
  source 1..20: mol_type = other DNA
aaaataaaaataaaagatct

SEQ ID NO: 14517 - DNA, 20 bp, synthetic construct
  misc_feature 1..20: note = CRISPR gRNA sequence
  source 1..20: mol_type = other DNA
aaataaaaataaaagatctc

SEQ ID NO: 14518 - DNA, 20 bp, synthetic construct
  misc_feature 1..20: note = CRISPR gRNA sequence
  source 1..20: mol_type = other DNA
tctcaggactgtatctttca

SEQ ID NO: 14519 - DNA, 20 bp, synthetic construct
  misc_feature 1..20: note = CRISPR gRNA sequence
  source 1..20: mol_type = other DNA
actgtatctttcatggaaat

SEQ ID NO: 14520 - DNA, 20 bp, synthetic construct
  misc_feature 1..20: note = CRISPR gRNA sequence
  source 1..20: mol_type = other DNA
tctttcatggaaatgagcct

SEQ ID NO: 14521 - DNA, 20 bp, synthetic construct
  misc_feature 1..20: note = CRISPR gRNA sequence
  source 1..20: mol_type = other DNA
catggaaatgagcctcagat

SEQ ID NO: 14522 - DNA, 20 bp, synthetic construct
  misc_feature 1..20: note = CRISPR gRNA sequence
  source 1..20: mol_type = other DNA
atggaaatgagcctcagatt

SEQ ID NO: 14523 - DNA, 20 bp, synthetic construct
  misc_feature 1..20: note = CRISPR gRNA sequence
  source 1..20: mol_type = other DNA
gcctcagattaggcacttac

SEQ ID NO: 14524 - DNA, 20 bp, synthetic construct
  misc_feature 1..20: note = CRISPR gRNA sequence
  source 1..20: mol_type = other DNA
gcacttaccagtacctatcc

SEQ ID NO: 14525 - DNA, 20 bp, synthetic construct
  misc_feature 1..20: note = CRISPR gRNA sequence
  source 1..20: mol_type = other DNA
ttaccagtacctatcccaga

SEQ ID NO: 14526 - DNA, 20 bp, synthetic construct
  misc_feature 1..20: note = CRISPR gRNA sequence
  source 1..20: mol_type = other DNA
acctatcccagacagcactt

SEQ ID NO: 14527 - DNA, 20 bp, synthetic construct
  misc_feature 1..20: note = CRISPR gRNA sequence
  source 1..20: mol_type = other DNA
ctatcccagacagcacttaa

SEQ ID NO: 14528 - DNA, 20 bp, synthetic construct
  misc_feature 1..20: note = CRISPR gRNA sequence
  source 1..20: mol_type = other DNA
tatcccagacagcacttaag

SEQ ID NO: 14529 - DNA, 20 bp, synthetic construct
  misc_feature 1..20: note = CRISPR gRNA sequence
  source 1..20: mol_type = other DNA
cgctcaaacaatgtgtgatg

SEQ ID NO: 14530 - DNA, 20 bp, synthetic construct
  misc_feature 1..20: note = CRISPR gRNA sequence
  source 1..20: mol_type = other DNA
gctcaaacaatgtgtgatga

SEQ ID NO: 14531 - DNA, 20 bp, synthetic construct
  misc_feature 1..20: note = CRISPR gRNA sequence
  source 1..20: mol_type = other DNA
tgtgatgaaggaatgaatga

SEQ ID NO: 14532 - DNA, 20 bp, synthetic construct
  misc_feature 1..20: note = CRISPR gRNA sequence
  source 1..20: mol_type = other DNA
atgaaggaatgaatgaaaga

SEQ ID NO: 14533 - DNA, 20 bp, synthetic construct
  misc_feature 1..20: note = CRISPR gRNA sequence
  source 1..20: mol_type = other DNA
agttaacttgttctgtaatc

SEQ ID NO: 14534 - DNA, 20 bp, synthetic construct
  misc_feature 1..20: note = CRISPR gRNA sequence
  source 1..20: mol_type = other DNA
atcaagttttgtctgccttc

SEQ ID NO: 14535 - DNA, 20 bp, synthetic construct
  misc_feature 1..20: note = CRISPR gRNA sequence
  source 1..20: mol_type = other DNA
tttgtctgccttctggacct

SEQ ID NO: 14536 - DNA, 20 bp, synthetic construct
  misc_feature 1..20: note = CRISPR gRNA sequence
  source 1..20: mol_type = other DNA
agctctgccgtctataaatt

SEQ ID NO: 14537 - DNA, 20 bp, synthetic construct
  misc_feature 1..20: note = CRISPR gRNA sequence
  source 1..20: mol_type = other DNA
gctctgccgtctataaattt

SEQ ID NO: 14538 - DNA, 20 bp, synthetic construct
  misc_feature 1..20: note = CRISPR gRNA sequence
  source 1..20: mol_type = other DNA
cgtctataaatttgggacaa

SEQ ID NO: 14539 - DNA, 20 bp, synthetic construct
  misc_feature 1..20: note = CRISPR gRNA sequence
  source 1..20: mol_type = other DNA
cagttgtcctaaatgcctca

SEQ ID NO: 14540 - DNA, 20 bp, synthetic construct
  misc_feature 1..20: note = CRISPR gRNA sequence
  source 1..20: mol_type = other DNA
agttgtcctaaatgcctcaa

SEQ ID NO: 14541 - DNA, 20 bp, synthetic construct
  misc_feature 1..20: note = CRISPR gRNA sequence
  source 1..20: mol_type = other DNA
gttgtcctaaatgcctcaaa

SEQ ID NO: 14542 - DNA, 20 bp, synthetic construct
  misc_feature 1..20: note = CRISPR gRNA sequence
  source 1..20: mol_type = other DNA
gtcctaaatgcctcaaaggg

SEQ ID NO: 14543 - DNA, 20 bp, synthetic construct
  misc_feature 1..20: note = CRISPR gRNA sequence
  source 1..20: mol_type = other DNA
ctaaatgcctcaaagggtgg

SEQ ID NO: 14544 - DNA, 20 bp, synthetic construct
  misc_feature 1..20: note = CRISPR gRNA sequence
  source 1..20: mol_type = other DNA
aatgcctcaaagggtggcag

SEQ ID NO: 14545 - DNA, 20 bp, synthetic construct
  misc_feature 1..20: note = CRISPR gRNA sequence
  source 1..20: mol_type = other DNA
atgcctcaaagggtggcagt

SEQ ID NO: 14546 - DNA, 20 bp, synthetic construct
  misc_feature 1..20: note = CRISPR gRNA sequence
  source 1..20: mol_type = other DNA
gtaggtgtcacttctgttac

SEQ ID NO: 14547 - DNA, 20 bp, synthetic construct
  misc_feature 1..20: note = CRISPR gRNA sequence
  source 1..20: mol_type = other DNA
taggtgtcacttctgttact

SEQ ID NO: 14548 - DNA, 20 bp, synthetic construct
  misc_feature 1..20: note = CRISPR gRNA sequence
  source 1..20: mol_type = other DNA
acttctgttactaggtgcac

SEQ ID NO: 14549 - DNA, 20 bp, synthetic construct
  misc_feature 1..20: note = CRISPR gRNA sequence
  source 1..20: mol_type = other DNA
cttctgttactaggtgcaca

SEQ ID NO: 14550 - DNA, 20 bp, synthetic construct
  misc_feature 1..20: note = CRISPR gRNA sequence
  source 1..20: mol_type = other DNA
aaggcatccttgttaactcc

SEQ ID NO: 14551 - DNA, 20 bp, synthetic construct
  misc_feature 1..20: note = CRISPR gRNA sequence
  source 1..20: mol_type = other DNA
gcatccttgttaactcctag

SEQ ID NO: 14552 - DNA, 20 bp, synthetic construct
  misc_feature 1..20: note = CRISPR gRNA sequence
  source 1..20: mol_type = other DNA
catccttgttaactcctaga

SEQ ID NO: 14553 - DNA, 20 bp, synthetic construct
  misc_feature 1..20: note = CRISPR gRNA sequence
  source 1..20: mol_type = other DNA
atccttgttaactcctagaa

SEQ ID NO: 14554 - DNA, 20 bp, synthetic construct
  misc_feature 1..20: note = CRISPR gRNA sequence
  source 1..20: mol_type = other DNA
tccttgttaactcctagaag

SEQ ID NO: 14555 - DNA, 20 bp, synthetic construct
  misc_feature 1..20: note = CRISPR gRNA sequence
  source 1..20: mol_type = other DNA
cttgttaactcctagaaggg

SEQ ID NO: 14556 - DNA, 20 bp, synthetic construct
  misc_feature 1..20: note = CRISPR gRNA sequence
  source 1..20: mol_type = other DNA
tgttaactcctagaagggga

SEQ ID NO: 14557 - DNA, 20 bp, synthetic construct
  misc_feature 1..20: note = CRISPR gRNA sequence
  source 1..20: mol_type = other DNA
gttaactcctagaaggggag

SEQ ID NO: 14558 - DNA, 20 bp, synthetic construct
  misc_feature 1..20: note = CRISPR gRNA sequence
  source 1..20: mol_type = other DNA
agaaggggagaggttctcca

SEQ ID NO: 14559 - DNA, 20 bp, synthetic construct
  misc_feature 1..20: note = CRISPR gRNA sequence
  source 1..20: mol_type = other DNA
ggagaggttctccatggctt

SEQ ID NO: 14560 - DNA, 20 bp, synthetic construct
  misc_feature 1..20: note = CRISPR gRNA sequence
  source 1..20: mol_type = other DNA
ggttctccatggctttagct

SEQ ID NO: 14561 - DNA, 20 bp, synthetic construct
  misc_feature 1..20: note = CRISPR gRNA sequence
  source 1..20: mol_type = other DNA
ccatggctttagctaagact

SEQ ID NO: 14562 - DNA, 20 bp, synthetic construct
  misc_feature 1..20: note = CRISPR gRNA sequence
  source 1..20: mol_type = other DNA
catggctttagctaagactt

SEQ ID NO: 14563 - DNA, 20 bp, synthetic construct
  misc_feature 1..20: note = CRISPR gRNA sequence
  source 1..20: mol_type = other DNA
gctaagacttgggcacatga

SEQ ID NO: 14564 - DNA, 20 bp, synthetic construct
  misc_feature 1..20: note = CRISPR gRNA sequence
  source 1..20: mol_type = other DNA
aagacttgggcacatgatgg

SEQ ID NO: 14565 - DNA, 20 bp, synthetic construct
  misc_feature 1..20: note = CRISPR gRNA sequence
  source 1..20: mol_type = other DNA
agacttgggcacatgatggc

SEQ ID NO: 14566 - DNA, 20 bp, synthetic construct
  misc_feature 1..20: note = CRISPR gRNA sequence
  source 1..20: mol_type = other DNA
atgatggcaggttttgaatg

SEQ ID NO: 14567 - DNA, 20 bp, synthetic construct
  misc_feature 1..20: note = CRISPR gRNA sequence
  source 1..20: mol_type = other DNA
ggcaggttttgaatgcagca

SEQ ID NO: 14568 - DNA, 20 bp, synthetic construct
  misc_feature 1..20: note = CRISPR gRNA sequence
  source 1..20: mol_type = other DNA
tgcagcaaagttttcaattc

SEQ ID NO: 14569 - DNA, 20 bp, synthetic construct
  misc_feature 1..20: note = CRISPR gRNA sequence
  source 1..20: mol_type = other DNA
cagcaaagttttcaattcta

SEQ ID NO: 14570 - DNA, 20 bp, synthetic construct
  misc_feature 1..20: note = CRISPR gRNA sequence
  source 1..20: mol_type = other DNA
agcaaagttttcaattctag

SEQ ID NO: 14571 - DNA, 20 bp, synthetic construct
  misc_feature 1..20: note = CRISPR gRNA sequence
  source 1..20: mol_type = other DNA
tcaattctagaggctccgcc

SEQ ID NO: 14572 - DNA, 20 bp, synthetic construct
  misc_feature 1..20: note = CRISPR gRNA sequence
  source 1..20: mol_type = other DNA
caattctagaggctccgcct

SEQ ID NO: 14573 - DNA, 20 bp, synthetic construct
  misc_feature 1..20: note = CRISPR gRNA sequence
  source 1..20: mol_type = other DNA
ttctagaggctccgcctggg

SEQ ID NO: 14574 - DNA, 20 bp, synthetic construct
  misc_feature 1..20: note = CRISPR gRNA sequence
  source 1..20: mol_type = other DNA
agaggctccgcctgggcagc

SEQ ID NO: 14575 - DNA, 20 bp, synthetic construct
  misc_feature 1..20: note = CRISPR gRNA sequence
  source 1..20: mol_type = other DNA
ctccgcctgggcagcgagtg

SEQ ID NO: 14576 - DNA, 20 bp, synthetic construct
  misc_feature 1..20: note = CRISPR gRNA sequence
  source 1..20: mol_type = other DNA
gcctgggcagcgagtgcagt

SEQ ID NO: 14577 - DNA, 20 bp, synthetic construct
  misc_feature 1..20: note = CRISPR gRNA sequence
  source 1..20: mol_type = other DNA
ctgggcagcgagtgcagtga

SEQ ID NO: 14578 - DNA, 20 bp, synthetic construct
  misc_feature 1..20: note = CRISPR gRNA sequence
  source 1..20: mol_type = other DNA
gcgagtgcagtgagagactc

SEQ ID NO: 14579 - DNA, 20 bp, synthetic construct
  misc_feature 1..20: note = CRISPR gRNA sequence
  source 1..20: mol_type = other DNA
gtgcagtgagagactctggt

SEQ ID NO: 14580 - DNA, 20 bp, synthetic construct
  misc_feature 1..20: note = CRISPR gRNA sequence
  source 1..20: mol_type = other DNA
gactctggttagccattgcc

SEQ ID NO: 14581 - DNA, 20 bp, synthetic construct
  misc_feature 1..20: note = CRISPR gRNA sequence
  source 1..20: mol_type = other DNA
ctggttagccattgcccaga

SEQ ID NO: 14582 - DNA, 20 bp, synthetic construct
  misc_feature 1..20: note = CRISPR gRNA sequence
  source 1..20: mol_type = other DNA
ggttagccattgcccagaaa

SEQ ID NO: 14583 - DNA, 20 bp, synthetic construct
  misc_feature 1..20: note = CRISPR gRNA sequence
  source 1..20: mol_type = other DNA
gttagccattgcccagaaag

SEQ ID NO: 14584 - DNA, 20 bp, synthetic construct
  misc_feature 1..20: note = CRISPR gRNA sequence
  source 1..20: mol_type = other DNA
ttagccattgcccagaaaga

SEQ ID NO: 14585 - DNA, 20 bp, synthetic construct
  misc_feature 1..20: note = CRISPR gRNA sequence
  source 1..20: mol_type = other DNA
cattgcccagaaagagggca

SEQ ID NO: 14586 - DNA, 20 bp, synthetic construct
  misc_feature 1..20: note = CRISPR gRNA sequence
  source 1..20: mol_type = other DNA
attgcccagaaagagggcat

SEQ ID NO: 14587 - DNA, 20 bp, synthetic construct
  misc_feature 1..20: note = CRISPR gRNA sequence
  source 1..20: mol_type = other DNA
ttgcccagaaagagggcatg

SEQ ID NO: 14588 - DNA, 20 bp, synthetic construct
  misc_feature 1..20: note = CRISPR gRNA sequence
  source 1..20: mol_type = other DNA
aaagagggcatggggtgtcc

SEQ ID NO: 14589 - DNA, 20 bp, synthetic construct
  misc_feature 1..20: note = CRISPR gRNA sequence
  source 1..20: mol_type = other DNA
agagggcatggggtgtccca

SEQ ID NO: 14590 - DNA, 20 bp, synthetic construct
  misc_feature 1..20: note = CRISPR gRNA sequence
  source 1..20: mol_type = other DNA
gagggcatggggtgtcccag

SEQ ID NO: 14591 - DNA, 20 bp, synthetic construct
  misc_feature 1..20: note = CRISPR gRNA sequence
  source 1..20: mol_type = other DNA
gcatggggtgtcccagagga

SEQ ID NO: 14592 - DNA, 20 bp, synthetic construct
  misc_feature 1..20: note = CRISPR gRNA sequence
  source 1..20: mol_type = other DNA
catggggtgtcccagaggac

SEQ ID NO: 14593 - DNA, 20 bp, synthetic construct
  misc_feature 1..20: note = CRISPR gRNA sequence
  source 1..20: mol_type = other DNA
atggggtgtcccagaggaca

SEQ ID NO: 14594 - DNA, 20 bp, synthetic construct
  misc_feature 1..20: note = CRISPR gRNA sequence
  source 1..20: mol_type = other DNA
tggggtgtcccagaggacag

SEQ ID NO: 14595 - DNA, 20 bp, synthetic construct
  misc_feature 1..20: note = CRISPR gRNA sequence
  source 1..20: mol_type = other DNA
ggggtgtcccagaggacagg

SEQ ID NO: 14596 - DNA, 20 bp, synthetic construct
  misc_feature 1..20: note = CRISPR gRNA sequence
  source 1..20: mol_type = other DNA
tcccagaggacagggggcac

SEQ ID NO: 14597 - DNA, 20 bp, synthetic construct
  misc_feature 1..20: note = CRISPR gRNA sequence
  source 1..20: mol_type = other DNA
gaaatgcccatgacaaactt

SEQ ID NO: 14598 - DNA, 20 bp, synthetic construct
  misc_feature 1..20: note = CRISPR gRNA sequence
  source 1..20: mol_type = other DNA
gcccatgacaaacttgagaa

SEQ ID NO: 14599 - DNA, 20 bp, synthetic construct
  misc_feature 1..20: note = CRISPR gRNA sequence
  source 1..20: mol_type = other DNA
cccatgacaaacttgagaat

SEQ ID NO: 14600 - DNA, 20 bp, synthetic construct
  misc_feature 1..20: note = CRISPR gRNA sequence
  source 1..20: mol_type = other DNA
ctacatgtcctcaacctgca

SEQ ID NO: 14601 - DNA, 20 bp, synthetic construct
  misc_feature 1..20: note = CRISPR gRNA sequence
  source 1..20: mol_type = other DNA
ccgcctctcctctcacctct

SEQ ID NO: 14602 - DNA, 20 bp, synthetic construct
  misc_feature 1..20: note = CRISPR gRNA sequence
  source 1..20: mol_type = other DNA
tctcacctctgagtctgcac

SEQ ID NO: 14603 - DNA, 20 bp, synthetic construct
  misc_feature 1..20: note = CRISPR gRNA sequence
  source 1..20: mol_type = other DNA
tgagtctgcacaagctttcc

SEQ ID NO: 14604 - DNA, 20 bp, synthetic construct
  misc_feature 1..20: note = CRISPR gRNA sequence
  source 1..20: mol_type = other DNA
gagtctgcacaagctttccc

SEQ ID NO: 14605 - DNA, 20 bp, synthetic construct
  misc_feature 1..20: note = CRISPR gRNA sequence
  source 1..20: mol_type = other DNA
cccaggtcttccacatcctt

SEQ ID NO: 14606 - DNA, 20 bp, synthetic construct
  misc_feature 1..20: note = CRISPR gRNA sequence
  source 1..20: mol_type = other DNA
ccaggtcttccacatccttc

SEQ ID NO: 14607 - DNA, 20 bp, synthetic construct
  misc_feature 1..20: note = CRISPR gRNA sequence
  source 1..20: mol_type = other DNA
caggtcttccacatccttca

SEQ ID NO: 14608 - DNA, 20 bp, synthetic construct
  misc_feature 1..20: note = CRISPR gRNA sequence
  source 1..20: mol_type = other DNA
ttccacatccttcagggact

SEQ ID NO: 14609 - DNA, 20 bp, synthetic construct
  misc_feature 1..20: note = CRISPR gRNA sequence
  source 1..20: mol_type = other DNA
cttcagggacttggctttga

SEQ ID NO: 14610 - DNA, 20 bp, synthetic construct
  misc_feature 1..20: note = CRISPR gRNA sequence
  source 1..20: mol_type = other DNA
ttcagggacttggctttgaa

SEQ ID NO: 14611 - DNA, 20 bp, synthetic construct
  misc_feature 1..20: note = CRISPR gRNA sequence
  source 1..20: mol_type = other DNA
cttggctttgaaaggctcga

SEQ ID NO: 14612 - DNA, 20 bp, synthetic construct
  misc_feature 1..20: note = CRISPR gRNA sequence
  source 1..20: mol_type = other DNA
aacttctcctctgctgcctg

SEQ ID NO: 14613 - DNA, 20 bp, synthetic construct
  misc_feature 1..20: note = CRISPR gRNA sequence
  source 1..20: mol_type = other DNA
ttctcctctgctgcctgaag

SEQ ID NO: 14614 - DNA, 20 bp, synthetic construct
  misc_feature 1..20: note = CRISPR gRNA sequence
  source 1..20: mol_type = other DNA
ctctgctgcctgaagtagct

SEQ ID NO: 14615 - DNA, 20 bp, synthetic construct
  misc_feature 1..20: note = CRISPR gRNA sequence
  source 1..20: mol_type = other DNA
ttggtctccccatgctgctg

SEQ ID NO: 14616 - DNA, 20 bp, synthetic construct
  misc_feature 1..20: note = CRISPR gRNA sequence
  source 1..20: mol_type = other DNA
tggtctccccatgctgctgc

SEQ ID NO: 14617 - DNA, 20 bp, synthetic construct
  misc_feature 1..20: note = CRISPR gRNA sequence
  source 1..20: mol_type = other DNA
ggtctccccatgctgctgca

SEQ ID NO: 14618 - DNA, 20 bp, synthetic construct
  misc_feature 1..20: note = CRISPR gRNA sequence
  source 1..20: mol_type = other DNA
tgctgctgcagggactccca

SEQ ID NO: 14619 - DNA, 20 bp, synthetic construct
  misc_feature 1..20: note = CRISPR gRNA sequence
  source 1..20: mol_type = other DNA
acagcgccaccgtgtcgctc

SEQ ID NO: 14620 - DNA, 20 bp, synthetic construct
  misc_feature 1..20: note = CRISPR gRNA sequence
  source 1..20: mol_type = other DNA
cagcgccaccgtgtcgctca

SEQ ID NO: 14621 - DNA, 20 bp, synthetic construct
  misc_feature 1..20: note = CRISPR gRNA sequence
  source 1..20: mol_type = other DNA
cgccaccgtgtcgctcaagg

SEQ ID NO: 14622 - DNA, 20 bp, synthetic construct
  misc_feature 1..20: note = CRISPR gRNA sequence
  source 1..20: mol_type = other DNA
tgtcgctcaaggcagccctg

SEQ ID NO: 14623 - DNA, 20 bp, synthetic construct
  misc_feature 1..20: note = CRISPR gRNA sequence
  source 1..20: mol_type = other DNA
tcgctcaaggcagccctgtg

SEQ ID NO: 14624 - DNA, 20 bp, synthetic construct
  misc_feature 1..20: note = CRISPR gRNA sequence
  source 1..20: mol_type = other DNA
cgctcaaggcagccctgtgg

SEQ ID NO: 14625 - DNA, 20 bp, synthetic construct
  misc_feature 1..20: note = CRISPR gRNA sequence
  source 1..20: mol_type = other DNA
gctcaaggcagccctgtgga

SEQ ID NO: 14626 - DNA, 20 bp, synthetic construct
  misc_feature 1..20: note = CRISPR gRNA sequence
  source 1..20: mol_type = other DNA
tcaaggcagccctgtggagg

SEQ ID NO: 14627 - DNA, 20 bp, synthetic construct
  misc_feature 1..20: note = CRISPR gRNA sequence
  source 1..20: mol_type = other DNA
caaggcagccctgtggaggg

SEQ ID NO: 14628 - DNA, 20 bp, synthetic construct
  misc_feature 1..20: note = CRISPR gRNA sequence
  source 1..20: mol_type = other DNA
aaggcagccctgtggaggga

SEQ ID NO: 14629 - DNA, 20 bp, synthetic construct
  misc_feature 1..20: note = CRISPR gRNA sequence
  source 1..20: mol_type = other DNA
gccctgtggagggagggcct

SEQ ID NO: 14630 - DNA, 20 bp, synthetic construct
  misc_feature 1..20: note = CRISPR gRNA sequence
  source 1..20: mol_type = other DNA
tggagggagggcctcagacc

SEQ ID NO: 14631 - DNA, 20 bp, synthetic construct
  misc_feature 1..20: note = CRISPR gRNA sequence
  source 1..20: mol_type = other DNA
ggagggagggcctcagaccc

SEQ ID NO: 14632 - DNA, 20 bp, synthetic construct
  misc_feature 1..20: note = CRISPR gRNA sequence
  source 1..20: mol_type = other DNA
gagggcctcagacccaggca

SEQ ID NO: 14633 - DNA, 20 bp, synthetic construct
  misc_feature 1..20: note = CRISPR gRNA sequence
  source 1..20: mol_type = other DNA
tcagacccaggcacggtgac

SEQ ID NO: 14634 - DNA, 20 bp, synthetic construct
  misc_feature 1..20: note = CRISPR gRNA sequence
  source 1..20: mol_type = other DNA
cagacccaggcacggtgacc

SEQ ID NO: 14635 - DNA, 20 bp, synthetic construct
  misc_feature 1..20: note = CRISPR gRNA sequence
  source 1..20: mol_type = other DNA
cccaggcacggtgaccaggc

SEQ ID NO: 14636 - DNA, 20 bp, synthetic construct
  misc_feature 1..20: note = CRISPR gRNA sequence
  source 1..20: mol_type = other DNA
gtgaccaggctagaccttaa

SEQ ID NO: 14637 - DNA, 20 bp, synthetic construct
  misc_feature 1..20: note = CRISPR gRNA sequence
  source 1..20: mol_type = other DNA
accaggctagaccttaatgg

SEQ ID NO: 14638 - DNA, 20 bp, synthetic construct
  misc_feature 1..20: note = CRISPR gRNA sequence
  source 1..20: mol_type = other DNA
ccaggctagaccttaatgga

SEQ ID NO: 14639 - DNA, 20 bp, synthetic construct
  misc_feature 1..20: note = CRISPR gRNA sequence
  source 1..20: mol_type = other DNA
caggctagaccttaatggaa

SEQ ID NO: 14640 - DNA, 20 bp, synthetic construct
  misc_feature 1..20: note = CRISPR gRNA sequence
  source 1..20: mol_type = other DNA
gctagaccttaatggaaggg

SEQ ID NO: 14641 - DNA, 20 bp, synthetic construct
  misc_feature 1..20: note = CRISPR gRNA sequence
  source 1..20: mol_type = other DNA
aatggaagggcagctccatg

SEQ ID NO: 14642 - DNA, 20 bp, synthetic construct
  misc_feature 1..20: note = CRISPR gRNA sequence
  source 1..20: mol_type = other DNA
atggaagggcagctccatga

SEQ ID NO: 14643 - DNA, 20 bp, synthetic construct
  misc_feature 1..20: note = CRISPR gRNA sequence
  source 1..20: mol_type = other DNA
tggaagggcagctccatgaa

SEQ ID NO: 14644 - DNA, 20 bp, synthetic construct
  misc_feature 1..20: note = CRISPR gRNA sequence
  source 1..20: mol_type = other DNA
attaaaatactttctttcct

SEQ ID NO: 14645 - DNA, 20 bp, synthetic construct
  misc_feature 1..20: note = CRISPR gRNA sequence
  source 1..20: mol_type = other DNA
agctcaacctctacctttcc

SEQ ID NO: 14646 - DNA, 20 bp, synthetic construct
  misc_feature 1..20: note = CRISPR gRNA sequence
  source 1..20: mol_type = other DNA
caacctctacctttcccaga

SEQ ID NO: 14647 - DNA, 20 bp, synthetic construct
  misc_feature 1..20: note = CRISPR gRNA sequence
  source 1..20: mol_type = other DNA
aaagccttccatgaccactc

SEQ ID NO: 14648 - DNA, 20 bp, synthetic construct
  misc_feature 1..20: note = CRISPR gRNA sequence
  source 1..20: mol_type = other DNA
ctactttctcacaactcaca

SEQ ID NO: 14649 - DNA, 20 bp, synthetic construct
  misc_feature 1..20: note = CRISPR gRNA sequence
  source 1..20: mol_type = other DNA
ctttctcacaactcacacag

SEQ ID NO: 14650 - DNA, 20 bp, synthetic construct
  misc_feature 1..20: note = CRISPR gRNA sequence
  source 1..20: mol_type = other DNA
ttttctttccctttttgctt

SEQ ID NO: 14651 - DNA, 20 bp, synthetic construct
  misc_feature 1..20: note = CRISPR gRNA sequence
  source 1..20: mol_type = other DNA
tccctttttgcttcggctac

SEQ ID NO: 14652 - DNA, 20 bp, synthetic construct
  misc_feature 1..20: note = CRISPR gRNA sequence
  source 1..20: mol_type = other DNA
ccctttttgcttcggctacc

SEQ ID NO: 14653 - DNA, 20 bp, synthetic construct
  misc_feature 1..20: note = CRISPR gRNA sequence
  source 1..20: mol_type = other DNA
tttttgcttcggctaccagg

SEQ ID NO: 14654 - DNA, 20 bp, synthetic construct
  misc_feature 1..20: note = CRISPR gRNA sequence
  source 1..20: mol_type = other DNA
gaagctcactgctaaattat

SEQ ID NO: 14655 - DNA, 20 bp, synthetic construct
  misc_feature 1..20: note = CRISPR gRNA sequence
  source 1..20: mol_type = other DNA
aaattattggcacaattatg

SEQ ID NO: 14656 - DNA, 20 bp, synthetic construct
  misc_feature 1..20: note = CRISPR gRNA sequence
  source 1..20: mol_type = other DNA
aattattggcacaattatgt

SEQ ID NO: 14657 - DNA, 20 bp, synthetic construct
  misc_feature 1..20: note = CRISPR gRNA sequence
  source 1..20: mol_type = other DNA
cacaattatgtaggacctta

SEQ ID NO: 14658 - DNA, 20 bp, synthetic construct
  misc_feature 1..20: note = CRISPR gRNA sequence
  source 1..20: mol_type = other DNA
ttatgtaggaccttacagct

SEQ ID NO: 14659 - DNA, 20 bp, synthetic construct
  misc_feature 1..20: note = CRISPR gRNA sequence
  source 1..20: mol_type = other DNA
tatgtaggaccttacagctt

SEQ ID NO: 14660 - DNA, 20 bp, synthetic construct
  misc_feature 1..20: note = CRISPR gRNA sequence
  source 1..20: mol_type = other DNA
aggaccttacagcttgggta

SEQ ID NO: 14661 - DNA, 20 bp, synthetic construct
  misc_feature 1..20: note = CRISPR gRNA sequence
  source 1..20: mol_type = other DNA
cagcttgggtaaagtatgtt

SEQ ID NO: 14662 - DNA, 20 bp, synthetic construct
  misc_feature 1..20: note = CRISPR gRNA sequence
  source 1..20: mol_type = other DNA
agcttgggtaaagtatgttt

SEQ ID NO: 14663 - DNA, 20 bp, synthetic construct
  misc_feature 1..20: note = CRISPR gRNA sequence
  source 1..20: mol_type = other DNA
gcttgggtaaagtatgttta

SEQ ID NO: 14664 - DNA, 20 bp, synthetic construct
  misc_feature 1..20: note = CRISPR gRNA sequence
  source 1..20: mol_type = other DNA
cttgggtaaagtatgtttag

SEQ ID NO: 14665 - DNA, 20 bp, synthetic construct
  misc_feature 1..20: note = CRISPR gRNA sequence
  source 1..20: mol_type = other DNA
ttgggtaaagtatgtttagg

SEQ ID NO: 14666 - DNA, 20 bp, synthetic construct
  misc_feature 1..20: note = CRISPR gRNA sequence
  source 1..20: mol_type = other DNA
agtatgtttagggggaaata

SEQ ID NO: 14667 - DNA, 20 bp, synthetic construct
  misc_feature 1..20: note = CRISPR gRNA sequence
  source 1..20: mol_type = other DNA
atgtttagggggaaatatgg

SEQ ID NO: 14668 - DNA, 20 bp, synthetic construct
  misc_feature 1..20: note = CRISPR gRNA sequence
  source 1..20: mol_type = other DNA
gaaatatggaagcaatcctc

SEQ ID NO: 14669 - DNA, 20 bp, synthetic construct
  misc_feature 1..20: note = CRISPR gRNA sequence
  source 1..20: mol_type = other DNA
gaagcaatcctctggcgatt

SEQ ID NO: 14670 - DNA, 20 bp, synthetic construct
  misc_feature 1..20: note = CRISPR gRNA sequence
  source 1..20: mol_type = other DNA
gcgattaagctgaaatgctc

SEQ ID NO: 14671 - DNA, 20 bp, synthetic construct
  misc_feature 1..20: note = CRISPR gRNA sequence
  source 1..20: mol_type = other DNA
attaagctgaaatgctcaag

SEQ ID NO: 14672 - DNA, 20 bp, synthetic construct
  misc_feature 1..20: note = CRISPR gRNA sequence
  source 1..20: mol_type = other DNA
tgaaatgctcaagcagattg

SEQ ID NO: 14673 - DNA, 20 bp, synthetic construct
  misc_feature 1..20: note = CRISPR gRNA sequence
  source 1..20: mol_type = other DNA
cgacttaatgaaaccaaatt

SEQ ID NO: 14674 - DNA, 20 bp, synthetic construct
  misc_feature 1..20: note = CRISPR gRNA sequence
  source 1..20: mol_type = other DNA
gacttaatgaaaccaaatta

SEQ ID NO: 14675 - DNA, 20 bp, synthetic construct
  misc_feature 1..20: note = CRISPR gRNA sequence
  source 1..20: mol_type = other DNA
tgaaaccaaattaaggaatt

SEQ ID NO: 14676 - DNA, 20 bp, synthetic construct
  misc_feature 1..20: note = CRISPR gRNA sequence
  source 1..20: mol_type = other DNA
gaatttagccttcatcctga

SEQ ID NO: 14677 - DNA, 20 bp, synthetic construct
  misc_feature 1..20: note = CRISPR gRNA sequence
  source 1..20: mol_type = other DNA
tttagccttcatcctgacag

SEQ ID NO: 14678 - DNA, 20 bp, synthetic construct
  misc_feature 1..20: note = CRISPR gRNA sequence
  source 1..20: mol_type = other DNA
agccttcatcctgacagtgg

SEQ ID NO: 14679 - DNA, 20 bp, synthetic construct
  misc_feature 1..20: note = CRISPR gRNA sequence
  source 1..20: mol_type = other DNA
ccttcatcctgacagtggtg

SEQ ID NO: 14680 - DNA, 20 bp, synthetic construct
  misc_feature 1..20: note = CRISPR gRNA sequence
  source 1..20: mol_type = other DNA
acagtggtggagtgtccctg

SEQ ID NO: 14681 - DNA, 20 bp, synthetic construct
  misc_feature 1..20: note = CRISPR gRNA sequence
  source 1..20: mol_type = other DNA
cagtggtggagtgtccctga

SEQ ID NO: 14682 - DNA, 20 bp, synthetic construct
  misc_feature 1..20: note = CRISPR gRNA sequence
  source 1..20: mol_type = other DNA
gagtgtccctgaaggattgt

SEQ ID NO: 14683 - DNA, 20 bp, synthetic construct
  misc_feature 1..20: note = CRISPR gRNA sequence
  source 1..20: mol_type = other DNA
tgtccctgaaggattgtaag

SEQ ID NO: 14684 - DNA, 20 bp, synthetic construct
  misc_feature 1..20: note = CRISPR gRNA sequence
  source 1..20: mol_type = other DNA
gtccctgaaggattgtaagc

SEQ ID NO: 14685 - DNA, 20 bp, synthetic construct
  misc_feature 1..20: note = CRISPR gRNA sequence
  source 1..20: mol_type = other DNA
tccctgaaggattgtaagca

SEQ ID NO: 14686 - DNA, 20 bp, synthetic construct
  misc_feature 1..20: note = CRISPR gRNA sequence
  source 1..20: mol_type = other DNA
tgaaggattgtaagcaggga

SEQ ID NO: 14687 - DNA, 20 bp, synthetic construct
  misc_feature 1..20: note = CRISPR gRNA sequence
  source 1..20: mol_type = other DNA
gaaggattgtaagcagggat

SEQ ID NO: 14688 - DNA, 20 bp, synthetic construct
  misc_feature 1..20: note = CRISPR gRNA sequence
  source 1..20: mol_type = other DNA
aagcagggatgggatacaat

SEQ ID NO: 14689 - DNA, 20 bp, synthetic construct
  misc_feature 1..20: note = CRISPR gRNA sequence
  source 1..20: mol_type = other DNA
gatgggatacaatcagattc

SEQ ID NO: 14690 - DNA, 20 bp, synthetic construct
  misc_feature 1..20: note = CRISPR gRNA sequence
  source 1..20: mol_type = other DNA
tacaatcagattcaagttct

SEQ ID NO: 14691 - DNA, 20 bp, synthetic construct
  misc_feature 1..20: note = CRISPR gRNA sequence
  source 1..20: mol_type = other DNA
aatcagattcaagttctgag

SEQ ID NO: 14692 - DNA, 20 bp, synthetic construct
  misc_feature 1..20: note = CRISPR gRNA sequence
  source 1..20: mol_type = other DNA
gattcaagttctgagaagat

SEQ ID NO: 14693 - DNA, 20 bp, synthetic construct
  misc_feature 1..20: note = CRISPR gRNA sequence
  source 1..20: mol_type = other DNA
aagttctgagaagattggtc

SEQ ID NO: 14694 - DNA, 20 bp, synthetic construct
  misc_feature 1..20: note = CRISPR gRNA sequence
  source 1..20: mol_type = other DNA
tctggttgctgaatacaaaa

SEQ ID NO: 14695 - DNA, 20 bp, synthetic construct
  misc_feature 1..20: note = CRISPR gRNA sequence
  source 1..20: mol_type = other DNA
tggttgctgaatacaaaatg

SEQ ID NO: 14696 - DNA, 20 bp, synthetic construct
  misc_feature 1..20: note = CRISPR gRNA sequence
  source 1..20: mol_type = other DNA
ttgctgaatacaaaatggag

SEQ ID NO: 14697 - DNA, 20 bp, synthetic construct
  misc_feature 1..20: note = CRISPR gRNA sequence
  source 1..20: mol_type = other DNA
ctgaatacaaaatggagtgg

SEQ ID NO: 14698 - DNA, 20 bp, synthetic construct
  misc_feature 1..20: note = CRISPR gRNA sequence
  source 1..20: mol_type = other DNA
gaatacaaaatggagtggaa

SEQ ID NO: 14699 - DNA, 20 bp, synthetic construct
  misc_feature 1..20: note = CRISPR gRNA sequence
  source 1..20: mol_type = other DNA
aatacaaaatggagtggaag

SEQ ID NO: 14700 - DNA, 20 bp, synthetic construct
  misc_feature 1..20: note = CRISPR gRNA sequence
  source 1..20: mol_type = other DNA
tacaaaatggagtggaagag

SEQ ID NO: 14701 - DNA, 20 bp, synthetic construct
  misc_feature 1..20: note = CRISPR gRNA sequence
  source 1..20: mol_type = other DNA
caaaatggagtggaagagga

SEQ ID NO: 14702 - DNA, 20 bp, synthetic construct
  misc_feature 1..20: note = CRISPR gRNA sequence
  source 1..20: mol_type = other DNA
tggagtggaagaggagagaa

SEQ ID NO: 14703 - DNA, 20 bp, synthetic construct
  misc_feature 1..20: note = CRISPR gRNA sequence
  source 1..20: mol_type = other DNA
gagtggaagaggagagaatg

SEQ ID NO: 14704 - DNA, 20 bp, synthetic construct
  misc_feature 1..20: note = CRISPR gRNA sequence
  source 1..20: mol_type = other DNA
agtggaagaggagagaatgg

SEQ ID NO: 14705 - DNA, 20 bp, synthetic construct
  misc_feature 1..20: note = CRISPR gRNA sequence
  source 1..20: mol_type = other DNA
ggaagaggagagaatggagg

SEQ ID NO: 14706 - DNA, 20 bp, synthetic construct
  misc_feature 1..20: note = CRISPR gRNA sequence
  source 1..20: mol_type = other DNA
aagaggagagaatggaggca

SEQ ID NO: 14707 - DNA, 20 bp, synthetic construct
  misc_feature 1..20: note = CRISPR gRNA sequence
  source 1..20: mol_type = other DNA
gaggagagaatggaggcaga

SEQ ID NO: 14708 - DNA, 20 bp, synthetic construct
  misc_feature 1..20: note = CRISPR gRNA sequence
  source 1..20: mol_type = other DNA
agaatggaggcagagagtcc

SEQ ID NO: 14709 - DNA, 20 bp, synthetic construct
  misc_feature 1..20: note = CRISPR gRNA sequence
  source 1..20: mol_type = other DNA
gaatggaggcagagagtcca

SEQ ID NO: 14710 - DNA, 20 bp, synthetic construct
  misc_feature 1..20: note = CRISPR gRNA sequence
  source 1..20: mol_type = other DNA
aatggaggcagagagtccaa

SEQ ID NO: 14711 - DNA, 20 bp, synthetic construct
  misc_feature 1..20: note = CRISPR gRNA sequence
  source 1..20: mol_type = other DNA
atggaggcagagagtccaag

SEQ ID NO: 14712 - DNA, 20 bp, synthetic construct
  misc_feature 1..20: note = CRISPR gRNA sequence
  source 1..20: mol_type = other DNA
ggaggcagagagtccaaggg

SEQ ID NO: 14713 - DNA, 20 bp, synthetic construct
  misc_feature 1..20: note = CRISPR gRNA sequence
  source 1..20: mol_type = other DNA
gaggcagagagtccaagggg

SEQ ID NO: 14714 - DNA, 20 bp, synthetic construct
  misc_feature 1..20: note = CRISPR gRNA sequence
  source 1..20: mol_type = other DNA
gagagtccaaggggaggcca

SEQ ID NO: 14715 - DNA, 20 bp, synthetic construct
  misc_feature 1..20: note = CRISPR gRNA sequence
  source 1..20: mol_type = other DNA
ggaggccatggctttactct

SEQ ID NO: 14716 - DNA, 20 bp, synthetic construct
  misc_feature 1..20: note = CRISPR gRNA sequence
  source 1..20: mol_type = other DNA
catggctttactcttagcat

SEQ ID NO: 14717 - DNA, 20 bp, synthetic construct
  misc_feature 1..20: note = CRISPR gRNA sequence
  source 1..20: mol_type = other DNA
ttactcttagcataagaaaa

SEQ ID NO: 14718 - DNA, 20 bp, synthetic construct
  misc_feature 1..20: note = CRISPR gRNA sequence
  source 1..20: mol_type = other DNA
ctcttagcataagaaaacgg

SEQ ID NO: 14719 - DNA, 20 bp, synthetic construct
  misc_feature 1..20: note = CRISPR gRNA sequence
  source 1..20: mol_type = other DNA
taagaaaacggtggcgtgct

SEQ ID NO: 14720 - DNA, 20 bp, synthetic construct
  misc_feature 1..20: note = CRISPR gRNA sequence
  source 1..20: mol_type = other DNA
aagaaaacggtggcgtgctc

SEQ ID NO: 14721 - DNA, 20 bp, synthetic construct
  misc_feature 1..20: note = CRISPR gRNA sequence
  source 1..20: mol_type = other DNA
agaaaacggtggcgtgctca

SEQ ID NO: 14722 - DNA, 20 bp, synthetic construct
  misc_feature 1..20: note = CRISPR gRNA sequence
  source 1..20: mol_type = other DNA
gaaaacggtggcgtgctcag

SEQ ID NO: 14723 - DNA, 20 bp, synthetic construct
  misc_feature 1..20: note = CRISPR gRNA sequence
  source 1..20: mol_type = other DNA
aaaacggtggcgtgctcagg

SEQ ID NO: 14724 - DNA, 20 bp, synthetic construct
  misc_feature 1..20: note = CRISPR gRNA sequence
  source 1..20: mol_type = other DNA
acggtggcgtgctcaggggg

SEQ ID NO: 14725 - DNA, 20 bp, synthetic construct
  misc_feature 1..20: note = CRISPR gRNA sequence
  source 1..20: mol_type = other DNA
tggcgtgctcagggggtgga

SEQ ID NO: 14726 - DNA, 20 bp, synthetic construct
  misc_feature 1..20: note = CRISPR gRNA sequence
  source 1..20: mol_type = other DNA
ggaaagaataaaacaaattt

SEQ ID NO: 14727 - DNA, 20 bp, synthetic construct
  misc_feature 1..20: note = CRISPR gRNA sequence
  source 1..20: mol_type = other DNA
gaataaaacaaatttgagcc

SEQ ID NO: 14728 - DNA, 20 bp, synthetic construct
  misc_feature 1..20: note = CRISPR gRNA sequence
  source 1..20: mol_type = other DNA
aataaaacaaatttgagccc

SEQ ID NO: 14729 - DNA, 20 bp, synthetic construct
  misc_feature 1..20: note = CRISPR gRNA sequence
  source 1..20: mol_type = other DNA
aaacaaatttgagcccaggt

SEQ ID NO: 14730 - DNA, 20 bp, synthetic construct
  misc_feature 1..20: note = CRISPR gRNA sequence
  source 1..20: mol_type = other DNA
atttgagcccaggtcagtct

SEQ ID NO: 14731 - DNA, 20 bp, synthetic construct
  misc_feature 1..20: note = CRISPR gRNA sequence
  source 1..20: mol_type = other DNA
cccaggtcagtctcagattc

SEQ ID NO: 14732 - DNA, 20 bp, synthetic construct
  misc_feature 1..20: note = CRISPR gRNA sequence
  source 1..20: mol_type = other DNA
ctcagattctagacataccc

SEQ ID NO: 14733 - DNA, 20 bp, synthetic construct
  misc_feature 1..20: note = CRISPR gRNA sequence
  source 1..20: mol_type = other DNA
tctagacataccccagtgac

SEQ ID NO: 14734 - DNA, 20 bp, synthetic construct
  misc_feature 1..20: note = CRISPR gRNA sequence
  source 1..20: mol_type = other DNA
ataccccagtgactggcaca

SEQ ID NO: 14735 - DNA, 20 bp, synthetic construct
  misc_feature 1..20: note = CRISPR gRNA sequence
  source 1..20: mol_type = other DNA
ccccagtgactggcacatgg

SEQ ID NO: 14736 - DNA, 20 bp, synthetic construct
  misc_feature 1..20: note = CRISPR gRNA sequence
  source 1..20: mol_type = other DNA
cccagtgactggcacatggc

SEQ ID NO: 14737 - DNA, 20 bp, synthetic construct
  misc_feature 1..20: note = CRISPR gRNA sequence
  source 1..20: mol_type = other DNA
gcgggccttcaaatattgac

SEQ ID NO: 14738 - DNA, 20 bp, synthetic construct
  misc_feature 1..20: note = CRISPR gRNA sequence
  source 1..20: mol_type = other DNA
cgggccttcaaatattgact

SEQ ID NO: 14739 - DNA, 20 bp, synthetic construct
  misc_feature 1..20: note = CRISPR gRNA sequence
  source 1..20: mol_type = other DNA
ggccttcaaatattgactgg

SEQ ID NO: 14740 - DNA, 20 bp, synthetic construct
  misc_feature 1..20: note = CRISPR gRNA sequence
  source 1..20: mol_type = other DNA
attgcctctcacttgctgtg

SEQ ID NO: 14741 - DNA, 20 bp, synthetic construct
  misc_feature 1..20: note = CRISPR gRNA sequence
  source 1..20: mol_type = other DNA
cctctcacttgctgtgtggc

SEQ ID NO: 14742 - DNA, 20 bp, synthetic construct
  misc_feature 1..20: note = CRISPR gRNA sequence
  source 1..20: mol_type = other DNA
ctcacttgctgtgtggcaag

SEQ ID NO: 14743 - DNA, 20 bp, synthetic construct
  misc_feature 1..20: note = CRISPR gRNA sequence
  source 1..20: mol_type = other DNA
gcaagtggctgcccctctct

SEQ ID NO: 14744 - DNA, 20 bp, synthetic construct
  misc_feature 1..20: note = CRISPR gRNA sequence
  source 1..20: mol_type = other DNA
caacatcctcatcttaaaaa

SEQ ID NO: 14745 - DNA, 20 bp, synthetic construct
  misc_feature 1..20: note = CRISPR gRNA sequence
  source 1..20: mol_type = other DNA
acatcctcatcttaaaaatg

SEQ ID NO: 14746 - DNA, 20 bp, synthetic construct
  misc_feature 1..20: note = CRISPR gRNA sequence
  source 1..20: mol_type = other DNA
atcctcatcttaaaaatgga

SEQ ID NO: 14747 - DNA, 20 bp, synthetic construct
  misc_feature 1..20: note = CRISPR gRNA sequence
  source 1..20: mol_type = other DNA
agaatccattctgccccacc

SEQ ID NO: 14748 - DNA, 20 bp, synthetic construct
  misc_feature 1..20: note = CRISPR gRNA sequence
  source 1..20: mol_type = other DNA
ccggctgctctgcatactaa

SEQ ID NO: 14749 - DNA, 20 bp, synthetic construct
  misc_feature 1..20: note = CRISPR gRNA sequence
  source 1..20: mol_type = other DNA
ggctgctctgcatactaaaa

SEQ ID NO: 14750 - DNA, 20 bp, synthetic construct
  misc_feature 1..20: note = CRISPR gRNA sequence
  source 1..20: mol_type = other DNA
gcatactaaaagagacccca

SEQ ID NO: 14751 - DNA, 20 bp, synthetic construct
  misc_feature 1..20: note = CRISPR gRNA sequence
  source 1..20: mol_type = other DNA
atactaaaagagaccccaca

SEQ ID NO: 14752 - DNA, 20 bp, synthetic construct
  misc_feature 1..20: note = CRISPR gRNA sequence
  source 1..20: mol_type = other DNA
aaagagaccccacagagcac

SEQ ID NO: 14753 - DNA, 20 bp, synthetic construct
  misc_feature 1..20: note = CRISPR gRNA sequence
  source 1..20: mol_type = other DNA
aagagaccccacagagcact

SEQ ID NO: 14754 - DNA, 20 bp, synthetic construct
  misc_feature 1..20: note = CRISPR gRNA sequence
  source 1..20: mol_type = other DNA
accccacagagcactgggct

SEQ ID NO: 14755 - DNA, 20 bp, synthetic construct
  misc_feature 1..20: note = CRISPR gRNA sequence
  source 1..20: mol_type = other DNA
agagcactgggcttggcacc

SEQ ID NO: 14756 - DNA, 20 bp, synthetic construct
  misc_feature 1..20: note = CRISPR gRNA sequence
  source 1..20: mol_type = other DNA
tgggcttggcaccaagaccg

SEQ ID NO: 14757 - DNA, 20 bp, synthetic construct
  misc_feature 1..20: note = CRISPR gRNA sequence
  source 1..20: mol_type = other DNA
ccgcagttaatgcccaacac

SEQ ID NO: 14758 - DNA, 20 bp, synthetic construct
  misc_feature 1..20: note = CRISPR gRNA sequence
  source 1..20: mol_type = other DNA
cgcagttaatgcccaacaca

SEQ ID NO: 14759 - DNA, 20 bp, synthetic construct
  misc_feature 1..20: note = CRISPR gRNA sequence
  source 1..20: mol_type = other DNA
cacaaggatgtctcttcccc

SEQ ID NO: 14760 - DNA, 20 bp, synthetic construct
  misc_feature 1..20: note = CRISPR gRNA sequence
  source 1..20: mol_type = other DNA
gcccctcaccccacctgaaa

SEQ ID NO: 14761 - DNA, 20 bp, synthetic construct
  misc_feature 1..20: note = CRISPR gRNA sequence
  source 1..20: mol_type = other DNA
cccctcaccccacctgaaac

SEQ ID NO: 14762 - DNA, 20 bp, synthetic construct
  misc_feature 1..20: note = CRISPR gRNA sequence
  source 1..20: mol_type = other DNA
cccacctgaaacgggtgaca

SEQ ID NO: 14763 - DNA, 20 bp, synthetic construct
  misc_feature 1..20: note = CRISPR gRNA sequence
  source 1..20: mol_type = other DNA
ctgaaacgggtgacacagct

SEQ ID NO: 14764 - DNA, 20 bp, synthetic construct
  misc_feature 1..20: note = CRISPR gRNA sequence
  source 1..20: mol_type = other DNA
gtgacacagctgagtcccac

SEQ ID NO: 14765 - DNA, 20 bp, synthetic construct
  misc_feature 1..20: note = CRISPR gRNA sequence
  source 1..20: mol_type = other DNA
tgacacagctgagtcccacg

SEQ ID NO: 14766 - DNA, 20 bp, synthetic construct
  misc_feature 1..20: note = CRISPR gRNA sequence
  source 1..20: mol_type = other DNA
tcccacgaggctccccaatc

SEQ ID NO: 14767 - DNA, 20 bp, synthetic construct
  misc_feature 1..20: note = CRISPR gRNA sequence
  source 1..20: mol_type = other DNA
ccacgaggctccccaatcca

SEQ ID NO: 14768 - DNA, 20 bp, synthetic construct
  misc_feature 1..20: note = CRISPR gRNA sequence
  source 1..20: mol_type = other DNA
cacgaggctccccaatccag

SEQ ID NO: 14769 - DNA, 20 bp, synthetic construct
  misc_feature 1..20: note = CRISPR gRNA sequence
  source 1..20: mol_type = other DNA
acgaggctccccaatccaga

SEQ ID NO: 14770 - DNA, 20 bp, synthetic construct
  misc_feature 1..20: note = CRISPR gRNA sequence
  source 1..20: mol_type = other DNA
cgaggctccccaatccagag

SEQ ID NO: 14771 - DNA, 20 bp, synthetic construct
  misc_feature 1..20: note = CRISPR gRNA sequence
  source 1..20: mol_type = other DNA
caatccagaggggcaaatgc

SEQ ID NO: 14772 - DNA, 20 bp, synthetic construct
  misc_feature 1..20: note = CRISPR gRNA sequence
  source 1..20: mol_type = other DNA
aggggcaaatgccagtgctg

SEQ ID NO: 14773 - DNA, 20 bp, synthetic construct
  misc_feature 1..20: note = CRISPR gRNA sequence
  source 1..20: mol_type = other DNA
gggcaaatgccagtgctgcg

SEQ ID NO: 14774 - DNA, 20 bp, synthetic construct
  misc_feature 1..20: note = CRISPR gRNA sequence
  source 1..20: mol_type = other DNA
ggcaaatgccagtgctgcgg

SEQ ID NO: 14775 - DNA, 20 bp, synthetic construct
  misc_feature 1..20: note = CRISPR gRNA sequence
  source 1..20: mol_type = other DNA
atgccagtgctgcggaggtc

SEQ ID NO: 14776 - DNA, 20 bp, synthetic construct
  misc_feature 1..20: note = CRISPR gRNA sequence
  source 1..20: mol_type = other DNA
tgccagtgctgcggaggtcc

SEQ ID NO: 14777 - DNA, 20 bp, synthetic construct
  misc_feature 1..20: note = CRISPR gRNA sequence
  source 1..20: mol_type = other DNA
gccagtgctgcggaggtcca

SEQ ID NO: 14778 - DNA, 20 bp, synthetic construct
  misc_feature 1..20: note = CRISPR gRNA sequence
  source 1..20: mol_type = other DNA
cagtgctgcggaggtccagg

SEQ ID NO: 14779 - DNA, 20 bp, synthetic construct
  misc_feature 1..20: note = CRISPR gRNA sequence
  source 1..20: mol_type = other DNA
tgctgcggaggtccagggag

SEQ ID NO: 14780 - DNA, 20 bp, synthetic construct
  misc_feature 1..20: note = CRISPR gRNA sequence
  source 1..20: mol_type = other DNA
ggaggtccagggagaagtct

SEQ ID NO: 14781 - DNA, 20 bp, synthetic construct
  misc_feature 1..20: note = CRISPR gRNA sequence
  source 1..20: mol_type = other DNA
agtcttggcccgccgcctcc

SEQ ID NO: 14782 - DNA, 20 bp, synthetic construct
  misc_feature 1..20: note = CRISPR gRNA sequence
  source 1..20: mol_type = other DNA
gtcttggcccgccgcctcca

SEQ ID NO: 14783 - DNA, 20 bp, synthetic construct
  misc_feature 1..20: note = CRISPR gRNA sequence
  source 1..20: mol_type = other DNA
gccgcctccaaggccttgcc

SEQ ID NO: 14784 - DNA, 20 bp, synthetic construct
  misc_feature 1..20: note = CRISPR gRNA sequence
  source 1..20: mol_type = other DNA
cttgcccagtacatgtgcat

SEQ ID NO: 14785 - DNA, 20 bp, synthetic construct
  misc_feature 1..20: note = CRISPR gRNA sequence
  source 1..20: mol_type = other DNA
ttgcccagtacatgtgcatc

SEQ ID NO: 14786 - DNA, 20 bp, synthetic construct
  misc_feature 1..20: note = CRISPR gRNA sequence
  source 1..20: mol_type = other DNA
gcccagtacatgtgcatcag

SEQ ID NO: 14787 - DNA, 20 bp, synthetic construct
  misc_feature 1..20: note = CRISPR gRNA sequence
  source 1..20: mol_type = other DNA
cccagtacatgtgcatcagg

SEQ ID NO: 14788 - DNA, 20 bp, synthetic construct
  misc_feature 1..20: note = CRISPR gRNA sequence
  source 1..20: mol_type = other DNA
acatgtgcatcaggaggcgt

SEQ ID NO: 14789 - DNA, 20 bp, synthetic construct
  misc_feature 1..20: note = CRISPR gRNA sequence
  source 1..20: mol_type = other DNA
catgtgcatcaggaggcgtg

SEQ ID NO: 14790 - DNA, 20 bp, synthetic construct
  misc_feature 1..20: note = CRISPR gRNA sequence
  source 1..20: mol_type = other DNA
gtgcatcaggaggcgtgagg

SEQ ID NO: 14791 - DNA, 20 bp, synthetic construct
  misc_feature 1..20: note = CRISPR gRNA sequence
  source 1..20: mol_type = other DNA
tgcatcaggaggcgtgaggc

SEQ ID NO: 14792 - DNA, 20 bp, synthetic construct
  misc_feature 1..20: note = CRISPR gRNA sequence
  source 1..20: mol_type = other DNA
ggaggcgtgaggcgggtgcc

SEQ ID NO: 14793 - DNA, 20 bp, synthetic construct
  misc_feature 1..20: note = CRISPR gRNA sequence
  source 1..20: mol_type = other DNA
cgtgaggcgggtgcccagaa

SEQ ID NO: 14794 - DNA, 20 bp, synthetic construct
  misc_feature 1..20: note = CRISPR gRNA sequence
  source 1..20: mol_type = other DNA
tgaggcgggtgcccagaaaa

SEQ ID NO: 14795 - DNA, 20 bp, synthetic construct
  misc_feature 1..20: note = CRISPR gRNA sequence
  source 1..20: mol_type = other DNA
aggcgggtgcccagaaaaga

SEQ ID NO: 14796 - DNA, 20 bp, synthetic construct
  misc_feature 1..20: note = CRISPR gRNA sequence
  source 1..20: mol_type = other DNA
ggcgggtgcccagaaaagag

SEQ ID NO: 14797 - DNA, 20 bp, synthetic construct
  misc_feature 1..20: note = CRISPR gRNA sequence
  source 1..20: mol_type = other DNA
gggtgcccagaaaagagagg

SEQ ID NO: 14798 - DNA, 20 bp, synthetic construct
  misc_feature 1..20: note = CRISPR gRNA sequence
  source 1..20: mol_type = other DNA
gcccagaaaagagaggcggc

SEQ ID NO: 14799 - DNA, 20 bp, synthetic construct
  misc_feature 1..20: note = CRISPR gRNA sequence
  source 1..20: mol_type = other DNA
cccagaaaagagaggcggcc

SEQ ID NO: 14800 - DNA, 20 bp, synthetic construct
  misc_feature 1..20: note = CRISPR gRNA sequence
  source 1..20: mol_type = other DNA
ccagaaaagagaggcggccg

SEQ ID NO: 14801 - DNA, 20 bp, synthetic construct
  misc_feature 1..20: note = CRISPR gRNA sequence
  source 1..20: mol_type = other DNA
agaaaagagaggcggccggg

SEQ ID NO: 14802 - DNA, 20 bp, synthetic construct
  misc_feature 1..20: note = CRISPR gRNA sequence
  source 1..20: mol_type = other DNA
taccacgtgctgccaaattc

SEQ ID NO: 14803 - DNA, 20 bp, synthetic construct
  misc_feature 1..20: note = CRISPR gRNA sequence
  source 1..20: mol_type = other DNA
ctgccaaattccagcctcct

SEQ ID NO: 14804 - DNA, 20 bp, synthetic construct
  misc_feature 1..20: note = CRISPR gRNA sequence
  source 1..20: mol_type = other DNA
ttccagcctcctcggcctcg

SEQ ID NO: 14805 - DNA, 20 bp, synthetic construct
  misc_feature 1..20: note = CRISPR gRNA sequence
  source 1..20: mol_type = other DNA
tccagcctcctcggcctcgt

SEQ ID NO: 14806 - DNA, 20 bp, synthetic construct
  misc_feature 1..20: note = CRISPR gRNA sequence
  source 1..20: mol_type = other DNA
cctcctcggcctcgtgggcg

SEQ ID NO: 14807 - DNA, 20 bp, synthetic construct
  misc_feature 1..20: note = CRISPR gRNA sequence
  source 1..20: mol_type = other DNA
tcggcctcgtgggcgcagtg

SEQ ID NO: 14808 - DNA, 20 bp, synthetic construct
  misc_feature 1..20: note = CRISPR gRNA sequence
  source 1..20: mol_type = other DNA
gcctcgtgggcgcagtgcag

SEQ ID NO: 14809 - DNA, 20 bp, synthetic construct
  misc_feature 1..20: note = CRISPR gRNA sequence
  source 1..20: mol_type = other DNA
tgggcgcagtgcagcagctc

SEQ ID NO: 14810 - DNA, 20 bp, synthetic construct
  misc_feature 1..20: note = CRISPR gRNA sequence
  source 1..20: mol_type = other DNA
gcgcagtgcagcagctccag

SEQ ID NO: 14811 - DNA, 20 bp, synthetic construct
  misc_feature 1..20: note = CRISPR gRNA sequence
  source 1..20: mol_type = other DNA
tccagcagctgccgcgcccg

SEQ ID NO: 14812 - DNA, 20 bp, synthetic construct
  misc_feature 1..20: note = CRISPR gRNA sequence
  source 1..20: mol_type = other DNA
tgccgcgcccgcagtgtccc

SEQ ID NO: 14813 - DNA, 20 bp, synthetic construct
  misc_feature 1..20: note = CRISPR gRNA sequence
  source 1..20: mol_type = other DNA
gcccgcagtgtccccggctg

SEQ ID NO: 14814 - DNA, 20 bp, synthetic construct
  misc_feature 1..20: note = CRISPR gRNA sequence
  source 1..20: mol_type = other DNA
gtccccggctgcagccgctt

SEQ ID NO: 14815 - DNA, 20 bp, synthetic construct
  misc_feature 1..20: note = CRISPR gRNA sequence
  source 1..20: mol_type = other DNA
tccccggctgcagccgcttc

SEQ ID NO: 14816 - DNA, 20 bp, synthetic construct
  misc_feature 1..20: note = CRISPR gRNA sequence
  source 1..20: mol_type = other DNA
agccgcttcaggtacctcgc

SEQ ID NO: 14817 - DNA, 20 bp, synthetic construct
  misc_feature 1..20: note = CRISPR gRNA sequence
  source 1..20: mol_type = other DNA
ccttctgcttcctgtccacc

SEQ ID NO: 14818 - DNA, 20 bp, synthetic construct
  misc_feature 1..20: note = CRISPR gRNA sequence
  source 1..20: mol_type = other DNA
cttctgcttcctgtccaccg

SEQ ID NO: 14819 - DNA, 20 bp, synthetic construct
  misc_feature 1..20: note = CRISPR gRNA sequence
  source 1..20: mol_type = other DNA
ctgcttcctgtccaccgagg

SEQ ID NO: 14820 - DNA, 20 bp, synthetic construct
  misc_feature 1..20: note = CRISPR gRNA sequence
  source 1..20: mol_type = other DNA
tccaccgaggcagccgccga

SEQ ID NO: 14821 - DNA, 20 bp, synthetic construct
  misc_feature 1..20: note = CRISPR gRNA sequence
  source 1..20: mol_type = other DNA
gaggcagccgccgatggccc

SEQ ID NO: 14822 - DNA, 20 bp, synthetic construct
  misc_feature 1..20: note = CRISPR gRNA sequence
  source 1..20: mol_type = other DNA
gcagccgccgatggcccgag

SEQ ID NO: 14823 - DNA, 20 bp, synthetic construct
  misc_feature 1..20: note = CRISPR gRNA sequence
  source 1..20: mol_type = other DNA
cagccgccgatggcccgagt

SEQ ID NO: 14824 - DNA, 20 bp, synthetic construct
  misc_feature 1..20: note = CRISPR gRNA sequence
  source 1..20: mol_type = other DNA
agccgccgatggcccgagta

SEQ ID NO: 14825 - DNA, 20 bp, synthetic construct
  misc_feature 1..20: note = CRISPR gRNA sequence
  source 1..20: mol_type = other DNA
gatggcccgagtagggctcc

SEQ ID NO: 14826 - DNA, 20 bp, synthetic construct
  misc_feature 1..20: note = CRISPR gRNA sequence
  source 1..20: mol_type = other DNA
atggcccgagtagggctccc

SEQ ID NO: 14827 - DNA, 20 bp, synthetic construct
  misc_feature 1..20: note = CRISPR gRNA sequence
  source 1..20: mol_type = other DNA
gcccgagtagggctcccagg

SEQ ID NO: 14828 - DNA, 20 bp, synthetic construct
  misc_feature 1..20: note = CRISPR gRNA sequence
  source 1..20: mol_type = other DNA
cgagtagggctcccaggcag

SEQ ID NO: 14829 - DNA, 20 bp, synthetic construct
  misc_feature 1..20: note = CRISPR gRNA sequence
  source 1..20: mol_type = other DNA
gagtagggctcccaggcagc

SEQ ID NO: 14830 - DNA, 20 bp, synthetic construct
  misc_feature 1..20: note = CRISPR gRNA sequence
  source 1..20: mol_type = other DNA
tagggctcccaggcagcggg

SEQ ID NO: 14831 - DNA, 20 bp, synthetic construct
  misc_feature 1..20: note = CRISPR gRNA sequence
  source 1..20: mol_type = other DNA
agggctcccaggcagcgggc

SEQ ID NO: 14832 - DNA, 20 bp, synthetic construct
  misc_feature 1..20: note = CRISPR gRNA sequence
  source 1..20: mol_type = other DNA
ggctcccaggcagcgggcgg

SEQ ID NO: 14833 - DNA, 20 bp, synthetic construct
  misc_feature 1..20: note = CRISPR gRNA sequence
  source 1..20: mol_type = other DNA
gctcccaggcagcgggcggg

SEQ ID NO: 14834 - DNA, 20 bp, synthetic construct
  misc_feature 1..20: note = CRISPR gRNA sequence
  source 1..20: mol_type = other DNA
ccaggcagcgggcgggaggc

SEQ ID NO: 14835 - DNA, 20 bp, synthetic construct
  misc_feature 1..20: note = CRISPR gRNA sequence
  source 1..20: mol_type = other DNA
ggcagcgggcgggaggctgg

SEQ ID NO: 14836 - DNA, 20 bp, synthetic construct
  misc_feature 1..20: note = CRISPR gRNA sequence
  source 1..20: mol_type = other DNA
cgggcgggaggctggaagat

SEQ ID NO: 14837 - DNA, 20 bp, synthetic construct
  misc_feature 1..20: note = CRISPR gRNA sequence
  source 1..20: mol_type = other DNA
gggaggctggaagatcagcc

SEQ ID NO: 14838 - DNA, 20 bp, synthetic construct
  misc_feature 1..20: note = CRISPR gRNA sequence
  source 1..20: mol_type = other DNA
ggctggaagatcagcccagc

SEQ ID NO: 14839 - DNA, 20 bp, synthetic construct
  misc_feature 1..20: note = CRISPR gRNA sequence
  source 1..20: mol_type = other DNA
ggaagatcagcccagccaga

SEQ ID NO: 14840 - DNA, 20 bp, synthetic construct
  misc_feature 1..20: note = CRISPR gRNA sequence
  source 1..20: mol_type = other DNA
atcagcccagccagaaagcg

SEQ ID NO: 14841 - DNA, 20 bp, synthetic construct
  misc_feature 1..20: note = CRISPR gRNA sequence
  source 1..20: mol_type = other DNA
agaaagcgtggcacgccctc

SEQ ID NO: 14842 - DNA, 20 bp, synthetic construct
  misc_feature 1..20: note = CRISPR gRNA sequence
  source 1..20: mol_type = other DNA
agcgtggcacgccctccagc

SEQ ID NO: 14843 - DNA, 20 bp, synthetic construct
  misc_feature 1..20: note = CRISPR gRNA sequence
  source 1..20: mol_type = other DNA
cgccctccagccagttgtca

SEQ ID NO: 14844 - DNA, 20 bp, synthetic construct
  misc_feature 1..20: note = CRISPR gRNA sequence
  source 1..20: mol_type = other DNA
gccctccagccagttgtcat

SEQ ID NO: 14845 - DNA, 20 bp, synthetic construct
  misc_feature 1..20: note = CRISPR gRNA sequence
  source 1..20: mol_type = other DNA
ccctccagccagttgtcata

SEQ ID NO: 14846 - DNA, 20 bp, synthetic construct
  misc_feature 1..20: note = CRISPR gRNA sequence
  source 1..20: mol_type = other DNA
tcatagggcctcttcttcct

SEQ ID NO: 14847 - DNA, 20 bp, synthetic construct
  misc_feature 1..20: note = CRISPR gRNA sequence
  source 1..20: mol_type = other DNA
catagggcctcttcttcctt

SEQ ID NO: 14848 - DNA, 20 bp, synthetic construct
  misc_feature 1..20: note = CRISPR gRNA sequence
  source 1..20: mol_type = other DNA
atagggcctcttcttccttg

SEQ ID NO: 14849 - DNA, 20 bp, synthetic construct
  misc_feature 1..20: note = CRISPR gRNA sequence
  source 1..20: mol_type = other DNA
ttcttccttggggtcaatgc

SEQ ID NO: 14850 - DNA, 20 bp, synthetic construct
  misc_feature 1..20: note = CRISPR gRNA sequence
  source 1..20: mol_type = other DNA
tcttccttggggtcaatgct

SEQ ID NO: 14851 - DNA, 20 bp, synthetic construct
  misc_feature 1..20: note = CRISPR gRNA sequence
  source 1..20: mol_type = other DNA
ggggtcaatgctaggtactg

SEQ ID NO: 14852 - DNA, 20 bp, synthetic construct
  misc_feature 1..20: note = CRISPR gRNA sequence
  source 1..20: mol_type = other DNA
gggtcaatgctaggtactgc

SEQ ID NO: 14853 - DNA, 20 bp, synthetic construct
  misc_feature 1..20: note = CRISPR gRNA sequence
  source 1..20: mol_type = other DNA
gtcaatgctaggtactgcgg

SEQ ID NO: 14854 - DNA, 20 bp, synthetic construct
  misc_feature 1..20: note = CRISPR gRNA sequence
  source 1..20: mol_type = other DNA
ttgtccttgatttcgccact

SEQ ID NO: 14855 - DNA, 20 bp, synthetic construct
  misc_feature 1..20: note = CRISPR gRNA sequence
  source 1..20: mol_type = other DNA
gtccttgatttcgccactca

SEQ ID NO: 14856 - DNA, 20 bp, synthetic construct
  misc_feature 1..20: note = CRISPR gRNA sequence
  source 1..20: mol_type = other DNA
ttgatttcgccactcagagc

SEQ ID NO: 14857 - DNA, 20 bp, synthetic construct
  misc_feature 1..20: note = CRISPR gRNA sequence
  source 1..20: mol_type = other DNA
tcgccactcagagccagcca

SEQ ID NO: 14858 - DNA, 20 bp, synthetic construct
  misc_feature 1..20: note = CRISPR gRNA sequence
  source 1..20: mol_type = other DNA
cgccactcagagccagccac

SEQ ID NO: 14859 - DNA, 20 bp, synthetic construct
  misc_feature 1..20: note = CRISPR gRNA sequence
  source 1..20: mol_type = other DNA
gccactcagagccagccaca

SEQ ID NO: 14860 - DNA, 20 bp, synthetic construct
  misc_feature 1..20: note = CRISPR gRNA sequence
  source 1..20: mol_type = other DNA
agagccagccacagggcccc

SEQ ID NO: 14861 - DNA, 20 bp, synthetic construct
  misc_feature 1..20: note = CRISPR gRNA sequence
  source 1..20: mol_type = other DNA
gagccagccacagggccccc

SEQ ID NO: 14862 - DNA, 20 bp, synthetic construct
  misc_feature 1..20: note = CRISPR gRNA sequence
  source 1..20: mol_type = other DNA
ccagccacagggcccccagg

SEQ ID NO: 14863 - DNA, 20 bp, synthetic construct
  misc_feature 1..20: note = CRISPR gRNA sequence
  source 1..20: mol_type = other DNA
agggcccccaggaagcattg

SEQ ID NO: 14864 - DNA, 20 bp, synthetic construct
  misc_feature 1..20: note = CRISPR gRNA sequence
  source 1..20: mol_type = other DNA
gggcccccaggaagcattgc

SEQ ID NO: 14865 - DNA, 20 bp, synthetic construct
  misc_feature 1..20: note = CRISPR gRNA sequence
  source 1..20: mol_type = other DNA
gcccccaggaagcattgcag

SEQ ID NO: 14866 - DNA, 20 bp, synthetic construct
  misc_feature 1..20: note = CRISPR gRNA sequence
  source 1..20: mol_type = other DNA
cccccaggaagcattgcagg

SEQ ID NO: 14867 - DNA, 20 bp, synthetic construct
  misc_feature 1..20: note = CRISPR gRNA sequence
  source 1..20: mol_type = other DNA
ccaggaagcattgcaggagg

SEQ ID NO: 14868 - DNA, 20 bp, synthetic construct
  misc_feature 1..20: note = CRISPR gRNA sequence
  source 1..20: mol_type = other DNA
gaagcattgcaggaggaagc

SEQ ID NO: 14869 - DNA, 20 bp, synthetic construct
  misc_feature 1..20: note = CRISPR gRNA sequence
  source 1..20: mol_type = other DNA
aagcattgcaggaggaagct

SEQ ID NO: 14870 - DNA, 20 bp, synthetic construct
  misc_feature 1..20: note = CRISPR gRNA sequence
  source 1..20: mol_type = other DNA
agcattgcaggaggaagctg

SEQ ID NO: 14871 - DNA, 20 bp, synthetic construct
  misc_feature 1..20: note = CRISPR gRNA sequence
  source 1..20: mol_type = other DNA
attgcaggaggaagctgggg

SEQ ID NO: 14872 - DNA, 20 bp, synthetic construct
  misc_feature 1..20: note = CRISPR gRNA sequence
  source 1..20: mol_type = other DNA
ttgcaggaggaagctgggga

SEQ ID NO: 14873 - DNA, 20 bp, synthetic construct
  misc_feature 1..20: note = CRISPR gRNA sequence
  source 1..20: mol_type = other DNA
aggaggaagctggggaaggc

SEQ ID NO: 14874 - DNA, 20 bp, synthetic construct
  misc_feature 1..20: note = CRISPR gRNA sequence
  source 1..20: mol_type = other DNA
gaagctggggaaggccagct

SEQ ID NO: 14875 - DNA, 20 bp, synthetic construct
  misc_feature 1..20: note = CRISPR gRNA sequence
  source 1..20: mol_type = other DNA
gaaggccagctcggactctg

SEQ ID NO: 14876 - DNA, 20 bp, synthetic construct
  misc_feature 1..20: note = CRISPR gRNA sequence
  source 1..20: mol_type = other DNA
agctcggactctgcggcccg

SEQ ID NO: 14877 - DNA, 20 bp, synthetic construct
  misc_feature 1..20: note = CRISPR gRNA sequence
  source 1..20: mol_type = other DNA
tcggactctgcggcccgcgg

SEQ ID NO: 14878 - DNA, 20 bp, synthetic construct
  misc_feature 1..20: note = CRISPR gRNA sequence
  source 1..20: mol_type = other DNA
cggactctgcggcccgcggt

SEQ ID NO: 14879 - DNA, 20 bp, synthetic construct
  misc_feature 1..20: note = CRISPR gRNA sequence
  source 1..20: mol_type = other DNA
ctgcggcccgcggtgggtgt

SEQ ID NO: 14880 - DNA, 20 bp, synthetic construct
  misc_feature 1..20: note = CRISPR gRNA sequence
  source 1..20: mol_type = other DNA
cccgcggtgggtgttggact

SEQ ID NO: 14881 - DNA, 20 bp, synthetic construct
  misc_feature 1..20: note = CRISPR gRNA sequence
  source 1..20: mol_type = other DNA
tgggtgttggactaagcctt

SEQ ID NO: 14882 - DNA, 20 bp, synthetic construct
  misc_feature 1..20: note = CRISPR gRNA sequence
  source 1..20: mol_type = other DNA
ctaagcctttggccatcgcc

SEQ ID NO: 14883 - DNA, 20 bp, synthetic construct
  misc_feature 1..20: note = CRISPR gRNA sequence
  source 1..20: mol_type = other DNA
taagcctttggccatcgccc

SEQ ID NO: 14884 - DNA, 20 bp, synthetic construct
  misc_feature 1..20: note = CRISPR gRNA sequence
  source 1..20: mol_type = other DNA
cgcccaggtcctcacgtctg

SEQ ID NO: 14885 - DNA, 20 bp, synthetic construct
  misc_feature 1..20: note = CRISPR gRNA sequence
  source 1..20: mol_type = other DNA
caggtcctcacgtctgcgga

SEQ ID NO: 14886 - DNA, 20 bp, synthetic construct
  misc_feature 1..20: note = CRISPR gRNA sequence
  source 1..20: mol_type = other DNA
aggtcctcacgtctgcggat

SEQ ID NO: 14887 - DNA, 20 bp, synthetic construct
  misc_feature 1..20: note = CRISPR gRNA sequence
  source 1..20: mol_type = other DNA
tcacgtctgcggatgggaac

SEQ ID NO: 14888 - DNA, 20 bp, synthetic construct
  misc_feature 1..20: note = CRISPR gRNA sequence
  source 1..20: mol_type = other DNA
gatgggaactggtcctcctg

SEQ ID NO: 14889 - DNA, 20 bp, synthetic construct
  misc_feature 1..20: note = CRISPR gRNA sequence
  source 1..20: mol_type = other DNA
atgggaactggtcctcctgt

SEQ ID NO: 14890 - DNA, 20 bp, synthetic construct
  misc_feature 1..20: note = CRISPR gRNA sequence
  source 1..20: mol_type = other DNA
tgggaactggtcctcctgta

SEQ ID NO: 14891 - DNA, 20 bp, synthetic construct
  misc_feature 1..20: note = CRISPR gRNA sequence
  source 1..20: mol_type = other DNA
gtagggtactttgatgtctg

SEQ ID NO: 14892 - DNA, 20 bp, synthetic construct
  misc_feature 1..20: note = CRISPR gRNA sequence
  source 1..20: mol_type = other DNA
gtactttgatgtctgcggcc

SEQ ID NO: 14893 - DNA, 20 bp, synthetic construct
  misc_feature 1..20: note = CRISPR gRNA sequence
  source 1..20: mol_type = other DNA
gatgtctgcggcccagctcc

SEQ ID NO: 14894 - DNA, 20 bp, synthetic construct
  misc_feature 1..20: note = CRISPR gRNA sequence
  source 1..20: mol_type = other DNA
atgtctgcggcccagctccc

SEQ ID NO: 14895 - DNA, 20 bp, synthetic construct
  misc_feature 1..20: note = CRISPR gRNA sequence
  source 1..20: mol_type = other DNA
ctgcggcccagctcccaggc

SEQ ID NO: 14896 - DNA, 20 bp, synthetic construct
  misc_feature 1..20: note = CRISPR gRNA sequence
  source 1..20: mol_type = other DNA
gcccagctcccaggccagct

SEQ ID NO: 14897 - DNA, 20 bp, synthetic construct
  misc_feature 1..20: note = CRISPR gRNA sequence
  source 1..20: mol_type = other DNA
agctcccaggccagcttggc

SEQ ID NO: 14898 - DNA, 20 bp, synthetic construct
  misc_feature 1..20: note = CRISPR gRNA sequence
  source 1..20: mol_type = other DNA
gccagcttggccagctctgc

SEQ ID NO: 14899 - DNA, 20 bp, synthetic construct
  misc_feature 1..20: note = CRISPR gRNA sequence
  source 1..20: mol_type = other DNA
ccagcttggccagctctgcc

SEQ ID NO: 14900 - DNA, 20 bp, synthetic construct
  misc_feature 1..20: note = CRISPR gRNA sequence
  source 1..20: mol_type = other DNA
cagcttggccagctctgcca

SEQ ID NO: 14901 - DNA, 20 bp, synthetic construct
  misc_feature 1..20: note = CRISPR gRNA sequence
  source 1..20: mol_type = other DNA
ggccagctctgccagggccc

SEQ ID NO: 14902 - DNA, 20 bp, synthetic construct
  misc_feature 1..20: note = CRISPR gRNA sequence
  source 1..20: mol_type = other DNA
gccagctctgccagggcccc

SEQ ID NO: 14903 - DNA, 20 bp, synthetic construct
  misc_feature 1..20: note = CRISPR gRNA sequence
  source 1..20: mol_type = other DNA
ccagctctgccagggccccg

SEQ ID NO: 14904 - DNA, 20 bp, synthetic construct
  misc_feature 1..20: note = CRISPR gRNA sequence
  source 1..20: mol_type = other DNA
cagctctgccagggccccgg

SEQ ID NO: 14905 - DNA, 20 bp, synthetic construct
  misc_feature 1..20: note = CRISPR gRNA sequence
  source 1..20: mol_type = other DNA
agctctgccagggccccggg

SEQ ID NO: 14906 - DNA, 20 bp, synthetic construct
  misc_feature 1..20: note = CRISPR gRNA sequence
  source 1..20: mol_type = other DNA
gctctgccagggccccgggg

SEQ ID NO: 14907 - DNA, 20 bp, synthetic construct
  misc_feature 1..20: note = CRISPR gRNA sequence
  source 1..20: mol_type = other DNA
agggccccgggggggctgtc

SEQ ID NO: 14908 - DNA, 20 bp, synthetic construct
  misc_feature 1..20: note = CRISPR gRNA sequence
  source 1..20: mol_type = other DNA
gggccccgggggggctgtcg

SEQ ID NO: 14909 - DNA, 20 bp, synthetic construct
  misc_feature 1..20: note = CRISPR gRNA sequence
  source 1..20: mol_type = other DNA
ggccccgggggggctgtcga

SEQ ID NO: 14910 - DNA, 20 bp, synthetic construct
  misc_feature 1..20: note = CRISPR gRNA sequence
  source 1..20: mol_type = other DNA
gggggctgtcgagggctgca

SEQ ID NO: 14911 - DNA, 20 bp, synthetic construct
  misc_feature 1..20: note = CRISPR gRNA sequence
  source 1..20: mol_type = other DNA
ctgtcgagggctgcacggcc

SEQ ID NO: 14912 - DNA, 20 bp, synthetic construct
  misc_feature 1..20: note = CRISPR gRNA sequence
  source 1..20: mol_type = other DNA
tcgagggctgcacggcccag

SEQ ID NO: 14913 - DNA, 20 bp, synthetic construct
  misc_feature 1..20: note = CRISPR gRNA sequence
  source 1..20: mol_type = other DNA
cgagggctgcacggcccagc

SEQ ID NO: 14914 - DNA, 20 bp, synthetic construct
  misc_feature 1..20: note = CRISPR gRNA sequence
  source 1..20: mol_type = other DNA
cacggcccagcaggccgaca

SEQ ID NO: 14915 - DNA, 20 bp, synthetic construct
  misc_feature 1..20: note = CRISPR gRNA sequence
  source 1..20: mol_type = other DNA
cggcccagcaggccgacata

SEQ ID NO: 14916 - DNA, 20 bp, synthetic construct
  misc_feature 1..20: note = CRISPR gRNA sequence
  source 1..20: mol_type = other DNA
aggccgacatagagtcccgt

SEQ ID NO: 14917 - DNA, 20 bp, synthetic construct
  misc_feature 1..20: note = CRISPR gRNA sequence
  source 1..20: mol_type = other DNA
gacatagagtcccgtgagcg

SEQ ID NO: 14918 - DNA, 20 bp, synthetic construct
  misc_feature 1..20: note = CRISPR gRNA sequence
  source 1..20: mol_type = other DNA
catagagtcccgtgagcgtg

SEQ ID NO: 14919 - DNA, 20 bp, synthetic construct
  misc_feature 1..20: note = CRISPR gRNA sequence
  source 1..20: mol_type = other DNA
atagagtcccgtgagcgtgg

SEQ ID NO: 14920 - DNA, 20 bp, synthetic construct
  misc_feature 1..20: note = CRISPR gRNA sequence
  source 1..20: mol_type = other DNA
tagagtcccgtgagcgtgga

SEQ ID NO: 14921 - DNA, 20 bp, synthetic construct
  misc_feature 1..20: note = CRISPR gRNA sequence
  source 1..20: mol_type = other DNA
agtcccgtgagcgtggaggg

SEQ ID NO: 14922 - DNA, 20 bp, synthetic construct
  misc_feature 1..20: note = CRISPR gRNA sequence
  source 1..20: mol_type = other DNA
cgtgagcgtggagggcagct

SEQ ID NO: 14923 - DNA, 20 bp, synthetic construct
  misc_feature 1..20: note = CRISPR gRNA sequence
  source 1..20: mol_type = other DNA
ggcagcttggcgtcctcccc

SEQ ID NO: 14924 - DNA, 20 bp, synthetic construct
  misc_feature 1..20: note = CRISPR gRNA sequence
  source 1..20: mol_type = other DNA
ttggcgtcctccccaagctc

SEQ ID NO: 14925 - DNA, 20 bp, synthetic construct
  misc_feature 1..20: note = CRISPR gRNA sequence
  source 1..20: mol_type = other DNA
gcgtcctccccaagctccag

SEQ ID NO: 14926 - DNA, 20 bp, synthetic construct
  misc_feature 1..20: note = CRISPR gRNA sequence
  source 1..20: mol_type = other DNA
cgtcctccccaagctccagc

SEQ ID NO: 14927 - DNA, 20 bp, synthetic construct
  misc_feature 1..20: note = CRISPR gRNA sequence
  source 1..20: mol_type = other DNA
gtcctccccaagctccagca

SEQ ID NO: 14928 - DNA, 20 bp, synthetic construct
  misc_feature 1..20: note = CRISPR gRNA sequence
  source 1..20: mol_type = other DNA
caagctccagcagggcctct

SEQ ID NO: 14929 - DNA, 20 bp, synthetic construct
  misc_feature 1..20: note = CRISPR gRNA sequence
  source 1..20: mol_type = other DNA
agctccagcagggcctctga

SEQ ID NO: 14930 - DNA, 20 bp, synthetic construct
  misc_feature 1..20: note = CRISPR gRNA sequence
  source 1..20: mol_type = other DNA
ccagcagggcctctgagagc

SEQ ID NO: 14931 - DNA, 20 bp, synthetic construct
  misc_feature 1..20: note = CRISPR gRNA sequence
  source 1..20: mol_type = other DNA
ctgagagctggcacactgcc

SEQ ID NO: 14932 - DNA, 20 bp, synthetic construct
  misc_feature 1..20: note = CRISPR gRNA sequence
  source 1..20: mol_type = other DNA
ctggcacactgcccggcaca

SEQ ID NO: 14933 - DNA, 20 bp, synthetic construct
  misc_feature 1..20: note = CRISPR gRNA sequence
  source 1..20: mol_type = other DNA
gcacactgcccggcacaaag

SEQ ID NO: 14934 - DNA, 20 bp, synthetic construct
  misc_feature 1..20: note = CRISPR gRNA sequence
  source 1..20: mol_type = other DNA
cacactgcccggcacaaagt

SEQ ID NO: 14935 - DNA, 20 bp, synthetic construct
  misc_feature 1..20: note = CRISPR gRNA sequence
  source 1..20: mol_type = other DNA
acactgcccggcacaaagta

SEQ ID NO: 14936 - DNA, 20 bp, synthetic construct
  misc_feature 1..20: note = CRISPR gRNA sequence
  source 1..20: mol_type = other DNA
cccggcacaaagtagggctg

SEQ ID NO: 14937 - DNA, 20 bp, synthetic construct
  misc_feature 1..20: note = CRISPR gRNA sequence
  source 1..20: mol_type = other DNA
gtagggctgtggctgtgact

SEQ ID NO: 14938 - DNA, 20 bp, synthetic construct
  misc_feature 1..20: note = CRISPR gRNA sequence
  source 1..20: mol_type = other DNA
gggctgtggctgtgactgag

SEQ ID NO: 14939 - DNA, 20 bp, synthetic construct
  misc_feature 1..20: note = CRISPR gRNA sequence
  source 1..20: mol_type = other DNA
ctgtggctgtgactgagaag

SEQ ID NO: 14940 - DNA, 20 bp, synthetic construct
  misc_feature 1..20: note = CRISPR gRNA sequence
  source 1..20: mol_type = other DNA
tggctgtgactgagaagaag

SEQ ID NO: 14941 - DNA, 20 bp, synthetic construct
  misc_feature 1..20: note = CRISPR gRNA sequence
  source 1..20: mol_type = other DNA
tgtgactgagaagaagtggc

SEQ ID NO: 14942 - DNA, 20 bp, synthetic construct
  misc_feature 1..20: note = CRISPR gRNA sequence
  source 1..20: mol_type = other DNA
tgagaagaagtggccggtcc

SEQ ID NO: 14943 - DNA, 20 bp, synthetic construct
  misc_feature 1..20: note = CRISPR gRNA sequence
  source 1..20: mol_type = other DNA
agaagaagtggccggtcccg

SEQ ID NO: 14944 - DNA, 20 bp, synthetic construct
  misc_feature 1..20: note = CRISPR gRNA sequence
  source 1..20: mol_type = other DNA
gaagaagtggccggtcccgg

SEQ ID NO: 14945 - DNA, 20 bp, synthetic construct
  misc_feature 1..20: note = CRISPR gRNA sequence
  source 1..20: mol_type = other DNA
agaagtggccggtcccggag

SEQ ID NO: 14946 - DNA, 20 bp, synthetic construct
  misc_feature 1..20: note = CRISPR gRNA sequence
  source 1..20: mol_type = other DNA
ggccggtcccggaggagcgt

SEQ ID NO: 14947 - DNA, 20 bp, synthetic construct
  misc_feature 1..20: note = CRISPR gRNA sequence
  source 1..20: mol_type = other DNA
gccggtcccggaggagcgtc

SEQ ID NO: 14948 - DNA, 20 bp, synthetic construct
  misc_feature 1..20: note = CRISPR gRNA sequence
  source 1..20: mol_type = other DNA
ccggtcccggaggagcgtca

SEQ ID NO: 14949 - DNA, 20 bp, synthetic construct
  misc_feature 1..20: note = CRISPR gRNA sequence
  source 1..20: mol_type = other DNA
ggagcgtcagggctctgtct

SEQ ID NO: 14950 - DNA, 20 bp, synthetic construct
  misc_feature 1..20: note = CRISPR gRNA sequence
  source 1..20: mol_type = other DNA
cttggtgctctgtcatccct

SEQ ID NO: 14951 - DNA, 20 bp, synthetic construct
  misc_feature 1..20: note = CRISPR gRNA sequence
  source 1..20: mol_type = other DNA
ctgtcatccctgagctctca

SEQ ID NO: 14952 - DNA, 20 bp, synthetic construct
  misc_feature 1..20: note = CRISPR gRNA sequence
  source 1..20: mol_type = other DNA
tcatccctgagctctcaaag

SEQ ID NO: 14953 - DNA, 20 bp, synthetic construct
  misc_feature 1..20: note = CRISPR gRNA sequence
  source 1..20: mol_type = other DNA
agtagcgcatcacgtatgcc

SEQ ID NO: 14954 - DNA, 20 bp, synthetic construct
  misc_feature 1..20: note = CRISPR gRNA sequence
  source 1..20: mol_type = other DNA
gtagcgcatcacgtatgcct

SEQ ID NO: 14955 - DNA, 20 bp, synthetic construct
  misc_feature 1..20: note = CRISPR gRNA sequence
  source 1..20: mol_type = other DNA
gtatgcctgggcctgctcca

SEQ ID NO: 14956 - DNA, 20 bp, synthetic construct
  misc_feature 1..20: note = CRISPR gRNA sequence
  source 1..20: mol_type = other DNA
atgcctgggcctgctccatg

SEQ ID NO: 14957 - DNA, 20 bp, synthetic construct
  misc_feature 1..20: note = CRISPR gRNA sequence
  source 1..20: mol_type = other DNA
cctgggcctgctccatggag

SEQ ID NO: 14958 - DNA, 20 bp, synthetic construct
  misc_feature 1..20: note = CRISPR gRNA sequence
  source 1..20: mol_type = other DNA
ggcctgctccatggagaagc

SEQ ID NO: 14959 - DNA, 20 bp, synthetic construct
  misc_feature 1..20: note = CRISPR gRNA sequence
  source 1..20: mol_type = other DNA
tgctccatggagaagccgga

SEQ ID NO: 14960 - DNA, 20 bp, synthetic construct
  misc_feature 1..20: note = CRISPR gRNA sequence
  source 1..20: mol_type = other DNA
gagaagccggacagctcaaa

SEQ ID NO: 14961 - DNA, 20 bp, synthetic construct
  misc_feature 1..20: note = CRISPR gRNA sequence
  source 1..20: mol_type = other DNA
agaagccggacagctcaaat

SEQ ID NO: 14962 - DNA, 20 bp, synthetic construct
  misc_feature 1..20: note = CRISPR gRNA sequence
  source 1..20: mol_type = other DNA
gaagccggacagctcaaata

SEQ ID NO: 14963 - DNA, 20 bp, synthetic construct
  misc_feature 1..20: note = CRISPR gRNA sequence
  source 1..20: mol_type = other DNA
ggacagctcaaatagggcgt

SEQ ID NO: 14964 - DNA, 20 bp, synthetic construct
  misc_feature 1..20: note = CRISPR gRNA sequence
  source 1..20: mol_type = other DNA
aatagggcgtcggccttgct

SEQ ID NO: 14965 - DNA, 20 bp, synthetic construct
  misc_feature 1..20: note = CRISPR gRNA sequence
  source 1..20: mol_type = other DNA
atagggcgtcggccttgctc

SEQ ID NO: 14966 - DNA, 20 bp, synthetic construct
  misc_feature 1..20: note = CRISPR gRNA sequence
  source 1..20: mol_type = other DNA
cgtcggccttgctcaggctc

SEQ ID NO: 14967 - DNA, 20 bp, synthetic construct
  misc_feature 1..20: note = CRISPR gRNA sequence
  source 1..20: mol_type = other DNA
gccttgctcaggctctggac

SEQ ID NO: 14968 - DNA, 20 bp, synthetic construct
  misc_feature 1..20: note = CRISPR gRNA sequence
  source 1..20: mol_type = other DNA
ccttgctcaggctctggacc

SEQ ID NO: 14969 - DNA, 20 bp, synthetic construct
  misc_feature 1..20: note = CRISPR gRNA sequence
  source 1..20: mol_type = other DNA
tgctcaggctctggaccagg

SEQ ID NO: 14970 - DNA, 20 bp, synthetic construct
  misc_feature 1..20: note = CRISPR gRNA sequence
  source 1..20: mol_type = other DNA
ggctctggaccaggcggccc

SEQ ID NO: 14971 - DNA, 20 bp, synthetic construct
  misc_feature 1..20: note = CRISPR gRNA sequence
  source 1..20: mol_type = other DNA
gctctggaccaggcggcccc

SEQ ID NO: 14972 - DNA, 20 bp, synthetic construct
  misc_feature 1..20: note = CRISPR gRNA sequence
  source 1..20: mol_type = other DNA
ctctggaccaggcggccccg

SEQ ID NO: 14973 - DNA, 20 bp, synthetic construct
  misc_feature 1..20: note = CRISPR gRNA sequence
  source 1..20: mol_type = other DNA
ggaccaggcggccccggggc

SEQ ID NO: 14974 - DNA, 20 bp, synthetic construct
  misc_feature 1..20: note = CRISPR gRNA sequence
  source 1..20: mol_type = other DNA
gaccaggcggccccggggcc

SEQ ID NO: 14975 - DNA, 20 bp, synthetic construct
  misc_feature 1..20: note = CRISPR gRNA sequence
  source 1..20: mol_type = other DNA
cggccccggggccgggctgt

SEQ ID NO: 14976 - DNA, 20 bp, synthetic construct
  misc_feature 1..20: note = CRISPR gRNA sequence
  source 1..20: mol_type = other DNA
ggccccggggccgggctgtg

SEQ ID NO: 14977 - DNA, 20 bp, synthetic construct
  misc_feature 1..20: note = CRISPR gRNA sequence
  source 1..20: mol_type = other DNA
ccccggggccgggctgtgag

SEQ ID NO: 14978 - DNA, 20 bp, synthetic construct
  misc_feature 1..20: note = CRISPR gRNA sequence
  source 1..20: mol_type = other DNA
cccggggccgggctgtgagg

SEQ ID NO: 14979 - DNA, 20 bp, synthetic construct
  misc_feature 1..20: note = CRISPR gRNA sequence
  source 1..20: mol_type = other DNA
cggggccgggctgtgaggag

SEQ ID NO: 14980 - DNA, 20 bp, synthetic construct
  misc_feature 1..20: note = CRISPR gRNA sequence
  source 1..20: mol_type = other DNA
ggggccgggctgtgaggagg

SEQ ID NO: 14981 - DNA, 20 bp, synthetic construct
  misc_feature 1..20: note = CRISPR gRNA sequence
  source 1..20: mol_type = other DNA
gggccgggctgtgaggagga

SEQ ID NO: 14982 - DNA, 20 bp, synthetic construct
  misc_feature 1..20: note = CRISPR gRNA sequence
  source 1..20: mol_type = other DNA
tgaggaggagggtgcaacct

SEQ ID NO: 14983 - DNA, 20 bp, synthetic construct
  misc_feature 1..20: note = CRISPR gRNA sequence
  source 1..20: mol_type = other DNA
aggaggagggtgcaacctcg

SEQ ID NO: 14984 - DNA, 20 bp, synthetic construct
  misc_feature 1..20: note = CRISPR gRNA sequence
  source 1..20: mol_type = other DNA
aggagggtgcaacctcggag

SEQ ID NO: 14985 - DNA, 20 bp, synthetic construct
  misc_feature 1..20: note = CRISPR gRNA sequence
  source 1..20: mol_type = other DNA
aacctcggagcagcttcttc

SEQ ID NO: 14986 - DNA, 20 bp, synthetic construct
  misc_feature 1..20: note = CRISPR gRNA sequence
  source 1..20: mol_type = other DNA
cggagcagcttcttctggaa

SEQ ID NO: 14987 - DNA, 20 bp, synthetic construct
  misc_feature 1..20: note = CRISPR gRNA sequence
  source 1..20: mol_type = other DNA
ggagcagcttcttctggaaa

SEQ ID NO: 14988 - DNA, 20 bp, synthetic construct
  misc_feature 1..20: note = CRISPR gRNA sequence
  source 1..20: mol_type = other DNA
cagcttcttctggaaaaggc

SEQ ID NO: 14989 - DNA, 20 bp, synthetic construct
  misc_feature 1..20: note = CRISPR gRNA sequence
  source 1..20: mol_type = other DNA
ttcttctggaaaaggccggc

SEQ ID NO: 14990 - DNA, 20 bp, synthetic construct
  misc_feature 1..20: note = CRISPR gRNA sequence
  source 1..20: mol_type = other DNA
ttctggaaaaggccggccag

SEQ ID NO: 14991 - DNA, 20 bp, synthetic construct
  misc_feature 1..20: note = CRISPR gRNA sequence
  source 1..20: mol_type = other DNA
aaaggccggccagcagcccc

SEQ ID NO: 14992 - DNA, 20 bp, synthetic construct
  misc_feature 1..20: note = CRISPR gRNA sequence
  source 1..20: mol_type = other DNA
aggccggccagcagcccccg

SEQ ID NO: 14993 - DNA, 20 bp, synthetic construct
  misc_feature 1..20: note = CRISPR gRNA sequence
  source 1..20: mol_type = other DNA
ggccggccagcagcccccgg

SEQ ID NO: 14994 - DNA, 20 bp, synthetic construct
  misc_feature 1..20: note = CRISPR gRNA sequence
  source 1..20: mol_type = other DNA
gccggccagcagcccccgga

SEQ ID NO: 14995 - DNA, 20 bp, synthetic construct
  misc_feature 1..20: note = CRISPR gRNA sequence
  source 1..20: mol_type = other DNA
cggccagcagcccccggagg

SEQ ID NO: 14996 - DNA, 20 bp, synthetic construct
  misc_feature 1..20: note = CRISPR gRNA sequence
  source 1..20: mol_type = other DNA
ccagcagcccccggagggag

SEQ ID NO: 14997 - DNA, 20 bp, synthetic construct
  misc_feature 1..20: note = CRISPR gRNA sequence
  source 1..20: mol_type = other DNA
cagcagcccccggagggagc

SEQ ID NO: 14998 - DNA, 20 bp, synthetic construct
  misc_feature 1..20: note = CRISPR gRNA sequence
  source 1..20: mol_type = other DNA
agcagcccccggagggagca

SEQ ID NO: 14999 - DNA, 20 bp, synthetic construct
  misc_feature 1..20: note = CRISPR gRNA sequence
  source 1..20: mol_type = other DNA
cggagggagcagggctccgc

SEQ ID NO: 15000 - DNA, 20 bp, synthetic construct
  misc_feature 1..20: note = CRISPR gRNA sequence
  source 1..20: mol_type = other DNA
gagcagggctccgccggtgc

SEQ ID NO: 15001 - DNA, 20 bp, synthetic construct
  misc_feature 1..20: note = CRISPR gRNA sequence
  source 1..20: mol_type = other DNA
gccggtccgcacgtgctgtg

SEQ ID NO: 15002 - DNA, 20 bp, synthetic construct
  misc_feature 1..20: note = CRISPR gRNA sequence
  source 1..20: mol_type = other DNA
ccggtccgcacgtgctgtgc

SEQ ID NO: 15003 - DNA, 20 bp, synthetic construct
  misc_feature 1..20: note = CRISPR gRNA sequence
  source 1..20: mol_type = other DNA
gtccgcacgtgctgtgcagg

SEQ ID NO: 15004 - DNA, 20 bp, synthetic construct
  misc_feature 1..20: note = CRISPR gRNA sequence
  source 1..20: mol_type = other DNA
aggaagccatcttgcgcttc

SEQ ID NO: 15005 - DNA, 20 bp, synthetic construct
  misc_feature 1..20: note = CRISPR gRNA sequence
  source 1..20: mol_type = other DNA
cttgcgcttccagctcctcg

SEQ ID NO: 15006 - DNA, 20 bp, synthetic construct
  misc_feature 1..20: note = CRISPR gRNA sequence
  source 1..20: mol_type = other DNA
tccagctcctcgaagccgtc

SEQ ID NO: 15007 - DNA, 20 bp, synthetic construct
  misc_feature 1..20: note = CRISPR gRNA sequence
  source 1..20: mol_type = other DNA
ccagctcctcgaagccgtct

SEQ ID NO: 15008 - DNA, 20 bp, synthetic construct
  misc_feature 1..20: note = CRISPR gRNA sequence
  source 1..20: mol_type = other DNA
tcctcgaagccgtctaggat

SEQ ID NO: 15009 - DNA, 20 bp, synthetic construct
  misc_feature 1..20: note = CRISPR gRNA sequence
  source 1..20: mol_type = other DNA
tcgaagccgtctaggatgag

SEQ ID NO: 15010 - DNA, 20 bp, synthetic construct
  misc_feature 1..20: note = CRISPR gRNA sequence
  source 1..20: mol_type = other DNA
cgtctaggatgagcagaacg

SEQ ID NO: 15011 - DNA, 20 bp, synthetic construct
  misc_feature 1..20: note = CRISPR gRNA sequence
  source 1..20: mol_type = other DNA
taggatgagcagaacgcggt

SEQ ID NO: 15012 - DNA, 20 bp, synthetic construct
  misc_feature 1..20: note = CRISPR gRNA sequence
  source 1..20: mol_type = other DNA
aggatgagcagaacgcggtc

SEQ ID NO: 15013 - DNA, 20 bp, synthetic construct
  misc_feature 1..20: note = CRISPR gRNA sequence
  source 1..20: mol_type = other DNA
gaacgcggtcaggtctcttc

SEQ ID NO: 15014 - DNA, 20 bp, synthetic construct
  misc_feature 1..20: note = CRISPR gRNA sequence
  source 1..20: mol_type = other DNA
ggtcaggtctcttcaagatg

SEQ ID NO: 15015 - DNA, 20 bp, synthetic construct
  misc_feature 1..20: note = CRISPR gRNA sequence
  source 1..20: mol_type = other DNA
gatgtggctgaaaacctcat

SEQ ID NO: 15016 - DNA, 20 bp, synthetic construct
  misc_feature 1..20: note = CRISPR gRNA sequence
  source 1..20: mol_type = other DNA
aaaacctcatcggccgccac

SEQ ID NO: 15017 - DNA, 20 bp, synthetic construct
  misc_feature 1..20: note = CRISPR gRNA sequence
  source 1..20: mol_type = other DNA
acctcatcggccgccacgag

SEQ ID NO: 15018 - DNA, 20 bp, synthetic construct
  misc_feature 1..20: note = CRISPR gRNA sequence
  source 1..20: mol_type = other DNA
tcggccgccacgagtggctg

SEQ ID NO: 15019 - DNA, 20 bp, synthetic construct
  misc_feature 1..20: note = CRISPR gRNA sequence
  source 1..20: mol_type = other DNA
cggccgccacgagtggctgt

SEQ ID NO: 15020 - DNA, 20 bp, synthetic construct
  misc_feature 1..20: note = CRISPR gRNA sequence
  source 1..20: mol_type = other DNA
gccacgagtggctgtgggcc

SEQ ID NO: 15021 - DNA, 20 bp, synthetic construct
  misc_feature 1..20: note = CRISPR gRNA sequence
  source 1..20: mol_type = other DNA
ccacgagtggctgtgggccc

SEQ ID NO: 15022 - DNA, 20 bp, synthetic construct
  misc_feature 1..20: note = CRISPR gRNA sequence
  source 1..20: mol_type = other DNA
cacgagtggctgtgggccca

SEQ ID NO: 15023 - DNA, 20 bp, synthetic construct
  misc_feature 1..20: note = CRISPR gRNA sequence
  source 1..20: mol_type = other DNA
cgagtggctgtgggcccagg

SEQ ID NO: 15024 - DNA, 20 bp, synthetic construct
  misc_feature 1..20: note = CRISPR gRNA sequence
  source 1..20: mol_type = other DNA
gtggctgtgggcccagggag

SEQ ID NO: 15025 - DNA, 20 bp, synthetic construct
  misc_feature 1..20: note = CRISPR gRNA sequence
  source 1..20: mol_type = other DNA
ggctgtgggcccagggagaa

SEQ ID NO: 15026 - DNA, 20 bp, synthetic construct
  misc_feature 1..20: note = CRISPR gRNA sequence
  source 1..20: mol_type = other DNA
tgtgggcccagggagaagag

SEQ ID NO: 15027 - DNA, 20 bp, synthetic construct
  misc_feature 1..20: note = CRISPR gRNA sequence
  source 1..20: mol_type = other DNA
agggagaagagcagatcctg

SEQ ID NO: 15028 - DNA, 20 bp, synthetic construct
  misc_feature 1..20: note = CRISPR gRNA sequence
  source 1..20: mol_type = other DNA
gggagaagagcagatcctgc

SEQ ID NO: 15029 - DNA, 20 bp, synthetic construct
  misc_feature 1..20: note = CRISPR gRNA sequence
  source 1..20: mol_type = other DNA
agagcagatcctgcaggcca

SEQ ID NO: 15030 - DNA, 20 bp, synthetic construct
  misc_feature 1..20: note = CRISPR gRNA sequence
  source 1..20: mol_type = other DNA
gagcagatcctgcaggccat

SEQ ID NO: 15031 - DNA, 20 bp, synthetic construct
  misc_feature 1..20: note = CRISPR gRNA sequence
  source 1..20: mol_type = other DNA
tgcaggccataggcatcccc

SEQ ID NO: 15032 - DNA, 20 bp, synthetic construct
  misc_feature 1..20: note = CRISPR gRNA sequence
  source 1..20: mol_type = other DNA
ggccataggcatcccccgga

SEQ ID NO: 15033 - DNA, 20 bp, synthetic construct
  misc_feature 1..20: note = CRISPR gRNA sequence
  source 1..20: mol_type = other DNA
aggcatcccccggacggttc

SEQ ID NO: 15034 - DNA, 20 bp, synthetic construct
  misc_feature 1..20: note = CRISPR gRNA sequence
  source 1..20: mol_type = other DNA
cccccggacggttcaagcaa

SEQ ID NO: 15035 - DNA, 20 bp, synthetic construct
  misc_feature 1..20: note = CRISPR gRNA sequence
  source 1..20: mol_type = other DNA
ccggacggttcaagcaatgg

SEQ ID NO: 15036 - DNA, 20 bp, synthetic construct
  misc_feature 1..20: note = CRISPR gRNA sequence
  source 1..20: mol_type = other DNA
cggacggttcaagcaatggc

SEQ ID NO: 15037 - DNA, 20 bp, synthetic construct
  misc_feature 1..20: note = CRISPR gRNA sequence
  source 1..20: mol_type = other DNA
ggacggttcaagcaatggca

SEQ ID NO: 15038 - DNA, 20 bp, synthetic construct
  misc_feature 1..20: note = CRISPR gRNA sequence
  source 1..20: mol_type = other DNA
gacggttcaagcaatggcag

SEQ ID NO: 15039 - DNA, 20 bp, synthetic construct
  misc_feature 1..20: note = CRISPR gRNA sequence
  source 1..20: mol_type = other DNA
gttcaagcaatggcagggga

SEQ ID NO: 15040 - DNA, 20 bp, synthetic construct
  misc_feature 1..20: note = CRISPR gRNA sequence
  source 1..20: mol_type = other DNA
tcaagcaatggcaggggaca

SEQ ID NO: 15041 - DNA, 20 bp, synthetic construct
  misc_feature 1..20: note = CRISPR gRNA sequence
  source 1..20: mol_type = other DNA
agcaatggcaggggacagag

SEQ ID NO: 15042 - DNA, 20 bp, synthetic construct
  misc_feature 1..20: note = CRISPR gRNA sequence
  source 1..20: mol_type = other DNA
ggcaggggacagagaagaca

SEQ ID NO: 15043 - DNA, 20 bp, synthetic construct
  misc_feature 1..20: note = CRISPR gRNA sequence
  source 1..20: mol_type = other DNA
cagagaagacaaagtcgtac

SEQ ID NO: 15044 - DNA, 20 bp, synthetic construct
  misc_feature 1..20: note = CRISPR gRNA sequence
  source 1..20: mol_type = other DNA
agagaagacaaagtcgtact

SEQ ID NO: 15045 - DNA, 20 bp, synthetic construct
  misc_feature 1..20: note = CRISPR gRNA sequence
  source 1..20: mol_type = other DNA
gagaagacaaagtcgtactg

SEQ ID NO: 15046 - DNA, 20 bp, synthetic construct
  misc_feature 1..20: note = CRISPR gRNA sequence
  source 1..20: mol_type = other DNA
aagacaaagtcgtactgggg

SEQ ID NO: 15047 - DNA, 20 bp, synthetic construct
  misc_feature 1..20: note = CRISPR gRNA sequence
  source 1..20: mol_type = other DNA
caaagtcgtactggggaagc

SEQ ID NO: 15048 - DNA, 20 bp, synthetic construct
  misc_feature 1..20: note = CRISPR gRNA sequence
  source 1..20: mol_type = other DNA
gtactggggaagccggccac

SEQ ID NO: 15049 - DNA, 20 bp, synthetic construct
  misc_feature 1..20: note = CRISPR gRNA sequence
  source 1..20: mol_type = other DNA
ggggaagccggccacaagcc

SEQ ID NO: 15050 - DNA, 20 bp, synthetic construct
  misc_feature 1..20: note = CRISPR gRNA sequence
  source 1..20: mol_type = other DNA
gggaagccggccacaagccc

SEQ ID NO: 15051 - DNA, 20 bp, synthetic construct
  misc_feature 1..20: note = CRISPR gRNA sequence
  source 1..20: mol_type = other DNA
gccggccacaagcccaggcc

SEQ ID NO: 15052 - DNA, 20 bp, synthetic construct
  misc_feature 1..20: note = CRISPR gRNA sequence
  source 1..20: mol_type = other DNA
ccaggcccggctcactgccc

SEQ ID NO: 15053 - DNA, 20 bp, synthetic construct
  misc_feature 1..20: note = CRISPR gRNA sequence
  source 1..20: mol_type = other DNA
ggctcactgccccagcccaa

SEQ ID NO: 15054 - DNA, 20 bp, synthetic construct
  misc_feature 1..20: note = CRISPR gRNA sequence
  source 1..20: mol_type = other DNA
ccaatagctcttgccctgac

SEQ ID NO: 15055 - DNA, 20 bp, synthetic construct
  misc_feature 1..20: note = CRISPR gRNA sequence
  source 1..20: mol_type = other DNA
ttgccctgaccagctttgcc

SEQ ID NO: 15056 - DNA, 20 bp, synthetic construct
  misc_feature 1..20: note = CRISPR gRNA sequence
  source 1..20: mol_type = other DNA
ctgaccagctttgcccagca

SEQ ID NO: 15057 - DNA, 20 bp, synthetic construct
  misc_feature 1..20: note = CRISPR gRNA sequence
  source 1..20: mol_type = other DNA
gcaatcactcgtgtctcacg

SEQ ID NO: 15058 - DNA, 20 bp, synthetic construct
  misc_feature 1..20: note = CRISPR gRNA sequence
  source 1..20: mol_type = other DNA
ctcgtgtctcacgcggccgc

SEQ ID NO: 15059 - DNA, 20 bp, synthetic construct
  misc_feature 1..20: note = CRISPR gRNA sequence
  source 1..20: mol_type = other DNA
acgcggccgccggtgctcct

SEQ ID NO: 15060 - DNA, 20 bp, synthetic construct
  misc_feature 1..20: note = CRISPR gRNA sequence
  source 1..20: mol_type = other DNA
cggccgccggtgctccttgg

SEQ ID NO: 15061 - DNA, 20 bp, synthetic construct
  misc_feature 1..20: note = CRISPR gRNA sequence
  source 1..20: mol_type = other DNA
cggtgctccttggcagccaa

SEQ ID NO: 15062 - DNA, 20 bp, synthetic construct
  misc_feature 1..20: note = CRISPR gRNA sequence
  source 1..20: mol_type = other DNA
cttggcagccaacagcacct

SEQ ID NO: 15063 - DNA, 20 bp, synthetic construct
  misc_feature 1..20: note = CRISPR gRNA sequence
  source 1..20: mol_type = other DNA
gcagccaacagcacctcagc

SEQ ID NO: 15064 - DNA, 20 bp, synthetic construct
  misc_feature 1..20: note = CRISPR gRNA sequence
  source 1..20: mol_type = other DNA
cagccaacagcacctcagcc

SEQ ID NO: 15065 - DNA, 20 bp, synthetic construct
  misc_feature 1..20: note = CRISPR gRNA sequence
  source 1..20: mol_type = other DNA
gcacctcagccaggcctcct

SEQ ID NO: 15066 - DNA, 20 bp, synthetic construct
  misc_feature 1..20: note = CRISPR gRNA sequence
  source 1..20: mol_type = other DNA
cacctcagccaggcctcctt

SEQ ID NO: 15067 - DNA, 20 bp, synthetic construct
  misc_feature 1..20: note = CRISPR gRNA sequence
  source 1..20: mol_type = other DNA
tcagccaggcctccttgggc

SEQ ID NO: 15068 - DNA, 20 bp, synthetic construct
  misc_feature 1..20: note = CRISPR gRNA sequence
  source 1..20: mol_type = other DNA
gggccagctgccgttctgcc

SEQ ID NO: 15069 - DNA, 20 bp, synthetic construct
  misc_feature 1..20: note = CRISPR gRNA sequence
  source 1..20: mol_type = other DNA
agctgccgttctgcccagtc

SEQ ID NO: 15070 - DNA, 20 bp, synthetic construct
  misc_feature 1..20: note = CRISPR gRNA sequence
  source 1..20: mol_type = other DNA
gctgccgttctgcccagtcc

SEQ ID NO: 15071 - DNA, 20 bp, synthetic construct
  misc_feature 1..20: note = CRISPR gRNA sequence
  source 1..20: mol_type = other DNA
ctgccgttctgcccagtccg

SEQ ID NO: 15072 - DNA, 20 bp, synthetic construct
  misc_feature 1..20: note = CRISPR gRNA sequence
  source 1..20: mol_type = other DNA
ccgttctgcccagtccgggg

SEQ ID NO: 15073 - DNA, 20 bp, synthetic construct
  misc_feature 1..20: note = CRISPR gRNA sequence
  source 1..20: mol_type = other DNA
tctgcccagtccggggtggc

SEQ ID NO: 15074 - DNA, 20 bp, synthetic construct
  misc_feature 1..20: note = CRISPR gRNA sequence
  source 1..20: mol_type = other DNA
ggggtggccagttcccgctc

SEQ ID NO: 15075 - DNA, 20 bp, synthetic construct
  misc_feature 1..20: note = CRISPR gRNA sequence
  source 1..20: mol_type = other DNA
gggtggccagttcccgctcc

SEQ ID NO: 15076 - DNA, 20 bp, synthetic construct
  misc_feature 1..20: note = CRISPR gRNA sequence
  source 1..20: mol_type = other DNA
ctcttgctgctgctcctctc

SEQ ID NO: 15077 - DNA, 20 bp, synthetic construct
  misc_feature 1..20: note = CRISPR gRNA sequence
  source 1..20: mol_type = other DNA
gctgctgctcctctccagcc

SEQ ID NO: 15078 - DNA, 20 bp, synthetic construct
  misc_feature 1..20: note = CRISPR gRNA sequence
  source 1..20: mol_type = other DNA
ctctccagcctggcctgcac

SEQ ID NO: 15079 - DNA, 20 bp, synthetic construct
  misc_feature 1..20: note = CRISPR gRNA sequence
  source 1..20: mol_type = other DNA
tgcaccagatccacctccac

SEQ ID NO: 15080 - DNA, 20 bp, synthetic construct
  misc_feature 1..20: note = CRISPR gRNA sequence
  source 1..20: mol_type = other DNA
gcaccagatccacctccact

SEQ ID NO: 15081 - DNA, 20 bp, synthetic construct
  misc_feature 1..20: note = CRISPR gRNA sequence
  source 1..20: mol_type = other DNA
acctccactaggatgccatc

SEQ ID NO: 15082 - DNA, 20 bp, synthetic construct
  misc_feature 1..20: note = CRISPR gRNA sequence
  source 1..20: mol_type = other DNA
cctccactaggatgccatcc

SEQ ID NO: 15083 - DNA, 20 bp, synthetic construct
  misc_feature 1..20: note = CRISPR gRNA sequence
  source 1..20: mol_type = other DNA
taggatgccatccgggcctg

SEQ ID NO: 15084 - DNA, 20 bp, synthetic construct
  misc_feature 1..20: note = CRISPR gRNA sequence
  source 1..20: mol_type = other DNA
aggatgccatccgggcctgc

SEQ ID NO: 15085 - DNA, 20 bp, synthetic construct
  misc_feature 1..20: note = CRISPR gRNA sequence
  source 1..20: mol_type = other DNA
gccatccgggcctgcgggct

SEQ ID NO: 15086 - DNA, 20 bp, synthetic construct
  misc_feature 1..20: note = CRISPR gRNA sequence
  source 1..20: mol_type = other DNA
tcggcaccatacgtgtcctg

SEQ ID NO: 15087 - DNA, 20 bp, synthetic construct
  misc_feature 1..20: note = CRISPR gRNA sequence
  source 1..20: mol_type = other DNA
caccatacgtgtcctgcagt

SEQ ID NO: 15088 - DNA, 20 bp, synthetic construct
  misc_feature 1..20: note = CRISPR gRNA sequence
  source 1..20: mol_type = other DNA
catacgtgtcctgcagtgag

SEQ ID NO: 15089 - DNA, 20 bp, synthetic construct
  misc_feature 1..20: note = CRISPR gRNA sequence
  source 1..20: mol_type = other DNA
acgtgtcctgcagtgagcgg

SEQ ID NO: 15090 - DNA, 20 bp, synthetic construct
  misc_feature 1..20: note = CRISPR gRNA sequence
  source 1..20: mol_type = other DNA
gagcggtagaactgctccac

SEQ ID NO: 15091 - DNA, 20 bp, synthetic construct
  misc_feature 1..20: note = CRISPR gRNA sequence
  source 1..20: mol_type = other DNA
actgctccaccggctctgca

SEQ ID NO: 15092 - DNA, 20 bp, synthetic construct
  misc_feature 1..20: note = CRISPR gRNA sequence
  source 1..20: mol_type = other DNA
ctgctccaccggctctgcaa

SEQ ID NO: 15093 - DNA, 20 bp, synthetic construct
  misc_feature 1..20: note = CRISPR gRNA sequence
  source 1..20: mol_type = other DNA
tccaccggctctgcaaaggc

SEQ ID NO: 15094 - DNA, 20 bp, synthetic construct
  misc_feature 1..20: note = CRISPR gRNA sequence
  source 1..20: mol_type = other DNA
ccaccggctctgcaaaggcc

SEQ ID NO: 15095 - DNA, 20 bp, synthetic construct
  misc_feature 1..20: note = CRISPR gRNA sequence
  source 1..20: mol_type = other DNA
caccggctctgcaaaggcca

SEQ ID NO: 15096 - DNA, 20 bp, synthetic construct
  misc_feature 1..20: note = CRISPR gRNA sequence
  source 1..20: mol_type = other DNA
accggctctgcaaaggccag

SEQ ID NO: 15097 - DNA, 20 bp, synthetic construct
  misc_feature 1..20: note = CRISPR gRNA sequence
  source 1..20: mol_type = other DNA
tgcaaaggccaggggcgtgt

SEQ ID NO: 15098 - DNA, 20 bp, synthetic construct
  misc_feature 1..20: note = CRISPR gRNA sequence
  source 1..20: mol_type = other DNA
gcaaaggccaggggcgtgtc

SEQ ID NO: 15099 - DNA, 20 bp, synthetic construct
  misc_feature 1..20: note = CRISPR gRNA sequence
  source 1..20: mol_type = other DNA
caaaggccaggggcgtgtca

SEQ ID NO: 15100 - DNA, 20 bp, synthetic construct
  misc_feature 1..20: note = CRISPR gRNA sequence
  source 1..20: mol_type = other DNA
aggccaggggcgtgtcaggg

SEQ ID NO: 15101 - DNA, 20 bp, synthetic construct
  misc_feature 1..20: note = CRISPR gRNA sequence
  source 1..20: mol_type = other DNA
ggccaggggcgtgtcagggt

SEQ ID NO: 15102 - DNA, 20 bp, synthetic construct
  misc_feature 1..20: note = CRISPR gRNA sequence
  source 1..20: mol_type = other DNA
gccaggggcgtgtcagggtg

SEQ ID NO: 15103 - DNA, 20 bp, synthetic construct
  misc_feature 1..20: note = CRISPR gRNA sequence
  source 1..20: mol_type = other DNA
ccaggggcgtgtcagggtgg

SEQ ID NO: 15104 - DNA, 20 bp, synthetic construct
  misc_feature 1..20: note = CRISPR gRNA sequence
  source 1..20: mol_type = other DNA
gtgtcagggtgggggtatgt

SEQ ID NO: 15105 - DNA, 20 bp, synthetic construct
  misc_feature 1..20: note = CRISPR gRNA sequence
  source 1..20: mol_type = other DNA
gtcagggtgggggtatgtga

SEQ ID NO: 15106 - DNA, 20 bp, synthetic construct
  misc_feature 1..20: note = CRISPR gRNA sequence
  source 1..20: mol_type = other DNA
tcagggtgggggtatgtgag

SEQ ID NO: 15107 - DNA, 20 bp, synthetic construct
  misc_feature 1..20: note = CRISPR gRNA sequence
  source 1..20: mol_type = other DNA
gggtgggggtatgtgagagg

SEQ ID NO: 15108 - DNA, 20 bp, synthetic construct
  misc_feature 1..20: note = CRISPR gRNA sequence
  source 1..20: mol_type = other DNA
ggtgggggtatgtgagaggc

SEQ ID NO: 15109 - DNA, 20 bp, synthetic construct
  misc_feature 1..20: note = CRISPR gRNA sequence
  source 1..20: mol_type = other DNA
gtgggggtatgtgagaggca

SEQ ID NO: 15110 - DNA, 20 bp, synthetic construct
  misc_feature 1..20: note = CRISPR gRNA sequence
  source 1..20: mol_type = other DNA
gggtatgtgagaggcagggc

SEQ ID NO: 15111 - DNA, 20 bp, synthetic construct
  misc_feature 1..20: note = CRISPR gRNA sequence
  source 1..20: mol_type = other DNA
ggtatgtgagaggcagggcc

SEQ ID NO: 15112 - DNA, 20 bp, synthetic construct
  misc_feature 1..20: note = CRISPR gRNA sequence
  source 1..20: mol_type = other DNA
gtatgtgagaggcagggcca

SEQ ID NO: 15113 - DNA, 20 bp, synthetic construct
  misc_feature 1..20: note = CRISPR gRNA sequence
  source 1..20: mol_type = other DNA
gtgagaggcagggccagggc

SEQ ID NO: 15114 - DNA, 20 bp, synthetic construct
  misc_feature 1..20: note = CRISPR gRNA sequence
  source 1..20: mol_type = other DNA
gggccagggccagccaccac

SEQ ID NO: 15115 - DNA, 20 bp, synthetic construct
  misc_feature 1..20: note = CRISPR gRNA sequence
  source 1..20: mol_type = other DNA
ggccagggccagccaccaca

SEQ ID NO: 15116 - DNA, 20 bp, synthetic construct
  misc_feature 1..20: note = CRISPR gRNA sequence
  source 1..20: mol_type = other DNA
agggccagccaccacaaggc

SEQ ID NO: 15117 - DNA, 20 bp, synthetic construct
  misc_feature 1..20: note = CRISPR gRNA sequence
  source 1..20: mol_type = other DNA
atttacatctgttccccaca

SEQ ID NO: 15118 - DNA, 20 bp, synthetic construct
  misc_feature 1..20: note = CRISPR gRNA sequence
  source 1..20: mol_type = other DNA
tgtttgttttgttttgtttt

SEQ ID NO: 15119 - DNA, 20 bp, synthetic construct
  misc_feature 1..20: note = CRISPR gRNA sequence
  source 1..20: mol_type = other DNA
tgttttgttttgttttgaga

SEQ ID NO: 15120 - DNA, 20 bp, synthetic construct
  misc_feature 1..20: note = CRISPR gRNA sequence
  source 1..20: mol_type = other DNA
gttttgttttgttttgagac

SEQ ID NO: 15121 - DNA, 20 bp, synthetic construct
  misc_feature 1..20: note = CRISPR gRNA sequence
  source 1..20: mol_type = other DNA
ttttgttttgttttgagaca

SEQ ID NO: 15122 - DNA, 20 bp, synthetic construct
  misc_feature 1..20: note = CRISPR gRNA sequence
  source 1..20: mol_type = other DNA
ttttgttttgagacagggtc

SEQ ID NO: 15123 - DNA, 20 bp, synthetic construct
  misc_feature 1..20: note = CRISPR gRNA sequence
  source 1..20: mol_type = other DNA
cagggtctggcttttttgcc

SEQ ID NO: 15124 - DNA, 20 bp, synthetic construct
  misc_feature 1..20: note = CRISPR gRNA sequence
  source 1..20: mol_type = other DNA
agggtctggcttttttgccc

SEQ ID NO: 15125 - DNA, 20 bp, synthetic construct
  misc_feature 1..20: note = CRISPR gRNA sequence
  source 1..20: mol_type = other DNA
tctggcttttttgcccaggc

SEQ ID NO: 15126 - DNA, 20 bp, synthetic construct
  misc_feature 1..20: note = CRISPR gRNA sequence
  source 1..20: mol_type = other DNA
tttttgcccaggctggaatg

SEQ ID NO: 15127 - DNA, 20 bp, synthetic construct
  misc_feature 1..20: note = CRISPR gRNA sequence
  source 1..20: mol_type = other DNA
ttgcccaggctggaatgcag

SEQ ID NO: 15128 - DNA, 20 bp, synthetic construct
  misc_feature 1..20: note = CRISPR gRNA sequence
  source 1..20: mol_type = other DNA
ggaatgcagtggtgtgatca

SEQ ID NO: 15129 - DNA, 20 bp, synthetic construct
  misc_feature 1..20: note = CRISPR gRNA sequence
  source 1..20: mol_type = other DNA
tcgctgcaacctcaacctcc

SEQ ID NO: 15130 - DNA, 20 bp, synthetic construct
  misc_feature 1..20: note = CRISPR gRNA sequence
  source 1..20: mol_type = other DNA
cgctgcaacctcaacctcct

SEQ ID NO: 15131 - DNA, 20 bp, synthetic construct
  misc_feature 1..20: note = CRISPR gRNA sequence
  source 1..20: mol_type = other DNA
tcctcctgactccacctccc

SEQ ID NO: 15132 - DNA, 20 bp, synthetic construct
  misc_feature 1..20: note = CRISPR gRNA sequence
  source 1..20: mol_type = other DNA
tcctgactccacctcccaag

SEQ ID NO: 15133 - DNA, 20 bp, synthetic construct
  misc_feature 1..20: note = CRISPR gRNA sequence
  source 1..20: mol_type = other DNA
gactccacctcccaagtagc

SEQ ID NO: 15134 - DNA, 20 bp, synthetic construct
  misc_feature 1..20: note = CRISPR gRNA sequence
  source 1..20: mol_type = other DNA
actccacctcccaagtagct

SEQ ID NO: 15135 - DNA, 20 bp, synthetic construct
  misc_feature 1..20: note = CRISPR gRNA sequence
  source 1..20: mol_type = other DNA
ctcccaagtagctgggacca

SEQ ID NO: 15136 - DNA, 20 bp, synthetic construct
  misc_feature 1..20: note = CRISPR gRNA sequence
  source 1..20: mol_type = other DNA
cagacatgtgacaccatgcc

SEQ ID NO: 15137 - DNA, 20 bp, synthetic construct
  misc_feature 1..20: note = CRISPR gRNA sequence
  source 1..20: mol_type = other DNA
ataattttttgatttttttg

SEQ ID NO: 15138 - DNA, 20 bp, synthetic construct
  misc_feature 1..20: note = CRISPR gRNA sequence
  source 1..20: mol_type = other DNA
aattttttgatttttttgta

SEQ ID NO: 15139 - DNA, 20 bp, synthetic construct
  misc_feature 1..20: note = CRISPR gRNA sequence
  source 1..20: mol_type = other DNA
ttttgatttttttgtagaga

SEQ ID NO: 15140 - DNA, 20 bp, synthetic construct
  misc_feature 1..20: note = CRISPR gRNA sequence
  source 1..20: mol_type = other DNA
tttgatttttttgtagagat

SEQ ID NO: 15141 - DNA, 20 bp, synthetic construct
  misc_feature 1..20: note = CRISPR gRNA sequence
  source 1..20: mol_type = other DNA
ttgatttttttgtagagatg

SEQ ID NO: 15142 - DNA, 20 bp, synthetic construct
  misc_feature 1..20: note = CRISPR gRNA sequence
  source 1..20: mol_type = other DNA
tggggtctcactatgtcgcc

SEQ ID NO: 15143 - DNA, 20 bp, synthetic construct
  misc_feature 1..20: note = CRISPR gRNA sequence
  source 1..20: mol_type = other DNA
ggggtctcactatgtcgccc

SEQ ID NO: 15144 - DNA, 20 bp, synthetic construct
  misc_feature 1..20: note = CRISPR gRNA sequence
  source 1..20: mol_type = other DNA
tctcactatgtcgcccaggc

SEQ ID NO: 15145 - DNA, 20 bp, synthetic construct
  misc_feature 1..20: note = CRISPR gRNA sequence
  source 1..20: mol_type = other DNA
tcgcccaggctggcgtgcaa

SEQ ID NO: 15146 - DNA, 20 bp, synthetic construct
  misc_feature 1..20: note = CRISPR gRNA sequence
  source 1..20: mol_type = other DNA
ggcgtgcaatggcacaatca

SEQ ID NO: 15147 - DNA, 20 bp, synthetic construct
  misc_feature 1..20: note = CRISPR gRNA sequence
  source 1..20: mol_type = other DNA
ggcacaatcatggtccacca

SEQ ID NO: 15148 - DNA, 20 bp, synthetic construct
  misc_feature 1..20: note = CRISPR gRNA sequence
  source 1..20: mol_type = other DNA
ccaccacagcttcaacctca

SEQ ID NO: 15149 - DNA, 20 bp, synthetic construct
  misc_feature 1..20: note = CRISPR gRNA sequence
  source 1..20: mol_type = other DNA
caccacagcttcaacctcac

SEQ ID NO: 15150 - DNA, 20 bp, synthetic construct
  misc_feature 1..20: note = CRISPR gRNA sequence
  source 1..20: mol_type = other DNA
agcttcaacctcacaggctc

SEQ ID NO: 15151 - DNA, 20 bp, synthetic construct
  misc_feature 1..20: note = CRISPR gRNA sequence
  source 1..20: mol_type = other DNA
ctcaagcaatcctcccacct

SEQ ID NO: 15152 - DNA, 20 bp, synthetic construct
  misc_feature 1..20: note = CRISPR gRNA sequence
  source 1..20: mol_type = other DNA
tcctcccacctcagcctcct

SEQ ID NO: 15153 - DNA, 20 bp, synthetic construct
  misc_feature 1..20: note = CRISPR gRNA sequence
  source 1..20: mol_type = other DNA
tcccacctcagcctcctgag

SEQ ID NO: 15154 - DNA, 20 bp, synthetic construct
  misc_feature 1..20: note = CRISPR gRNA sequence
  source 1..20: mol_type = other DNA
acctcagcctcctgagtagc

SEQ ID NO: 15155 - DNA, 20 bp, synthetic construct
  misc_feature 1..20: note = CRISPR gRNA sequence
  source 1..20: mol_type = other DNA
cctcagcctcctgagtagct

SEQ ID NO: 15156 - DNA, 20 bp, synthetic construct
  misc_feature 1..20: note = CRISPR gRNA sequence
  source 1..20: mol_type = other DNA
ctcctgagtagctgggacta

SEQ ID NO: 15157 - DNA, 20 bp, synthetic construct
  misc_feature 1..20: note = CRISPR gRNA sequence
  source 1..20: mol_type = other DNA
tcctgagtagctgggactac

SEQ ID NO: 15158 - DNA, 20 bp, synthetic construct
  misc_feature 1..20: note = CRISPR gRNA sequence
  source 1..20: mol_type = other DNA
caggcgcccactgccatgcc

SEQ ID NO: 15159 - DNA, 20 bp, synthetic construct
  misc_feature 1..20: note = CRISPR gRNA sequence
  source 1..20: mol_type = other DNA
ttttcttttttgtttttttg

SEQ ID NO: 15160 - DNA, 20 bp, synthetic construct
  misc_feature 1..20: note = CRISPR gRNA sequence
  source 1..20: mol_type = other DNA
ttcttttttgtttttttgtg

SEQ ID NO: 15161 - DNA, 20 bp, synthetic construct
  misc_feature 1..20: note = CRISPR gRNA sequence
  source 1..20: mol_type = other DNA
ttttgtttttttgtggagat

SEQ ID NO: 15162 - DNA, 20 bp, synthetic construct
  misc_feature 1..20: note = CRISPR gRNA sequence
  source 1..20: mol_type = other DNA
taagttctcactattttgcc

SEQ ID NO: 15163 - DNA, 20 bp, synthetic construct
  misc_feature 1..20: note = CRISPR gRNA sequence
  source 1..20: mol_type = other DNA
aagttctcactattttgccc

SEQ ID NO: 15164 - DNA, 20 bp, synthetic construct
  misc_feature 1..20: note = CRISPR gRNA sequence
  source 1..20: mol_type = other DNA
tctcactattttgcccaggc

SEQ ID NO: 15165 - DNA, 20 bp, synthetic construct
  misc_feature 1..20: note = CRISPR gRNA sequence
  source 1..20: mol_type = other DNA
attttgcccaggctggtctt

SEQ ID NO: 15166 - DNA, 20 bp, synthetic construct
  misc_feature 1..20: note = CRISPR gRNA sequence
  source 1..20: mol_type = other DNA
ccaggctggtcttgagctcc

SEQ ID NO: 15167 - DNA, 20 bp, synthetic construct
  misc_feature 1..20: note = CRISPR gRNA sequence
  source 1..20: mol_type = other DNA
caggctggtcttgagctcct

SEQ ID NO: 15168 - DNA, 20 bp, synthetic construct
  misc_feature 1..20: note = CRISPR gRNA sequence
  source 1..20: mol_type = other DNA
ggtcttgagctcctgggctc

SEQ ID NO: 15169 - DNA, 20 bp, synthetic construct
  misc_feature 1..20: note = CRISPR gRNA sequence
  source 1..20: mol_type = other DNA
ctcaagcaatcgttccgcct

SEQ ID NO: 15170 - DNA, 20 bp, synthetic construct
  misc_feature 1..20: note = CRISPR gRNA sequence
  source 1..20: mol_type = other DNA
cgttccgccttggcctccca

SEQ ID NO: 15171 - DNA, 20 bp, synthetic construct
  misc_feature 1..20: note = CRISPR gRNA sequence
  source 1..20: mol_type = other DNA
gccttggcctcccaaagtgc

SEQ ID NO: 15172 - DNA, 20 bp, synthetic construct
  misc_feature 1..20: note = CRISPR gRNA sequence
  source 1..20: mol_type = other DNA
ccttggcctcccaaagtgct

SEQ ID NO: 15173 - DNA, 20 bp, synthetic construct
  misc_feature 1..20: note = CRISPR gRNA sequence
  source 1..20: mol_type = other DNA
ctcccaaagtgctgggatta

SEQ ID NO: 15174 - DNA, 20 bp, synthetic construct
  misc_feature 1..20: note = CRISPR gRNA sequence
  source 1..20: mol_type = other DNA
tcccaaagtgctgggattac

SEQ ID NO: 15175 - DNA, 20 bp, synthetic construct
  misc_feature 1..20: note = CRISPR gRNA sequence
  source 1..20: mol_type = other DNA
agtgctgggattacaggtgt

SEQ ID NO: 15176 - DNA, 20 bp, synthetic construct
  misc_feature 1..20: note = CRISPR gRNA sequence
  source 1..20: mol_type = other DNA
caggtgtgagccaccacatc

SEQ ID NO: 15177 - DNA, 20 bp, synthetic construct
  misc_feature 1..20: note = CRISPR gRNA sequence
  source 1..20: mol_type = other DNA
caccacatctggcccccata

SEQ ID NO: 15178 - DNA, 20 bp, synthetic construct
  misc_feature 1..20: note = CRISPR gRNA sequence
  source 1..20: mol_type = other DNA
tcttcatcatttgcttcatt

SEQ ID NO: 15179 - DNA, 20 bp, synthetic construct
  misc_feature 1..20: note = CRISPR gRNA sequence
  source 1..20: mol_type = other DNA
gtcacccaccactcattcat

SEQ ID NO: 15180 - DNA, 20 bp, synthetic construct
  misc_feature 1..20: note = CRISPR gRNA sequence
  source 1..20: mol_type = other DNA
actcatcgtctctcttgttt

SEQ ID NO: 15181 - DNA, 20 bp, synthetic construct
  misc_feature 1..20: note = CRISPR gRNA sequence
  source 1..20: mol_type = other DNA
gtttaagtgtccactccttt

SEQ ID NO: 15182 - DNA, 20 bp, synthetic construct
  misc_feature 1..20: note = CRISPR gRNA sequence
  source 1..20: mol_type = other DNA
tttctctctttttttttttt

SEQ ID NO: 15183 - DNA, 20 bp, synthetic construct
  misc_feature 1..20: note = CRISPR gRNA sequence
  source 1..20: mol_type = other DNA
tctcttttttttttttgaga

SEQ ID NO: 15184 - DNA, 20 bp, synthetic construct
  misc_feature 1..20: note = CRISPR gRNA sequence
  source 1..20: mol_type = other DNA
atggatcctgccctgtgccc

SEQ ID NO: 15185 - DNA, 20 bp, synthetic construct
  misc_feature 1..20: note = CRISPR gRNA sequence
  source 1..20: mol_type = other DNA
tggatcctgccctgtgcccc

SEQ ID NO: 15186 - DNA, 20 bp, synthetic construct
  misc_feature 1..20: note = CRISPR gRNA sequence
  source 1..20: mol_type = other DNA
tcctgccctgtgccccaggc

SEQ ID NO: 15187 - DNA, 20 bp, synthetic construct
  misc_feature 1..20: note = CRISPR gRNA sequence
  source 1..20: mol_type = other DNA
ctgccctgtgccccaggctg

SEQ ID NO: 15188 - DNA, 20 bp, synthetic construct
  misc_feature 1..20: note = CRISPR gRNA sequence
  source 1..20: mol_type = other DNA
tgccccaggctggagtgcac

SEQ ID NO: 15189 - DNA, 20 bp, synthetic construct
  misc_feature 1..20: note = CRISPR gRNA sequence
  source 1..20: mol_type = other DNA
ggagtgcactggcgcaatct

SEQ ID NO: 15190 - DNA, 20 bp, synthetic construct
  misc_feature 1..20: note = CRISPR gRNA sequence
  source 1..20: mol_type = other DNA
actggcgcaatctcagctca

SEQ ID NO: 15191 - DNA, 20 bp, synthetic construct
  misc_feature 1..20: note = CRISPR gRNA sequence
  source 1..20: mol_type = other DNA
tcacggcaacctccacctcc

SEQ ID NO: 15192 - DNA, 20 bp, synthetic construct
  misc_feature 1..20: note = CRISPR gRNA sequence
  source 1..20: mol_type = other DNA
cacggcaacctccacctcct

SEQ ID NO: 15193 - DNA, 20 bp, synthetic construct
  misc_feature 1..20: note = CRISPR gRNA sequence
  source 1..20: mol_type = other DNA
caacctccacctcctgggtt

SEQ ID NO: 15194 - DNA, 20 bp, synthetic construct
  misc_feature 1..20: note = CRISPR gRNA sequence
  source 1..20: mol_type = other DNA
aacctccacctcctgggttt

SEQ ID NO: 15195 - DNA, 20 bp, synthetic construct
  misc_feature 1..20: note = CRISPR gRNA sequence
  source 1..20: mol_type = other DNA
tttaggcgattctcctgcct

SEQ ID NO: 15196 - DNA, 20 bp, synthetic construct
  misc_feature 1..20: note = CRISPR gRNA sequence
  source 1..20: mol_type = other DNA
ttctcctgcctcggcctgcc

SEQ ID NO: 15197 - DNA, 20 bp, synthetic construct
  misc_feature 1..20: note = CRISPR gRNA sequence
  source 1..20: mol_type = other DNA
tcctgcctcggcctgccaag

SEQ ID NO: 15198 - DNA, 20 bp, synthetic construct
  misc_feature 1..20: note = CRISPR gRNA sequence
  source 1..20: mol_type = other DNA
gcctcggcctgccaagtagc

SEQ ID NO: 15199 - DNA, 20 bp, synthetic construct
  misc_feature 1..20: note = CRISPR gRNA sequence
  source 1..20: mol_type = other DNA
cctcggcctgccaagtagct

SEQ ID NO: 15200 - DNA, 20 bp, synthetic construct
  misc_feature 1..20: note = CRISPR gRNA sequence
  source 1..20: mol_type = other DNA
ctgccaagtagctgggatta

SEQ ID NO: 15201 - DNA, 20 bp, synthetic construct
  misc_feature 1..20: note = CRISPR gRNA sequence
  source 1..20: mol_type = other DNA
tgccaagtagctgggattac

SEQ ID NO: 15202 - DNA, 20 bp, synthetic construct
  misc_feature 1..20: note = CRISPR gRNA sequence
  source 1..20: mol_type = other DNA
caggcacccactaccacgtc

SEQ ID NO: 15203 - DNA, 20 bp, synthetic construct
  misc_feature 1..20: note = CRISPR gRNA sequence
  source 1..20: mol_type = other DNA
ctaatttttgtattttttaa

SEQ ID NO: 15204 - DNA, 20 bp, synthetic construct
  misc_feature 1..20: note = CRISPR gRNA sequence
  source 1..20: mol_type = other DNA
aatttttgtattttttaatg

SEQ ID NO: 15205 - DNA, 20 bp, synthetic construct
  misc_feature 1..20: note = CRISPR gRNA sequence
  source 1..20: mol_type = other DNA
tttgtattttttaatggaga

SEQ ID NO: 15206 - DNA, 20 bp, synthetic construct
  misc_feature 1..20: note = CRISPR gRNA sequence
  source 1..20: mol_type = other DNA
ttgtattttttaatggagac

SEQ ID NO: 15207 - DNA, 20 bp, synthetic construct
  misc_feature 1..20: note = CRISPR gRNA sequence
  source 1..20: mol_type = other DNA
tgtattttttaatggagacg

SEQ ID NO: 15208 - DNA, 20 bp, synthetic construct
  misc_feature 1..20: note = CRISPR gRNA sequence
  source 1..20: mol_type = other DNA
gagacggggtttcactatgt

SEQ ID NO: 15209 - DNA, 20 bp, synthetic construct
  misc_feature 1..20: note = CRISPR gRNA sequence
  source 1..20: mol_type = other DNA
cggggtttcactatgttggc

SEQ ID NO: 15210 - DNA, 20 bp, synthetic construct
  misc_feature 1..20: note = CRISPR gRNA sequence
  source 1..20: mol_type = other DNA
ggggtttcactatgttggcc

SEQ ID NO: 15211 - DNA, 20 bp, synthetic construct
  misc_feature 1..20: note = CRISPR gRNA sequence
  source 1..20: mol_type = other DNA
tttcactatgttggccaggc

SEQ ID NO: 15212 - DNA, 20 bp, synthetic construct
  misc_feature 1..20: note = CRISPR gRNA sequence
  source 1..20: mol_type = other DNA
tggtctcgaactcctgacct

SEQ ID NO: 15213 - DNA, 20 bp, synthetic construct
  misc_feature 1..20: note = CRISPR gRNA sequence
  source 1..20: mol_type = other DNA
ggtctcgaactcctgacctc

SEQ ID NO: 15214 - DNA, 20 bp, synthetic construct
  misc_feature 1..20: note = CRISPR gRNA sequence
  source 1..20: mol_type = other DNA
ctcaggtgatccacctgcct

SEQ ID NO: 15215 - DNA, 20 bp, synthetic construct
  misc_feature 1..20: note = CRISPR gRNA sequence
  source 1..20: mol_type = other DNA
ccacctgccttggcctccca

SEQ ID NO: 15216 - DNA, 20 bp, synthetic construct
  misc_feature 1..20: note = CRISPR gRNA sequence
  source 1..20: mol_type = other DNA
gccttggcctcccaaagtgc

SEQ ID NO: 15217 - DNA, 20 bp, synthetic construct
  misc_feature 1..20: note = CRISPR gRNA sequence
  source 1..20: mol_type = other DNA
ccttggcctcccaaagtgct

SEQ ID NO: 15218 - DNA, 20 bp, synthetic construct
  misc_feature 1..20: note = CRISPR gRNA sequence
  source 1..20: mol_type = other DNA
ctcccaaagtgctgggatta

SEQ ID NO: 15219 - DNA, 20 bp, synthetic construct
  misc_feature 1..20: note = CRISPR gRNA sequence
  source 1..20: mol_type = other DNA
tcccaaagtgctgggattac

SEQ ID NO: 15220 - DNA, 20 bp, synthetic construct
  misc_feature 1..20: note = CRISPR gRNA sequence
  source 1..20: mol_type = other DNA
agtgctgggattacaggcat

SEQ ID NO: 15221 - DNA, 20 bp, synthetic construct
  misc_feature 1..20: note = CRISPR gRNA sequence
  source 1..20: mol_type = other DNA
gtgctgggattacaggcata

SEQ ID NO: 15222 - DNA, 20 bp, synthetic construct
  misc_feature 1..20: note = CRISPR gRNA sequence
  source 1..20: mol_type = other DNA
caggcataaggcaccatgca

SEQ ID NO: 15223 - DNA, 20 bp, synthetic construct
  misc_feature 1..20: note = CRISPR gRNA sequence
  source 1..20: mol_type = other DNA
cattccttcatttactcact

SEQ ID NO: 15224 - DNA, 20 bp, synthetic construct
  misc_feature 1..20: note = CRISPR gRNA sequence
  source 1..20: mol_type = other DNA
tgatcactactcactcacca

SEQ ID NO: 15225 - DNA, 20 bp, synthetic construct
  misc_feature 1..20: note = CRISPR gRNA sequence
  source 1..20: mol_type = other DNA
gatcactactcactcaccat

SEQ ID NO: 15226 - DNA, 20 bp, synthetic construct
  misc_feature 1..20: note = CRISPR gRNA sequence
  source 1..20: mol_type = other DNA
atcactactcactcaccatg

SEQ ID NO: 15227 - DNA, 20 bp, synthetic construct
  misc_feature 1..20: note = CRISPR gRNA sequence
  source 1..20: mol_type = other DNA
cactactcactcaccatggg

SEQ ID NO: 15228 - DNA, 20 bp, synthetic construct
  misc_feature 1..20: note = CRISPR gRNA sequence
  source 1..20: mol_type = other DNA
actactcactcaccatgggg

SEQ ID NO: 15229 - DNA, 20 bp, synthetic construct
  misc_feature 1..20: note = CRISPR gRNA sequence
  source 1..20: mol_type = other DNA
cactcaccatggggaggtca

SEQ ID NO: 15230 - DNA, 20 bp, synthetic construct
  misc_feature 1..20: note = CRISPR gRNA sequence
  source 1..20: mol_type = other DNA
actcaccatggggaggtcat

SEQ ID NO: 15231 - DNA, 20 bp, synthetic construct
  misc_feature 1..20: note = CRISPR gRNA sequence
  source 1..20: mol_type = other DNA
tcaccatggggaggtcatgg

SEQ ID NO: 15232 - DNA, 20 bp, synthetic construct
  misc_feature 1..20: note = CRISPR gRNA sequence
  source 1..20: mol_type = other DNA
caccatggggaggtcatggg

SEQ ID NO: 15233 - DNA, 20 bp, synthetic construct
  misc_feature 1..20: note = CRISPR gRNA sequence
  source 1..20: mol_type = other DNA
accatggggaggtcatggga

SEQ ID NO: 15234 - DNA, 20 bp, synthetic construct
  misc_feature 1..20: note = CRISPR gRNA sequence
  source 1..20: mol_type = other DNA
catggggaggtcatgggagg

SEQ ID NO: 15235 - DNA, 20 bp, synthetic construct
  misc_feature 1..20: note = CRISPR gRNA sequence
  source 1..20: mol_type = other DNA
aggtcatgggagggagtgtt

SEQ ID NO: 15236 - DNA, 20 bp, synthetic construct
  misc_feature 1..20: note = CRISPR gRNA sequence
  source 1..20: mol_type = other DNA
gtcatgggagggagtgttaa

SEQ ID NO: 15237 - DNA, 20 bp, synthetic construct
  misc_feature 1..20: note = CRISPR gRNA sequence
  source 1..20: mol_type = other DNA
gggagggagtgttaagagtt

SEQ ID NO: 15238 - DNA, 20 bp, synthetic construct
  misc_feature 1..20: note = CRISPR gRNA sequence
  source 1..20: mol_type = other DNA
gggagtgttaagagttaaga

SEQ ID NO: 15239 - DNA, 20 bp, synthetic construct
  misc_feature 1..20: note = CRISPR gRNA sequence
  source 1..20: mol_type = other DNA
agtgttaagagttaagacag

SEQ ID NO: 15240 - DNA, 20 bp, synthetic construct
  misc_feature 1..20: note = CRISPR gRNA sequence
  source 1..20: mol_type = other DNA
tgttaagagttaagacagtg

SEQ ID NO: 15241 - DNA, 20 bp, synthetic construct
  misc_feature 1..20: note = CRISPR gRNA sequence
  source 1..20: mol_type = other DNA
gacagtggagcccacgtgtc

SEQ ID NO: 15242 - DNA, 20 bp, synthetic construct
  misc_feature 1..20: note = CRISPR gRNA sequence
  source 1..20: mol_type = other DNA
acagtggagcccacgtgtct

SEQ ID NO: 15243 - DNA, 20 bp, synthetic construct
  misc_feature 1..20: note = CRISPR gRNA sequence
  source 1..20: mol_type = other DNA
acgtgtctgggttcaaatcc

SEQ ID NO: 15244 - DNA, 20 bp, synthetic construct
  misc_feature 1..20: note = CRISPR gRNA sequence
  source 1..20: mol_type = other DNA
atcccggttctaccacttgc

SEQ ID NO: 15245 - DNA, 20 bp, synthetic construct
  misc_feature 1..20: note = CRISPR gRNA sequence
  source 1..20: mol_type = other DNA
cccggttctaccacttgctg

SEQ ID NO: 15246 - DNA, 20 bp, synthetic construct
  misc_feature 1..20: note = CRISPR gRNA sequence
  source 1..20: mol_type = other DNA
ccacttgctggagcaattct

SEQ ID NO: 15247 - DNA, 20 bp, synthetic construct
  misc_feature 1..20: note = CRISPR gRNA sequence
  source 1..20: mol_type = other DNA
ctatacatcccaccatgcct

SEQ ID NO: 15248 - DNA, 20 bp, synthetic construct
  misc_feature 1..20: note = CRISPR gRNA sequence
  source 1..20: mol_type = other DNA
tacatcccaccatgcctcag

SEQ ID NO: 15249 - DNA, 20 bp, synthetic construct
  misc_feature 1..20: note = CRISPR gRNA sequence
  source 1..20: mol_type = other DNA
catgcctcagtagcctcatc

SEQ ID NO: 15250 - DNA, 20 bp, synthetic construct
  misc_feature 1..20: note = CRISPR gRNA sequence
  source 1..20: mol_type = other DNA
cagtagcctcatctggaaaa

SEQ ID NO: 15251 - DNA, 20 bp, synthetic construct
  misc_feature 1..20: note = CRISPR gRNA sequence
  source 1..20: mol_type = other DNA
agtagcctcatctggaaaat

SEQ ID NO: 15252 - DNA, 20 bp, synthetic construct
  misc_feature 1..20: note = CRISPR gRNA sequence
  source 1..20: mol_type = other DNA
gtagcctcatctggaaaatg

SEQ ID NO: 15253 - DNA, 20 bp, synthetic construct
  misc_feature 1..20: note = CRISPR gRNA sequence
  source 1..20: mol_type = other DNA
ctggaaaatggggataatat

SEQ ID NO: 15254 - DNA, 20 bp, synthetic construct
  misc_feature 1..20: note = CRISPR gRNA sequence
  source 1..20: mol_type = other DNA
tggaaaatggggataatatt

SEQ ID NO: 15255 - DNA, 20 bp, synthetic construct
  misc_feature 1..20: note = CRISPR gRNA sequence
  source 1..20: mol_type = other DNA
ggataatattgggattgtgt

SEQ ID NO: 15256 - DNA, 20 bp, synthetic construct
  misc_feature 1..20: note = CRISPR gRNA sequence
  source 1..20: mol_type = other DNA
tgtgtgagatgttaatgatt

SEQ ID NO: 15257 - DNA, 20 bp, synthetic construct
  misc_feature 1..20: note = CRISPR gRNA sequence
  source 1..20: mol_type = other DNA
tttagcatacctaacatgct

SEQ ID NO: 15258 - DNA, 20 bp, synthetic construct
  misc_feature 1..20: note = CRISPR gRNA sequence
  source 1..20: mol_type = other DNA
catacctaacatgcttagac

SEQ ID NO: 15259 - DNA, 20 bp, synthetic construct
  misc_feature 1..20: note = CRISPR gRNA sequence
  source 1..20: mol_type = other DNA
acatgcttagaccagtatgt

SEQ ID NO: 15260 - DNA, 20 bp, synthetic construct
  misc_feature 1..20: note = CRISPR gRNA sequence
  source 1..20: mol_type = other DNA
atgcttagaccagtatgtga

SEQ ID NO: 15261 - DNA, 20 bp, synthetic construct
  misc_feature 1..20: note = CRISPR gRNA sequence
  source 1..20: mol_type = other DNA
ttagaccagtatgtgagagt

SEQ ID NO: 15262 - DNA, 20 bp, synthetic construct
  misc_feature 1..20: note = CRISPR gRNA sequence
  source 1..20: mol_type = other DNA
agtatgtgagagtaagcatt

SEQ ID NO: 15263 - DNA, 20 bp, synthetic construct
  misc_feature 1..20: note = CRISPR gRNA sequence
  source 1..20: mol_type = other DNA
agagtaagcatttagtaatt

SEQ ID NO: 15264 - DNA, 20 bp, synthetic construct
  misc_feature 1..20: note = CRISPR gRNA sequence
  source 1..20: mol_type = other DNA
ttagtaattctcttattcac

SEQ ID NO: 15265 - DNA, 20 bp, synthetic construct
  misc_feature 1..20: note = CRISPR gRNA sequence
  source 1..20: mol_type = other DNA
ttgcccctcattcattctct

SEQ ID NO: 15266 - DNA, 20 bp, synthetic construct
  misc_feature 1..20: note = CRISPR gRNA sequence
  source 1..20: mol_type = other DNA
attctctcagcctgacaatg

SEQ ID NO: 15267 - DNA, 20 bp, synthetic construct
  misc_feature 1..20: note = CRISPR gRNA sequence
  source 1..20: mol_type = other DNA
gacaatgaagtgttaacacc

SEQ ID NO: 15268 - DNA, 20 bp, synthetic construct
  misc_feature 1..20: note = CRISPR gRNA sequence
  source 1..20: mol_type = other DNA
tgaagtgttaacacccagtg

SEQ ID NO: 15269 - DNA, 20 bp, synthetic construct
  misc_feature 1..20: note = CRISPR gRNA sequence
  source 1..20: mol_type = other DNA
gaagtgttaacacccagtgc

SEQ ID NO: 15270 - DNA, 20 bp, synthetic construct
  misc_feature 1..20: note = CRISPR gRNA sequence
  source 1..20: mol_type = other DNA
cacccagtgcaggcttattg

SEQ ID NO: 15271 - DNA, 20 bp, synthetic construct
  misc_feature 1..20: note = CRISPR gRNA sequence
  source 1..20: mol_type = other DNA
acccagtgcaggcttattga

SEQ ID NO: 15272 - DNA, 20 bp, synthetic construct
  misc_feature 1..20: note = CRISPR gRNA sequence
  source 1..20: mol_type = other DNA
cccagtgcaggcttattgaa

SEQ ID NO: 15273 - DNA, 20 bp, synthetic construct
  misc_feature 1..20: note = CRISPR gRNA sequence
  source 1..20: mol_type = other DNA
aagggcaataaatattattt

SEQ ID NO: 15274 - DNA, 20 bp, synthetic construct
  misc_feature 1..20: note = CRISPR gRNA sequence
  source 1..20: mol_type = other DNA
agggcaataaatattatttg

SEQ ID NO: 15275 - DNA, 20 bp, synthetic construct
  misc_feature 1..20: note = CRISPR gRNA sequence
  source 1..20: mol_type = other DNA
gggcaataaatattatttga

SEQ ID NO: 15276 - DNA, 20 bp, synthetic construct
  misc_feature 1..20: note = CRISPR gRNA sequence
  source 1..20: mol_type = other DNA
gcaataaatattatttgagg

SEQ ID NO: 15277 - DNA, 20 bp, synthetic construct
  misc_feature 1..20: note = CRISPR gRNA sequence
  source 1..20: mol_type = other DNA
ataaatattatttgagggag

SEQ ID NO: 15278 - DNA, 20 bp, synthetic construct
  misc_feature 1..20: note = CRISPR gRNA sequence
  source 1..20: mol_type = other DNA
aatattatttgagggagtgg

SEQ ID NO: 15279 - DNA, 20 bp, synthetic construct
  misc_feature 1..20: note = CRISPR gRNA sequence
  source 1..20: mol_type = other DNA
tattatttgagggagtggtg

SEQ ID NO: 15280 - DNA, 20 bp, synthetic construct
  misc_feature 1..20: note = CRISPR gRNA sequence
  source 1..20: mol_type = other DNA
tgagggagtggtggagtgaa

SEQ ID NO: 15281 - DNA, 20 bp, synthetic construct
  misc_feature 1..20: note = CRISPR gRNA sequence
  source 1..20: mol_type = other DNA
tggagtgaatggtgaaatga

SEQ ID NO: 15282 - DNA, 20 bp, synthetic construct
  misc_feature 1..20: note = CRISPR gRNA sequence
  source 1..20: mol_type = other DNA
aaatgatggcataatcaaat

SEQ ID NO: 15283 - DNA, 20 bp, synthetic construct
  misc_feature 1..20: note = CRISPR gRNA sequence
  source 1..20: mol_type = other DNA
gaatgaatgaataaataaat

SEQ ID NO: 15284 - DNA, 20 bp, synthetic construct
  misc_feature 1..20: note = CRISPR gRNA sequence
  source 1..20: mol_type = other DNA
gaataaataaatgagtgtgt

SEQ ID NO: 15285 - DNA, 20 bp, synthetic construct
  misc_feature 1..20: note = CRISPR gRNA sequence
  source 1..20: mol_type = other DNA
aatgagtgtgtgagccaaca

SEQ ID NO: 15286 - DNA, 20 bp, synthetic construct
  misc_feature 1..20: note = CRISPR gRNA sequence
  source 1..20: mol_type = other DNA
gagtgtgtgagccaacaaag

SEQ ID NO: 15287 - DNA, 20 bp, synthetic construct
  misc_feature 1..20: note = CRISPR gRNA sequence
  source 1..20: mol_type = other DNA
agtgtgtgagccaacaaaga

SEQ ID NO: 15288 - DNA, 20 bp, synthetic construct
  misc_feature 1..20: note = CRISPR gRNA sequence
  source 1..20: mol_type = other DNA
gtgtgtgagccaacaaagaa

SEQ ID NO: 15289 - DNA, 20 bp, synthetic construct
  misc_feature 1..20: note = CRISPR gRNA sequence
  source 1..20: mol_type = other DNA
tgtgtgagccaacaaagaag

SEQ ID NO: 15290 - DNA, 20 bp, synthetic construct
  misc_feature 1..20: note = CRISPR gRNA sequence
  source 1..20: mol_type = other DNA
caacaaagaaggggttgaat

SEQ ID NO: 15291 - DNA, 20 bp, synthetic construct
  misc_feature 1..20: note = CRISPR gRNA sequence
  source 1..20: mol_type = other DNA
gaaggggttgaataagtgtc

SEQ ID NO: 15292 - DNA, 20 bp, synthetic construct
  misc_feature 1..20: note = CRISPR gRNA sequence
  source 1..20: mol_type = other DNA
tgaataagtgtcaagtgaat

SEQ ID NO: 15293 - DNA, 20 bp, synthetic construct
  misc_feature 1..20: note = CRISPR gRNA sequence
  source 1..20: mol_type = other DNA
tcaagtgaatgagcaatgtg

SEQ ID NO: 15294 - DNA, 20 bp, synthetic construct
  misc_feature 1..20: note = CRISPR gRNA sequence
  source 1..20: mol_type = other DNA
gtgaatgagcaatgtgaagc

SEQ ID NO: 15295 - DNA, 20 bp, synthetic construct
  misc_feature 1..20: note = CRISPR gRNA sequence
  source 1..20: mol_type = other DNA
gagcaatgtgaagccagata

SEQ ID NO: 15296 - DNA, 20 bp, synthetic construct
  misc_feature 1..20: note = CRISPR gRNA sequence
  source 1..20: mol_type = other DNA
agcaatgtgaagccagatat

SEQ ID NO: 15297 - DNA, 20 bp, synthetic construct
  misc_feature 1..20: note = CRISPR gRNA sequence
  source 1..20: mol_type = other DNA
gggcttccatctccaccacc

SEQ ID NO: 15298 - DNA, 20 bp, synthetic construct
  misc_feature 1..20: note = CRISPR gRNA sequence
  source 1..20: mol_type = other DNA
ggcttccatctccaccaccc

SEQ ID NO: 15299 - DNA, 20 bp, synthetic construct
  misc_feature 1..20: note = CRISPR gRNA sequence
  source 1..20: mol_type = other DNA
gcttccatctccaccaccca

SEQ ID NO: 15300 - DNA, 20 bp, synthetic construct
  misc_feature 1..20: note = CRISPR gRNA sequence
  source 1..20: mol_type = other DNA
tccatctccaccacccaggg

SEQ ID NO: 15301 - DNA, 20 bp, synthetic construct
  misc_feature 1..20: note = CRISPR gRNA sequence
  source 1..20: mol_type = other DNA
catctccaccacccagggca

SEQ ID NO: 15302 - DNA, 20 bp, synthetic construct
  misc_feature 1..20: note = CRISPR gRNA sequence
  source 1..20: mol_type = other DNA
tctccaccacccagggcaga

SEQ ID NO: 15303 - DNA, 20 bp, synthetic construct
  misc_feature 1..20: note = CRISPR gRNA sequence
  source 1..20: mol_type = other DNA
agagatcccgcatcactcac

SEQ ID NO: 15304 - DNA, 20 bp, synthetic construct
  misc_feature 1..20: note = CRISPR gRNA sequence
  source 1..20: mol_type = other DNA
gagatcccgcatcactcacc

SEQ ID NO: 15305 - DNA, 20 bp, synthetic construct
  misc_feature 1..20: note = CRISPR gRNA sequence
  source 1..20: mol_type = other DNA
catcactcaccaggccattt

SEQ ID NO: 15306 - DNA, 20 bp, synthetic construct
  misc_feature 1..20: note = CRISPR gRNA sequence
  source 1..20: mol_type = other DNA
cactcaccaggccattttgg

SEQ ID NO: 15307 - DNA, 20 bp, synthetic construct
  misc_feature 1..20: note = CRISPR gRNA sequence
  source 1..20: mol_type = other DNA
aggccattttggaagcttgt

SEQ ID NO: 15308 - DNA, 20 bp, synthetic construct
  misc_feature 1..20: note = CRISPR gRNA sequence
  source 1..20: mol_type = other DNA
gccattttggaagcttgttg

SEQ ID NO: 15309 - DNA, 20 bp, synthetic construct
  misc_feature 1..20: note = CRISPR gRNA sequence
  source 1..20: mol_type = other DNA
aagcttgttggagacctctc

SEQ ID NO: 15310 - DNA, 20 bp, synthetic construct
  misc_feature 1..20: note = CRISPR gRNA sequence
  source 1..20: mol_type = other DNA
ttggagacctctccagctgc

SEQ ID NO: 15311 - DNA, 20 bp, synthetic construct
  misc_feature 1..20: note = CRISPR gRNA sequence
  source 1..20: mol_type = other DNA
tggagacctctccagctgcc

SEQ ID NO: 15312 - DNA, 20 bp, synthetic construct
  misc_feature 1..20: note = CRISPR gRNA sequence
  source 1..20: mol_type = other DNA
cctctccagctgccgggcat

SEQ ID NO: 15313 - DNA, 20 bp, synthetic construct
  misc_feature 1..20: note = CRISPR gRNA sequence
  source 1..20: mol_type = other DNA
ctctccagctgccgggcatt

SEQ ID NO: 15314 - DNA, 20 bp, synthetic construct
  misc_feature 1..20: note = CRISPR gRNA sequence
  source 1..20: mol_type = other DNA
tccagctgccgggcattggg

SEQ ID NO: 15315 - DNA, 20 bp, synthetic construct
  misc_feature 1..20: note = CRISPR gRNA sequence
  source 1..20: mol_type = other DNA
ccagctgccgggcattgggt

SEQ ID NO: 15316 - DNA, 20 bp, synthetic construct
  misc_feature 1..20: note = CRISPR gRNA sequence
  source 1..20: mol_type = other DNA
cagctgccgggcattgggtg

SEQ ID NO: 15317 - DNA, 20 bp, synthetic construct
  misc_feature 1..20: note = CRISPR gRNA sequence
  source 1..20: mol_type = other DNA
agctgccgggcattgggtgg

SEQ ID NO: 15318 - DNA, 20 bp, synthetic construct
  misc_feature 1..20: note = CRISPR gRNA sequence
  source 1..20: mol_type = other DNA
gtgggggacgtcttgtgctc

SEQ ID NO: 15319 - DNA, 20 bp, synthetic construct
  misc_feature 1..20: note = CRISPR gRNA sequence
  source 1..20: mol_type = other DNA
gggggacgtcttgtgctctg

SEQ ID NO: 15320 - DNA, 20 bp, synthetic construct
  misc_feature 1..20: note = CRISPR gRNA sequence
  source 1..20: mol_type = other DNA
gacgtcttgtgctctggaga

SEQ ID NO: 15321 - DNA, 20 bp, synthetic construct
  misc_feature 1..20: note = CRISPR gRNA sequence
  source 1..20: mol_type = other DNA
cgtcttgtgctctggagatg

SEQ ID NO: 15322 - DNA, 20 bp, synthetic construct
  misc_feature 1..20: note = CRISPR gRNA sequence
  source 1..20: mol_type = other DNA
cttgtgctctggagatggag

SEQ ID NO: 15323 - DNA, 20 bp, synthetic construct
  misc_feature 1..20: note = CRISPR gRNA sequence
  source 1..20: mol_type = other DNA
gtgctctggagatggagaag

SEQ ID NO: 15324 - DNA, 20 bp, synthetic construct
  misc_feature 1..20: note = CRISPR gRNA sequence
  source 1..20: mol_type = other DNA
tgctctggagatggagaagc

SEQ ID NO: 15325 - DNA, 20 bp, synthetic construct
  misc_feature 1..20: note = CRISPR gRNA sequence
  source 1..20: mol_type = other DNA
ggagatggagaagcaggtgc

SEQ ID NO: 15326 - DNA, 20 bp, synthetic construct
  misc_feature 1..20: note = CRISPR gRNA sequence
  source 1..20: mol_type = other DNA
ggagaagcaggtgccagatt

SEQ ID NO: 15327 - DNA, 20 bp, synthetic construct
  misc_feature 1..20: note = CRISPR gRNA sequence
  source 1..20: mol_type = other DNA
gagaagcaggtgccagattt

SEQ ID NO: 15328 - DNA, 20 bp, synthetic construct
  misc_feature 1..20: note = CRISPR gRNA sequence
  source 1..20: mol_type = other DNA
agaagcaggtgccagattta

SEQ ID NO: 15329 - DNA, 20 bp, synthetic construct
  misc_feature 1..20: note = CRISPR gRNA sequence
  source 1..20: mol_type = other DNA
gcaggtgccagatttagggt

SEQ ID NO: 15330 - DNA, 20 bp, synthetic construct
  misc_feature 1..20: note = CRISPR gRNA sequence
  source 1..20: mol_type = other DNA
caggtgccagatttagggtg

SEQ ID NO: 15331 - DNA, 20 bp, synthetic construct
  misc_feature 1..20: note = CRISPR gRNA sequence
  source 1..20: mol_type = other DNA
aggtgccagatttagggtga

SEQ ID NO: 15332 - DNA, 20 bp, synthetic construct
  misc_feature 1..20: note = CRISPR gRNA sequence
  source 1..20: mol_type = other DNA
tttagggtgagggttacccc

SEQ ID NO: 15333 - DNA, 20 bp, synthetic construct
  misc_feature 1..20: note = CRISPR gRNA sequence
  source 1..20: mol_type = other DNA
ttagggtgagggttacccct

SEQ ID NO: 15334 - DNA, 20 bp, synthetic construct
  misc_feature 1..20: note = CRISPR gRNA sequence
  source 1..20: mol_type = other DNA
tagggtgagggttacccctg

SEQ ID NO: 15335 - DNA, 20 bp, synthetic construct
  misc_feature 1..20: note = CRISPR gRNA sequence
  source 1..20: mol_type = other DNA
cctggggacccccctccctc

SEQ ID NO: 15336 - DNA, 20 bp, synthetic construct
  misc_feature 1..20: note = CRISPR gRNA sequence
  source 1..20: mol_type = other DNA
ctggggacccccctccctct

SEQ ID NO: 15337 - DNA, 20 bp, synthetic construct
  misc_feature 1..20: note = CRISPR gRNA sequence
  source 1..20: mol_type = other DNA
ccccctccctctgggccact

SEQ ID NO: 15338 - DNA, 20 bp, synthetic construct
  misc_feature 1..20: note = CRISPR gRNA sequence
  source 1..20: mol_type = other DNA
tctgggccacttagtcctta

SEQ ID NO: 15339 - DNA, 20 bp, synthetic construct
  misc_feature 1..20: note = CRISPR gRNA sequence
  source 1..20: mol_type = other DNA
cttagtccttacagccttca

SEQ ID NO: 15340 - DNA, 20 bp, synthetic construct
  misc_feature 1..20: note = CRISPR gRNA sequence
  source 1..20: mol_type = other DNA
ttagtccttacagccttcat

SEQ ID NO: 15341 - DNA, 20 bp, synthetic construct
  misc_feature 1..20: note = CRISPR gRNA sequence
  source 1..20: mol_type = other DNA
ccttacagccttcatgggct

SEQ ID NO: 15342 - DNA, 20 bp, synthetic construct
  misc_feature 1..20: note = CRISPR gRNA sequence
  source 1..20: mol_type = other DNA
cttcatgggctgagtttccc

SEQ ID NO: 15343 - DNA, 20 bp, synthetic construct
  misc_feature 1..20: note = CRISPR gRNA sequence
  source 1..20: mol_type = other DNA
atgggctgagtttcccaaga

SEQ ID NO: 15344 - DNA, 20 bp, synthetic construct
  misc_feature 1..20: note = CRISPR gRNA sequence
  source 1..20: mol_type = other DNA
gggctgagtttcccaagatg

SEQ ID NO: 15345 - DNA, 20 bp, synthetic construct
  misc_feature 1..20: note = CRISPR gRNA sequence
  source 1..20: mol_type = other DNA
ggctgagtttcccaagatgg

SEQ ID NO: 15346 - DNA, 20 bp, synthetic construct
  misc_feature 1..20: note = CRISPR gRNA sequence
  source 1..20: mol_type = other DNA
tttcccaagatggaggttat

SEQ ID NO: 15347 - DNA, 20 bp, synthetic construct
  misc_feature 1..20: note = CRISPR gRNA sequence
  source 1..20: mol_type = other DNA
ccaagatggaggttataaga

SEQ ID NO: 15348 - DNA, 20 bp, synthetic construct
  misc_feature 1..20: note = CRISPR gRNA sequence
  source 1..20: mol_type = other DNA
agatggaggttataagatag

SEQ ID NO: 15349 - DNA, 20 bp, synthetic construct
  misc_feature 1..20: note = CRISPR gRNA sequence
  source 1..20: mol_type = other DNA
aggttataagatagcggcct

SEQ ID NO: 15350 - DNA, 20 bp, synthetic construct
  misc_feature 1..20: note = CRISPR gRNA sequence
  source 1..20: mol_type = other DNA
ggttataagatagcggcctg

SEQ ID NO: 15351 - DNA, 20 bp, synthetic construct
  misc_feature 1..20: note = CRISPR gRNA sequence
  source 1..20: mol_type = other DNA
aactcaaatatgtctttctt

SEQ ID NO: 15352 - DNA, 20 bp, synthetic construct
  misc_feature 1..20: note = CRISPR gRNA sequence
  source 1..20: mol_type = other DNA
aatttcactcatgtttaaaa

SEQ ID NO: 15353 - DNA, 20 bp, synthetic construct
  misc_feature 1..20: note = CRISPR gRNA sequence
  source 1..20: mol_type = other DNA
aaaaaagaaaatcgcaatat

SEQ ID NO: 15354 - DNA, 20 bp, synthetic construct
  misc_feature 1..20: note = CRISPR gRNA sequence
  source 1..20: mol_type = other DNA
aaaaagaaaatcgcaatatc

SEQ ID NO: 15355 - DNA, 20 bp, synthetic construct
  misc_feature 1..20: note = CRISPR gRNA sequence
  source 1..20: mol_type = other DNA
agaaaatcgcaatatcaggc

SEQ ID NO: 15356 - DNA, 20 bp, synthetic construct
  misc_feature 1..20: note = CRISPR gRNA sequence
  source 1..20: mol_type = other DNA
gaaaatcgcaatatcaggct

SEQ ID NO: 15357 - DNA, 20 bp, synthetic construct
  misc_feature 1..20: note = CRISPR gRNA sequence
  source 1..20: mol_type = other DNA
tcgcaatatcaggctgggtg

SEQ ID NO: 15358 - DNA, 20 bp, synthetic construct
  misc_feature 1..20: note = CRISPR gRNA sequence
  source 1..20: mol_type = other DNA
caatatcaggctgggtgcag

SEQ ID NO: 15359 - DNA, 20 bp, synthetic construct
  misc_feature 1..20: note = CRISPR gRNA sequence
  source 1..20: mol_type = other DNA
gtggctcacacctgtaatcc

SEQ ID NO: 15360 - DNA, 20 bp, synthetic construct
  misc_feature 1..20: note = CRISPR gRNA sequence
  source 1..20: mol_type = other DNA
cacctgtaatcccagcactt

SEQ ID NO: 15361 - DNA, 20 bp, synthetic construct
  misc_feature 1..20: note = CRISPR gRNA sequence
  source 1..20: mol_type = other DNA
acctgtaatcccagcacttt

SEQ ID NO: 15362 - DNA, 20 bp, synthetic construct
  misc_feature 1..20: note = CRISPR gRNA sequence
  source 1..20: mol_type = other DNA
ctgtaatcccagcactttgg

SEQ ID NO: 15363 - DNA, 20 bp, synthetic construct
  misc_feature 1..20: note = CRISPR gRNA sequence
  source 1..20: mol_type = other DNA
tgtaatcccagcactttggg

SEQ ID NO: 15364 - DNA, 20 bp, synthetic construct
  misc_feature 1..20: note = CRISPR gRNA sequence
  source 1..20: mol_type = other DNA
tcccagcactttgggaggtc

SEQ ID NO: 15365 - DNA, 20 bp, synthetic construct
  misc_feature 1..20: note = CRISPR gRNA sequence
  source 1..20: mol_type = other DNA
cccagcactttgggaggtcg

SEQ ID NO: 15366 - DNA, 20 bp, synthetic construct
  misc_feature 1..20: note = CRISPR gRNA sequence
  source 1..20: mol_type = other DNA
agcactttgggaggtcgagg

SEQ ID NO: 15367 - DNA, 20 bp, synthetic construct
  misc_feature 1..20: note = CRISPR gRNA sequence
  source 1..20: mol_type = other DNA
gcactttgggaggtcgaggc

SEQ ID NO: 15368 - DNA, 20 bp, synthetic construct
  misc_feature 1..20: note = CRISPR gRNA sequence
  source 1..20: mol_type = other DNA
ctttgggaggtcgaggcagg

SEQ ID NO: 15369 - DNA, 20 bp, synthetic construct
  misc_feature 1..20: note = CRISPR gRNA sequence
  source 1..20: mol_type = other DNA
tcgaggcaggtggatcactt

SEQ ID NO: 15370 - DNA, 20 bp, synthetic construct
  misc_feature 1..20: note = CRISPR gRNA sequence
  source 1..20: mol_type = other DNA
gcaggtggatcacttgagat

SEQ ID NO: 15371 - DNA, 20 bp, synthetic construct
  misc_feature 1..20: note = CRISPR gRNA sequence
  source 1..20: mol_type = other DNA
caggtggatcacttgagatc

SEQ ID NO: 15372 - DNA, 20 bp, synthetic construct
  misc_feature 1..20: note = CRISPR gRNA sequence
  source 1..20: mol_type = other DNA
ggtggatcacttgagatcag

SEQ ID NO: 15373 - DNA, 20 bp, synthetic construct
  misc_feature 1..20: note = CRISPR gRNA sequence
  source 1..20: mol_type = other DNA
tcacttgagatcaggagttc

SEQ ID NO: 15374 - DNA, 20 bp, synthetic construct
  misc_feature 1..20: note = CRISPR gRNA sequence
  source 1..20: mol_type = other DNA
tgagatcaggagttcgagac

SEQ ID NO: 15375 - DNA, 20 bp, synthetic construct
  misc_feature 1..20: note = CRISPR gRNA sequence
  source 1..20: mol_type = other DNA
tcaggagttcgagaccagcc

SEQ ID NO: 15376 - DNA, 20 bp, synthetic construct
  misc_feature 1..20: note = CRISPR gRNA sequence
  source 1..20: mol_type = other DNA
cgagaccagcctggccaaca

SEQ ID NO: 15377 - DNA, 20 bp, synthetic construct
  misc_feature 1..20: note = CRISPR gRNA sequence
  source 1..20: mol_type = other DNA
tctactgaaattacaaaaat

SEQ ID NO: 15378 - DNA, 20 bp, synthetic construct
  misc_feature 1..20: note = CRISPR gRNA sequence
  source 1..20: mol_type = other DNA
ctgaaattacaaaaattggc

SEQ ID NO: 15379 - DNA, 20 bp, synthetic construct
  misc_feature 1..20: note = CRISPR gRNA sequence
  source 1..20: mol_type = other DNA
tgaaattacaaaaattggct

SEQ ID NO: 15380 - DNA, 20 bp, synthetic construct
  misc_feature 1..20: note = CRISPR gRNA sequence
  source 1..20: mol_type = other DNA
caaaaattggctgggtgtga

SEQ ID NO: 15381 - DNA, 20 bp, synthetic construct
  misc_feature 1..20: note = CRISPR gRNA sequence
  source 1..20: mol_type = other DNA
acggtgcacacctgtaattc

SEQ ID NO: 15382 - DNA, 20 bp, synthetic construct
  misc_feature 1..20: note = CRISPR gRNA sequence
  source 1..20: mol_type = other DNA
acctgtaattccagctgctc

SEQ ID NO: 15383 - DNA, 20 bp, synthetic construct
  misc_feature 1..20: note = CRISPR gRNA sequence
  source 1..20: mol_type = other DNA
ctgtaattccagctgctccg

SEQ ID NO: 15384 - DNA, 20 bp, synthetic construct
  misc_feature 1..20: note = CRISPR gRNA sequence
  source 1..20: mol_type = other DNA
tgtaattccagctgctccgg

SEQ ID NO: 15385 - DNA, 20 bp, synthetic construct
  misc_feature 1..20: note = CRISPR gRNA sequence
  source 1..20: mol_type = other DNA
ttccagctgctccggaggct

SEQ ID NO: 15386 - DNA, 20 bp, synthetic construct
  misc_feature 1..20: note = CRISPR gRNA sequence
  source 1..20: mol_type = other DNA
tccagctgctccggaggctg

SEQ ID NO: 15387 - DNA, 20 bp, synthetic construct
  misc_feature 1..20: note = CRISPR gRNA sequence
  source 1..20: mol_type = other DNA
agctgctccggaggctgagg

SEQ ID NO: 15388 - DNA, 20 bp, synthetic construct
  misc_feature 1..20: note = CRISPR gRNA sequence
  source 1..20: mol_type = other DNA
gctgctccggaggctgaggc

SEQ ID NO: 15389 - DNA, 20 bp, synthetic construct
  misc_feature 1..20: note = CRISPR gRNA sequence
  source 1..20: mol_type = other DNA
tgctccggaggctgaggcag

SEQ ID NO: 15390 - DNA, 20 bp, synthetic construct
  misc_feature 1..20: note = CRISPR gRNA sequence
  source 1..20: mol_type = other DNA
aggagaatcacttgaacctg

SEQ ID NO: 15391 - DNA, 20 bp, synthetic construct
  misc_feature 1..20: note = CRISPR gRNA sequence
  source 1..20: mol_type = other DNA
ggagaatcacttgaacctgt

SEQ ID NO: 15392 - DNA, 20 bp, synthetic construct
  misc_feature 1..20: note = CRISPR gRNA sequence
  source 1..20: mol_type = other DNA
gagaatcacttgaacctgta

SEQ ID NO: 15393 - DNA, 20 bp, synthetic construct
  misc_feature 1..20: note = CRISPR gRNA sequence
  source 1..20: mol_type = other DNA
aatcacttgaacctgtaggg

SEQ ID NO: 15394 - DNA, 20 bp, synthetic construct
  misc_feature 1..20: note = CRISPR gRNA sequence
  source 1..20: mol_type = other DNA
tcacttgaacctgtagggcg

SEQ ID NO: 15395 - DNA, 20 bp, synthetic construct
  misc_feature 1..20: note = CRISPR gRNA sequence
  source 1..20: mol_type = other DNA
cacttgaacctgtagggcgg

SEQ ID NO: 15396 - DNA, 20 bp, synthetic construct
  misc_feature 1..20: note = CRISPR gRNA sequence
  source 1..20: mol_type = other DNA
aacctgtagggcggaggttg

SEQ ID NO: 15397 - DNA, 20 bp, synthetic construct
  misc_feature 1..20: note = CRISPR gRNA sequence
  source 1..20: mol_type = other DNA
ggcggaggttgcagtgatct

SEQ ID NO: 15398 - DNA, 20 bp, synthetic construct
  misc_feature 1..20: note = CRISPR gRNA sequence
  source 1..20: mol_type = other DNA
gagatcgcaccactgcactc

SEQ ID NO: 15399 - DNA, 20 bp, synthetic construct
  misc_feature 1..20: note = CRISPR gRNA sequence
  source 1..20: mol_type = other DNA
cgcaccactgcactctagcc

SEQ ID NO: 15400 - DNA, 20 bp, synthetic construct
  misc_feature 1..20: note = CRISPR gRNA sequence
  source 1..20: mol_type = other DNA
gcaccactgcactctagcct

SEQ ID NO: 15401 - DNA, 20 bp, synthetic construct
  misc_feature 1..20: note = CRISPR gRNA sequence
  source 1..20: mol_type = other DNA
ctgcactctagcctgggcaa

SEQ ID NO: 15402 - DNA, 20 bp, synthetic construct
  misc_feature 1..20: note = CRISPR gRNA sequence
  source 1..20: mol_type = other DNA
gcactctagcctgggcaaca

SEQ ID NO: 15403 - DNA, 20 bp, synthetic construct
  misc_feature 1..20: note = CRISPR gRNA sequence
  source 1..20: mol_type = other DNA
tctagcctgggcaacagagt

SEQ ID NO: 15404 - DNA, 20 bp, synthetic construct
  misc_feature 1..20: note = CRISPR gRNA sequence
  source 1..20: mol_type = other DNA
cacaatatctatgtaaaaat

SEQ ID NO: 15405 - DNA, 20 bp, synthetic construct
  misc_feature 1..20: note = CRISPR gRNA sequence
  source 1..20: mol_type = other DNA
acaatatctatgtaaaaatc

SEQ ID NO: 15406 - DNA, 20 bp, synthetic construct
  misc_feature 1..20: note = CRISPR gRNA sequence
  source 1..20: mol_type = other DNA
caatatctatgtaaaaatca

SEQ ID NO: 15407 - DNA, 20 bp, synthetic construct
  misc_feature 1..20: note = CRISPR gRNA sequence
  source 1..20: mol_type = other DNA
atcagggttttcaacttcaa

SEQ ID NO: 15408 - DNA, 20 bp, synthetic construct
  misc_feature 1..20: note = CRISPR gRNA sequence
  source 1..20: mol_type = other DNA
aaagatctgaccacattgtc

SEQ ID NO: 15409 - DNA, 20 bp, synthetic construct
  misc_feature 1..20: note = CRISPR gRNA sequence
  source 1..20: mol_type = other DNA
acattgtctggcttttctgc

SEQ ID NO: 15410 - DNA, 20 bp, synthetic construct
  misc_feature 1..20: note = CRISPR gRNA sequence
  source 1..20: mol_type = other DNA
cattgtctggcttttctgct

SEQ ID NO: 15411 - DNA, 20 bp, synthetic construct
  misc_feature 1..20: note = CRISPR gRNA sequence
  source 1..20: mol_type = other DNA
tggcttttctgctgggtaac

SEQ ID NO: 15412 - DNA, 20 bp, synthetic construct
  misc_feature 1..20: note = CRISPR gRNA sequence
  source 1..20: mol_type = other DNA
cttttctgctgggtaacaag

SEQ ID NO: 15413 - DNA, 20 bp, synthetic construct
  misc_feature 1..20: note = CRISPR gRNA sequence
  source 1..20: mol_type = other DNA
tgctgggtaacaagcagctg

SEQ ID NO: 15414 - DNA, 20 bp, synthetic construct
  misc_feature 1..20: note = CRISPR gRNA sequence
  source 1..20: mol_type = other DNA
gctgggtaacaagcagctga

SEQ ID NO: 15415 - DNA, 20 bp, synthetic construct
  misc_feature 1..20: note = CRISPR gRNA sequence
  source 1..20: mol_type = other DNA
aacaagcagctgaaggctga

SEQ ID NO: 15416 - DNA, 20 bp, synthetic construct
  misc_feature 1..20: note = CRISPR gRNA sequence
  source 1..20: mol_type = other DNA
tgaaggctgatggctgtatt

SEQ ID NO: 15417 - DNA, 20 bp, synthetic construct
  misc_feature 1..20: note = CRISPR gRNA sequence
  source 1..20: mol_type = other DNA
ggctgatggctgtatttgga

SEQ ID NO: 15418 - DNA, 20 bp, synthetic construct
  misc_feature 1..20: note = CRISPR gRNA sequence
  source 1..20: mol_type = other DNA
gctgatggctgtatttggat

SEQ ID NO: 15419 - DNA, 20 bp, synthetic construct
  misc_feature 1..20: note = CRISPR gRNA sequence
  source 1..20: mol_type = other DNA
ggctgtatttggatgggatg

SEQ ID NO: 15420 - DNA, 20 bp, synthetic construct
  misc_feature 1..20: note = CRISPR gRNA sequence
  source 1..20: mol_type = other DNA
tggatgggatgtggattctc

SEQ ID NO: 15421 - DNA, 20 bp, synthetic construct
  misc_feature 1..20: note = CRISPR gRNA sequence
  source 1..20: mol_type = other DNA
acaaccatgcctccactccc

SEQ ID NO: 15422 - DNA, 20 bp, synthetic construct
  misc_feature 1..20: note = CRISPR gRNA sequence
  source 1..20: mol_type = other DNA
aaccatgcctccactccctg

SEQ ID NO: 15423 - DNA, 20 bp, synthetic construct
  misc_feature 1..20: note = CRISPR gRNA sequence
  source 1..20: mol_type = other DNA
aacatgacctgttgtcccta

SEQ ID NO: 15424 - DNA, 20 bp, synthetic construct
  misc_feature 1..20: note = CRISPR gRNA sequence
  source 1..20: mol_type = other DNA
acatgacctgttgtccctac

SEQ ID NO: 15425 - DNA, 20 bp, synthetic construct
  misc_feature 1..20: note = CRISPR gRNA sequence
  source 1..20: mol_type = other DNA
tgacctgttgtccctacagg

SEQ ID NO: 15426 - DNA, 20 bp, synthetic construct
  misc_feature 1..20: note = CRISPR gRNA sequence
  source 1..20: mol_type = other DNA
cctacaggcagctttgcttg

SEQ ID NO: 15427 - DNA, 20 bp, synthetic construct
  misc_feature 1..20: note = CRISPR gRNA sequence
  source 1..20: mol_type = other DNA
tttgcttgtggatcttattt

SEQ ID NO: 15428 - DNA, 20 bp, synthetic construct
  misc_feature 1..20: note = CRISPR gRNA sequence
  source 1..20: mol_type = other DNA
atttgagacaattccttccc

SEQ ID NO: 15429 - DNA, 20 bp, synthetic construct
  misc_feature 1..20: note = CRISPR gRNA sequence
  source 1..20: mol_type = other DNA
tttgagacaattccttcccc

SEQ ID NO: 15430 - DNA, 20 bp, synthetic construct
  misc_feature 1..20: note = CRISPR gRNA sequence
  source 1..20: mol_type = other DNA
ttgagacaattccttcccca

SEQ ID NO: 15431 - DNA, 20 bp, synthetic construct
  misc_feature 1..20: note = CRISPR gRNA sequence
  source 1..20: mol_type = other DNA
cagggcctcgatcctgcttc

SEQ ID NO: 15432 - DNA, 20 bp, synthetic construct
  misc_feature 1..20: note = CRISPR gRNA sequence
  source 1..20: mol_type = other DNA
cctgcttctagtacctctca

SEQ ID NO: 15433 - DNA, 20 bp, synthetic construct
  misc_feature 1..20: note = CRISPR gRNA sequence
  source 1..20: mol_type = other DNA
ctgcttctagtacctctcac

SEQ ID NO: 15434 - DNA, 20 bp, synthetic construct
  misc_feature 1..20: note = CRISPR gRNA sequence
  source 1..20: mol_type = other DNA
tagtacctctcacaggccct

SEQ ID NO: 15435 - DNA, 20 bp, synthetic construct
  misc_feature 1..20: note = CRISPR gRNA sequence
  source 1..20: mol_type = other DNA
agtacctctcacaggcccta

SEQ ID NO: 15436 - DNA, 20 bp, synthetic construct
  misc_feature 1..20: note = CRISPR gRNA sequence
  source 1..20: mol_type = other DNA
gtacctctcacaggccctaa

SEQ ID NO: 15437 - DNA, 20 bp, synthetic construct
  misc_feature 1..20: note = CRISPR gRNA sequence
  source 1..20: mol_type = other DNA
ccttacctgtcatgtttgct

SEQ ID NO: 15438 - DNA, 20 bp, synthetic construct
  misc_feature 1..20: note = CRISPR gRNA sequence
  source 1..20: mol_type = other DNA
cttacctgtcatgtttgctc

SEQ ID NO: 15439 - DNA, 20 bp, synthetic construct
  misc_feature 1..20: note = CRISPR gRNA sequence
  source 1..20: mol_type = other DNA
tacctgtcatgtttgctcgg

SEQ ID NO: 15440 - DNA, 20 bp, synthetic construct
  misc_feature 1..20: note = CRISPR gRNA sequence
  source 1..20: mol_type = other DNA
acctgtcatgtttgctcggg

SEQ ID NO: 15441 - DNA, 20 bp, synthetic construct
  misc_feature 1..20: note = CRISPR gRNA sequence
  source 1..20: mol_type = other DNA
gtcatgtttgctcgggaggt

SEQ ID NO: 15442 - DNA, 20 bp, synthetic construct
  misc_feature 1..20: note = CRISPR gRNA sequence
  source 1..20: mol_type = other DNA
tcatgtttgctcgggaggtc

SEQ ID NO: 15443 - DNA, 20 bp, synthetic construct
  misc_feature 1..20: note = CRISPR gRNA sequence
  source 1..20: mol_type = other DNA
catgtttgctcgggaggtca

SEQ ID NO: 15444 - DNA, 20 bp, synthetic construct
  misc_feature 1..20: note = CRISPR gRNA sequence
  source 1..20: mol_type = other DNA
gtttgctcgggaggtcaggg

SEQ ID NO: 15445 - DNA, 20 bp, synthetic construct
  misc_feature 1..20: note = CRISPR gRNA sequence
  source 1..20: mol_type = other DNA
tttgctcgggaggtcagggc

SEQ ID NO: 15446 - DNA, 20 bp, synthetic construct
  misc_feature 1..20: note = CRISPR gRNA sequence
  source 1..20: mol_type = other DNA
tcgggaggtcagggcaggtt

SEQ ID NO: 15447 - DNA, 20 bp, synthetic construct
  misc_feature 1..20: note = CRISPR gRNA sequence
  source 1..20: mol_type = other DNA
cgggaggtcagggcaggttc

SEQ ID NO: 15448 - DNA, 20 bp, synthetic construct
  misc_feature 1..20: note = CRISPR gRNA sequence
  source 1..20: mol_type = other DNA
cagggcaggttcaggcatgc

SEQ ID NO: 15449 - DNA, 20 bp, synthetic construct
  misc_feature 1..20: note = CRISPR gRNA sequence
  source 1..20: mol_type = other DNA
agggcaggttcaggcatgct

SEQ ID NO: 15450 - DNA, 20 bp, synthetic construct
  misc_feature 1..20: note = CRISPR gRNA sequence
  source 1..20: mol_type = other DNA
gcaggttcaggcatgctggg

SEQ ID NO: 15451 - DNA, 20 bp, synthetic construct
  misc_feature 1..20: note = CRISPR gRNA sequence
  source 1..20: mol_type = other DNA
caggttcaggcatgctgggc

SEQ ID NO: 15452 - DNA, 20 bp, synthetic construct
  misc_feature 1..20: note = CRISPR gRNA sequence
  source 1..20: mol_type = other DNA
ttcaggcatgctgggcaggt

SEQ ID NO: 15453 - DNA, 20 bp, synthetic construct
  misc_feature 1..20: note = CRISPR gRNA sequence
  source 1..20: mol_type = other DNA
aggcatgctgggcaggtcag

SEQ ID NO: 15454 - DNA, 20 bp, synthetic construct
  misc_feature 1..20: note = CRISPR gRNA sequence
  source 1..20: mol_type = other DNA
ctgggcaggtcagtggctga

SEQ ID NO: 15455 - DNA, 20 bp, synthetic construct
  misc_feature 1..20: note = CRISPR gRNA sequence
  source 1..20: mol_type = other DNA
gggcaggtcagtggctgatg

SEQ ID NO: 15456 - DNA, 20 bp, synthetic construct
  misc_feature 1..20: note = CRISPR gRNA sequence
  source 1..20: mol_type = other DNA
ggtcagtggctgatggagcg

SEQ ID NO: 15457 - DNA, 20 bp, synthetic construct
  misc_feature 1..20: note = CRISPR gRNA sequence
  source 1..20: mol_type = other DNA
gtcagtggctgatggagcga

SEQ ID NO: 15458 - DNA, 20 bp, synthetic construct
  misc_feature 1..20: note = CRISPR gRNA sequence
  source 1..20: mol_type = other DNA
tcagtggctgatggagcgaa

SEQ ID NO: 15459 - DNA, 20 bp, synthetic construct
  misc_feature 1..20: note = CRISPR gRNA sequence
  source 1..20: mol_type = other DNA
cagtggctgatggagcgaag

SEQ ID NO: 15460 - DNA, 20 bp, synthetic construct
  misc_feature 1..20: note = CRISPR gRNA sequence
  source 1..20: mol_type = other DNA
ggctgatggagcgaaggggc

SEQ ID NO: 15461 - DNA, 20 bp, synthetic construct
  misc_feature 1..20: note = CRISPR gRNA sequence
  source 1..20: mol_type = other DNA
tgatggagcgaaggggctgg

SEQ ID NO: 15462 - DNA, 20 bp, synthetic construct
  misc_feature 1..20: note = CRISPR gRNA sequence
  source 1..20: mol_type = other DNA
atggagcgaaggggctggtg

SEQ ID NO: 15463 - DNA, 20 bp, synthetic construct
  misc_feature 1..20: note = CRISPR gRNA sequence
  source 1..20: mol_type = other DNA
gcgaaggggctggtggagcc

SEQ ID NO: 15464 - DNA, 20 bp, synthetic construct
  misc_feature 1..20: note = CRISPR gRNA sequence
  source 1..20: mol_type = other DNA
aggggctggtggagcctggc

SEQ ID NO: 15465 - DNA, 20 bp, synthetic construct
  misc_feature 1..20: note = CRISPR gRNA sequence
  source 1..20: mol_type = other DNA
ctggtggagcctggccggtc

SEQ ID NO: 15466 - DNA, 20 bp, synthetic construct
  misc_feature 1..20: note = CRISPR gRNA sequence
  source 1..20: mol_type = other DNA
ggtggagcctggccggtctg

SEQ ID NO: 15467 - DNA, 20 bp, synthetic construct
  misc_feature 1..20: note = CRISPR gRNA sequence
  source 1..20: mol_type = other DNA
cctggccggtctggagatgt

SEQ ID NO: 15468 - DNA, 20 bp, synthetic construct
  misc_feature 1..20: note = CRISPR gRNA sequence
  source 1..20: mol_type = other DNA
ctggccggtctggagatgtt

SEQ ID NO: 15469 - DNA, 20 bp, synthetic construct
  misc_feature 1..20: note = CRISPR gRNA sequence
  source 1..20: mol_type = other DNA
ggccggtctggagatgttgg

SEQ ID NO: 15470 - DNA, 20 bp, synthetic construct
  misc_feature 1..20: note = CRISPR gRNA sequence
  source 1..20: mol_type = other DNA
gccggtctggagatgttggg

SEQ ID NO: 15471 - DNA, 20 bp, synthetic construct
  misc_feature 1..20: note = CRISPR gRNA sequence
  source 1..20: mol_type = other DNA
ctggagatgttgggaggccg

SEQ ID NO: 15472 - DNA, 20 bp, synthetic construct
  misc_feature 1..20: note = CRISPR gRNA sequence
  source 1..20: mol_type = other DNA
agatgttgggaggccgtgga

SEQ ID NO: 15473 - DNA, 20 bp, synthetic construct
  misc_feature 1..20: note = CRISPR gRNA sequence
  source 1..20: mol_type = other DNA
gccgtggacagtgaatccac

SEQ ID NO: 15474 - DNA, 20 bp, synthetic construct
  misc_feature 1..20: note = CRISPR gRNA sequence
  source 1..20: mol_type = other DNA
ccgtggacagtgaatccact

SEQ ID NO: 15475 - DNA, 20 bp, synthetic construct
  misc_feature 1..20: note = CRISPR gRNA sequence
  source 1..20: mol_type = other DNA
gtggacagtgaatccactgg

SEQ ID NO: 15476 - DNA, 20 bp, synthetic construct
  misc_feature 1..20: note = CRISPR gRNA sequence
  source 1..20: mol_type = other DNA
tggacagtgaatccactggg

SEQ ID NO: 15477 - DNA, 20 bp, synthetic construct
  misc_feature 1..20: note = CRISPR gRNA sequence
  source 1..20: mol_type = other DNA
ggacagtgaatccactggga

SEQ ID NO: 15478 - DNA, 20 bp, synthetic construct
  misc_feature 1..20: note = CRISPR gRNA sequence
  source 1..20: mol_type = other DNA
gacagtgaatccactgggag

SEQ ID NO: 15479 - DNA, 20 bp, synthetic construct
  misc_feature 1..20: note = CRISPR gRNA sequence
  source 1..20: mol_type = other DNA
acagtgaatccactgggagg

SEQ ID NO: 15480 - DNA, 20 bp, synthetic construct
  misc_feature 1..20: note = CRISPR gRNA sequence
  source 1..20: mol_type = other DNA
atccactgggagggggtact

SEQ ID NO: 15481 - DNA, 20 bp, synthetic construct
  misc_feature 1..20: note = CRISPR gRNA sequence
  source 1..20: mol_type = other DNA
actgggagggggtacttggc

SEQ ID NO: 15482 - DNA, 20 bp, synthetic construct
  misc_feature 1..20: note = CRISPR gRNA sequence
  source 1..20: mol_type = other DNA
gagggggtacttggctggcc

SEQ ID NO: 15483 - DNA, 20 bp, synthetic construct
  misc_feature 1..20: note = CRISPR gRNA sequence
  source 1..20: mol_type = other DNA
agggggtacttggctggcct

SEQ ID NO: 15484 - DNA, 20 bp, synthetic construct
  misc_feature 1..20: note = CRISPR gRNA sequence
  source 1..20: mol_type = other DNA
gggggtacttggctggcctg

SEQ ID NO: 15485 - DNA, 20 bp, synthetic construct
  misc_feature 1..20: note = CRISPR gRNA sequence
  source 1..20: mol_type = other DNA
ctggggcacctcacctacat

SEQ ID NO: 15486 - DNA, 20 bp, synthetic construct
  misc_feature 1..20: note = CRISPR gRNA sequence
  source 1..20: mol_type = other DNA
tggggcacctcacctacatt

SEQ ID NO: 15487 - DNA, 20 bp, synthetic construct
  misc_feature 1..20: note = CRISPR gRNA sequence
  source 1..20: mol_type = other DNA
ggggcacctcacctacattg

SEQ ID NO: 15488 - DNA, 20 bp, synthetic construct
  misc_feature 1..20: note = CRISPR gRNA sequence
  source 1..20: mol_type = other DNA
gggcacctcacctacattgg

SEQ ID NO: 15489 - DNA, 20 bp, synthetic construct
  misc_feature 1..20: note = CRISPR gRNA sequence
  source 1..20: mol_type = other DNA
cacctcacctacattggggg

SEQ ID NO: 15490 - DNA, 20 bp, synthetic construct
  misc_feature 1..20: note = CRISPR gRNA sequence
  source 1..20: mol_type = other DNA
cctcacctacattgggggtg

SEQ ID NO: 15491 - DNA, 20 bp, synthetic construct
  misc_feature 1..20: note = CRISPR gRNA sequence
  source 1..20: mol_type = other DNA
tcacctacattgggggtgga

SEQ ID NO: 15492 - DNA, 20 bp, synthetic construct
  misc_feature 1..20: note = CRISPR gRNA sequence
  source 1..20: mol_type = other DNA
cctacattgggggtggagag

SEQ ID NO: 15493 - DNA, 20 bp, synthetic construct
  misc_feature 1..20: note = CRISPR gRNA sequence
  source 1..20: mol_type = other DNA
ttgggggtggagagtggtgt

SEQ ID NO: 15494 - DNA, 20 bp, synthetic construct
  misc_feature 1..20: note = CRISPR gRNA sequence
  source 1..20: mol_type = other DNA
gagagtggtgtgagaataac

SEQ ID NO: 15495 - DNA, 20 bp, synthetic construct
  misc_feature 1..20: note = CRISPR gRNA sequence
  source 1..20: mol_type = other DNA
agagtggtgtgagaataacc

SEQ ID NO: 15496 - DNA, 20 bp, synthetic construct
  misc_feature 1..20: note = CRISPR gRNA sequence
  source 1..20: mol_type = other DNA
gaataaccaggtattgattc

SEQ ID NO: 15497 - DNA, 20 bp, synthetic construct
  misc_feature 1..20: note = CRISPR gRNA sequence
  source 1..20: mol_type = other DNA
attgattccagaaatgcact

SEQ ID NO: 15498 - DNA, 20 bp, synthetic construct
  misc_feature 1..20: note = CRISPR gRNA sequence
  source 1..20: mol_type = other DNA
ttgattccagaaatgcactt

SEQ ID NO: 15499 - DNA, 20 bp, synthetic construct
  misc_feature 1..20: note = CRISPR gRNA sequence
  source 1..20: mol_type = other DNA
gggtcacccctactccaaac

SEQ ID NO: 15500 - DNA, 20 bp, synthetic construct
  misc_feature 1..20: note = CRISPR gRNA sequence
  source 1..20: mol_type = other DNA
ggtcacccctactccaaact

SEQ ID NO: 15501 - DNA, 20 bp, synthetic construct
  misc_feature 1..20: note = CRISPR gRNA sequence
  source 1..20: mol_type = other DNA
ccctactccaaactgggctg

SEQ ID NO: 15502 - DNA, 20 bp, synthetic construct
  misc_feature 1..20: note = CRISPR gRNA sequence
  source 1..20: mol_type = other DNA
ctactccaaactgggctgtg

SEQ ID NO: 15503 - DNA, 20 bp, synthetic construct
  misc_feature 1..20: note = CRISPR gRNA sequence
  source 1..20: mol_type = other DNA
ccaaactgggctgtggagct

SEQ ID NO: 15504 - DNA, 20 bp, synthetic construct
  misc_feature 1..20: note = CRISPR gRNA sequence
  source 1..20: mol_type = other DNA
caaactgggctgtggagctc

SEQ ID NO: 15505 - DNA, 20 bp, synthetic construct
  misc_feature 1..20: note = CRISPR gRNA sequence
  source 1..20: mol_type = other DNA
actgggctgtggagctcagg

SEQ ID NO: 15506 - DNA, 20 bp, synthetic construct
  misc_feature 1..20: note = CRISPR gRNA sequence
  source 1..20: mol_type = other DNA
gctgtggagctcaggaagtc

SEQ ID NO: 15507 - DNA, 20 bp, synthetic construct
  misc_feature 1..20: note = CRISPR gRNA sequence
  source 1..20: mol_type = other DNA
tgtggagctcaggaagtctg

SEQ ID NO: 15508 - DNA, 20 bp, synthetic construct
  misc_feature 1..20: note = CRISPR gRNA sequence
  source 1..20: mol_type = other DNA
tggagctcaggaagtctgga

SEQ ID NO: 15509 - DNA, 20 bp, synthetic construct
  misc_feature 1..20: note = CRISPR gRNA sequence
  source 1..20: mol_type = other DNA
agctcaggaagtctggagag

SEQ ID NO: 15510 - DNA, 20 bp, synthetic construct
  misc_feature 1..20: note = CRISPR gRNA sequence
  source 1..20: mol_type = other DNA
ctcaggaagtctggagagaa

SEQ ID NO: 15511 - DNA, 20 bp, synthetic construct
  misc_feature 1..20: note = CRISPR gRNA sequence
  source 1..20: mol_type = other DNA
caggaagtctggagagaaga

SEQ ID NO: 15512 - DNA, 20 bp, synthetic construct
  misc_feature 1..20: note = CRISPR gRNA sequence
  source 1..20: mol_type = other DNA
gaagtctggagagaagagag

SEQ ID NO: 15513 - DNA, 20 bp, synthetic construct
  misc_feature 1..20: note = CRISPR gRNA sequence
  source 1..20: mol_type = other DNA
agaagagagtagaacttcca

SEQ ID NO: 15514 - DNA, 20 bp, synthetic construct
  misc_feature 1..20: note = CRISPR gRNA sequence
  source 1..20: mol_type = other DNA
gaagagagtagaacttccaa

SEQ ID NO: 15515 - DNA, 20 bp, synthetic construct
  misc_feature 1..20: note = CRISPR gRNA sequence
  source 1..20: mol_type = other DNA
gagagtagaacttccaaagg

SEQ ID NO: 15516 - DNA, 20 bp, synthetic construct
  misc_feature 1..20: note = CRISPR gRNA sequence
  source 1..20: mol_type = other DNA
acttccaaaggaagatattt

SEQ ID NO: 15517 - DNA, 20 bp, synthetic construct
  misc_feature 1..20: note = CRISPR gRNA sequence
  source 1..20: mol_type = other DNA
cttccaaaggaagatatttc

SEQ ID NO: 15518 - DNA, 20 bp, synthetic construct
  misc_feature 1..20: note = CRISPR gRNA sequence
  source 1..20: mol_type = other DNA
caaaggaagatatttcagga

SEQ ID NO: 15519 - DNA, 20 bp, synthetic construct
  misc_feature 1..20: note = CRISPR gRNA sequence
  source 1..20: mol_type = other DNA
aaggaagatatttcaggaca

SEQ ID NO: 15520 - DNA, 20 bp, synthetic construct
  misc_feature 1..20: note = CRISPR gRNA sequence
  source 1..20: mol_type = other DNA
gatatttcaggacagagctg

SEQ ID NO: 15521 - DNA, 20 bp, synthetic construct
  misc_feature 1..20: note = CRISPR gRNA sequence
  source 1..20: mol_type = other DNA
tttcaggacagagctgaaga

SEQ ID NO: 15522 - DNA, 20 bp, synthetic construct
  misc_feature 1..20: note = CRISPR gRNA sequence
  source 1..20: mol_type = other DNA
tcaggacagagctgaagaaa

SEQ ID NO: 15523 - DNA, 20 bp, synthetic construct
  misc_feature 1..20: note = CRISPR gRNA sequence
  source 1..20: mol_type = other DNA
cagagctgaagaaagagctc

SEQ ID NO: 15524 - DNA, 20 bp, synthetic construct
  misc_feature 1..20: note = CRISPR gRNA sequence
  source 1..20: mol_type = other DNA
gagctgaagaaagagctctg

SEQ ID NO: 15525 - DNA, 20 bp, synthetic construct
  misc_feature 1..20: note = CRISPR gRNA sequence
  source 1..20: mol_type = other DNA
aagagctctggagttacatc

SEQ ID NO: 15526 - DNA, 20 bp, synthetic construct
  misc_feature 1..20: note = CRISPR gRNA sequence
  source 1..20: mol_type = other DNA
ctggagttacatctagctcc

SEQ ID NO: 15527 - DNA, 20 bp, synthetic construct
  misc_feature 1..20: note = CRISPR gRNA sequence
  source 1..20: mol_type = other DNA
tgcttttccaatctgtgaaa

SEQ ID NO: 15528 - DNA, 20 bp, synthetic construct
  misc_feature 1..20: note = CRISPR gRNA sequence
  source 1..20: mol_type = other DNA
gcttttccaatctgtgaaat

SEQ ID NO: 15529 - DNA, 20 bp, synthetic construct
  misc_feature 1..20: note = CRISPR gRNA sequence
  source 1..20: mol_type = other DNA
atctgtgaaatgggtgcaat

SEQ ID NO: 15530 - DNA, 20 bp, synthetic construct
  misc_feature 1..20: note = CRISPR gRNA sequence
  source 1..20: mol_type = other DNA
aatgggtgcaattagctcat

SEQ ID NO: 15531 - DNA, 20 bp, synthetic construct
  misc_feature 1..20: note = CRISPR gRNA sequence
  source 1..20: mol_type = other DNA
atgggtgcaattagctcata

SEQ ID NO: 15532 - DNA, 20 bp, synthetic construct
  misc_feature 1..20: note = CRISPR gRNA sequence
  source 1..20: mol_type = other DNA
caattagctcataaggaact

SEQ ID NO: 15533 - DNA, 20 bp, synthetic construct
  misc_feature 1..20: note = CRISPR gRNA sequence
  source 1..20: mol_type = other DNA
aattagctcataaggaactt

SEQ ID NO: 15534 - DNA, 20 bp, synthetic construct
  misc_feature 1..20: note = CRISPR gRNA sequence
  source 1..20: mol_type = other DNA
attagctcataaggaactta

SEQ ID NO: 15535 - DNA, 20 bp, synthetic construct
  misc_feature 1..20: note = CRISPR gRNA sequence
  source 1..20: mol_type = other DNA
agctcataaggaacttaggg

SEQ ID NO: 15536 - DNA, 20 bp, synthetic construct
  misc_feature 1..20: note = CRISPR gRNA sequence
  source 1..20: mol_type = other DNA
gctcataaggaacttagggc

SEQ ID NO: 15537 - DNA, 20 bp, synthetic construct
  misc_feature 1..20: note = CRISPR gRNA sequence
  source 1..20: mol_type = other DNA
attgcactcttcctgctgtg

SEQ ID NO: 15538 - DNA, 20 bp, synthetic construct
  misc_feature 1..20: note = CRISPR gRNA sequence
  source 1..20: mol_type = other DNA
cactcttcctgctgtgtggt

SEQ ID NO: 15539 - DNA, 20 bp, synthetic construct
  misc_feature 1..20: note = CRISPR gRNA sequence
  source 1..20: mol_type = other DNA
gtggtcagtgctcattttcc

SEQ ID NO: 15540 - DNA, 20 bp, synthetic construct
  misc_feature 1..20: note = CRISPR gRNA sequence
  source 1..20: mol_type = other DNA
gtgctcattttcctagatat

SEQ ID NO: 15541 - DNA, 20 bp, synthetic construct
  misc_feature 1..20: note = CRISPR gRNA sequence
  source 1..20: mol_type = other DNA
tgctcattttcctagatatc

SEQ ID NO: 15542 - DNA, 20 bp, synthetic construct
  misc_feature 1..20: note = CRISPR gRNA sequence
  source 1..20: mol_type = other DNA
ggaactgcttctctgcttct

SEQ ID NO: 15543 - DNA, 20 bp, synthetic construct
  misc_feature 1..20: note = CRISPR gRNA sequence
  source 1..20: mol_type = other DNA
cttctctgcttctgagatac

SEQ ID NO: 15544 - DNA, 20 bp, synthetic construct
  misc_feature 1..20: note = CRISPR gRNA sequence
  source 1..20: mol_type = other DNA
tactgaaactgtcttgcaac

SEQ ID NO: 15545 - DNA, 20 bp, synthetic construct
  misc_feature 1..20: note = CRISPR gRNA sequence
  source 1..20: mol_type = other DNA
actgaaactgtcttgcaacc

SEQ ID NO: 15546 - DNA, 20 bp, synthetic construct
  misc_feature 1..20: note = CRISPR gRNA sequence
  source 1..20: mol_type = other DNA
aactgtcttgcaaccaggaa

SEQ ID NO: 15547 - DNA, 20 bp, synthetic construct
  misc_feature 1..20: note = CRISPR gRNA sequence
  source 1..20: mol_type = other DNA
gcaaccaggaatggatgctc

SEQ ID NO: 15548 - DNA, 20 bp, synthetic construct
  misc_feature 1..20: note = CRISPR gRNA sequence
  source 1..20: mol_type = other DNA
ggaatggatgctctggactt

SEQ ID NO: 15549 - DNA, 20 bp, synthetic construct
  misc_feature 1..20: note = CRISPR gRNA sequence
  source 1..20: mol_type = other DNA
atggatgctctggacttgag

SEQ ID NO: 15550 - DNA, 20 bp, synthetic construct
  misc_feature 1..20: note = CRISPR gRNA sequence
  source 1..20: mol_type = other DNA
gatgctctggacttgagtgg

SEQ ID NO: 15551 - DNA, 20 bp, synthetic construct
  misc_feature 1..20: note = CRISPR gRNA sequence
  source 1..20: mol_type = other DNA
cttgagtggaagcatcctcc

SEQ ID NO: 15552 - DNA, 20 bp, synthetic construct
  misc_feature 1..20: note = CRISPR gRNA sequence
  source 1..20: mol_type = other DNA
cctcctggtctcatccctga

SEQ ID NO: 15553 - DNA, 20 bp, synthetic construct
  misc_feature 1..20: note = CRISPR gRNA sequence
  source 1..20: mol_type = other DNA
agcccaaacacaccttccct

SEQ ID NO: 15554 - DNA, 20 bp, synthetic construct
  misc_feature 1..20: note = CRISPR gRNA sequence
  source 1..20: mol_type = other DNA
aaacacaccttccctgagac

SEQ ID NO: 15555 - DNA, 20 bp, synthetic construct
  misc_feature 1..20: note = CRISPR gRNA sequence
  source 1..20: mol_type = other DNA
tgagacaagtcacaacccct

SEQ ID NO: 15556 - DNA, 20 bp, synthetic construct
  misc_feature 1..20: note = CRISPR gRNA sequence
  source 1..20: mol_type = other DNA
caagtcacaacccctcagtg

SEQ ID NO: 15557 - DNA, 20 bp, synthetic construct
  misc_feature 1..20: note = CRISPR gRNA sequence
  source 1..20: mol_type = other DNA
gtcacaacccctcagtgtgg

SEQ ID NO: 15558 - DNA, 20 bp, synthetic construct
  misc_feature 1..20: note = CRISPR gRNA sequence
  source 1..20: mol_type = other DNA
tcacaacccctcagtgtggt

SEQ ID NO: 15559 - DNA, 20 bp, synthetic construct
  misc_feature 1..20: note = CRISPR gRNA sequence
  source 1..20: mol_type = other DNA
aacccctcagtgtggtgggt

SEQ ID NO: 15560 - DNA, 20 bp, synthetic construct
  misc_feature 1..20: note = CRISPR gRNA sequence
  source 1..20: mol_type = other DNA
ccctcagtgtggtgggtcag

SEQ ID NO: 15561 - DNA, 20 bp, synthetic construct
  misc_feature 1..20: note = CRISPR gRNA sequence
  source 1..20: mol_type = other DNA
cctcagtgtggtgggtcagt

SEQ ID NO: 15562 - DNA, 20 bp, synthetic construct
  misc_feature 1..20: note = CRISPR gRNA sequence
  source 1..20: mol_type = other DNA
ctcagtgtggtgggtcagta

SEQ ID NO: 15563 - DNA, 20 bp, synthetic construct
  misc_feature 1..20: note = CRISPR gRNA sequence
  source 1..20: mol_type = other DNA
gtagggaccattttactgat

SEQ ID NO: 15564 - DNA, 20 bp, synthetic construct
  misc_feature 1..20: note = CRISPR gRNA sequence
  source 1..20: mol_type = other DNA
tagggaccattttactgatt

SEQ ID NO: 15565 - DNA, 20 bp, synthetic construct
  misc_feature 1..20: note = CRISPR gRNA sequence
  source 1..20: mol_type = other DNA
cattttactgattaggaaac

SEQ ID NO: 15566 - DNA, 20 bp, synthetic construct
  misc_feature 1..20: note = CRISPR gRNA sequence
  source 1..20: mol_type = other DNA
gattaggaaacaagacaaat

SEQ ID NO: 15567 - DNA, 20 bp, synthetic construct
  misc_feature 1..20: note = CRISPR gRNA sequence
  source 1..20: mol_type = other DNA
ttaggaaacaagacaaatca

SEQ ID NO: 15568 - DNA, 20 bp, synthetic construct
  misc_feature 1..20: note = CRISPR gRNA sequence
  source 1..20: mol_type = other DNA
gaaacaagacaaatcagaga

SEQ ID NO: 15569 - DNA, 20 bp, synthetic construct
  misc_feature 1..20: note = CRISPR gRNA sequence
  source 1..20: mol_type = other DNA
caaatcagagaaagctatgc

SEQ ID NO: 15570 - DNA, 20 bp, synthetic construct
  misc_feature 1..20: note = CRISPR gRNA sequence
  source 1..20: mol_type = other DNA
aaatcagagaaagctatgca

SEQ ID NO: 15571 - DNA, 20 bp, synthetic construct
  misc_feature 1..20: note = CRISPR gRNA sequence
  source 1..20: mol_type = other DNA
gcacaccaaactattcacat

SEQ ID NO: 15572 - DNA, 20 bp, synthetic construct
  misc_feature 1..20: note = CRISPR gRNA sequence
  source 1..20: mol_type = other DNA
tattcacatcagtatactaa

SEQ ID NO: 15573 - DNA, 20 bp, synthetic construct
  misc_feature 1..20: note = CRISPR gRNA sequence
  source 1..20: mol_type = other DNA
ttcacatcagtatactaaaa

SEQ ID NO: 15574 - DNA, 20 bp, synthetic construct
  misc_feature 1..20: note = CRISPR gRNA sequence
  source 1..20: mol_type = other DNA
catcagtatactaaaagagt

SEQ ID NO: 15575 - DNA, 20 bp, synthetic construct
  misc_feature 1..20: note = CRISPR gRNA sequence
  source 1..20: mol_type = other DNA
tcagtatactaaaagagtga

SEQ ID NO: 15576 - DNA, 20 bp, synthetic construct
  misc_feature 1..20: note = CRISPR gRNA sequence
  source 1..20: mol_type = other DNA
agtatactaaaagagtgaga

SEQ ID NO: 15577 - DNA, 20 bp, synthetic construct
  misc_feature 1..20: note = CRISPR gRNA sequence
  source 1..20: mol_type = other DNA
tactaaaagagtgagagaga

SEQ ID NO: 15578 - DNA, 20 bp, synthetic construct
  misc_feature 1..20: note = CRISPR gRNA sequence
  source 1..20: mol_type = other DNA
ttgtaaacatcacttgtcat

SEQ ID NO: 15579 - DNA, 20 bp, synthetic construct
  misc_feature 1..20: note = CRISPR gRNA sequence
  source 1..20: mol_type = other DNA
atcacttgtcattagcttat

SEQ ID NO: 15580 - DNA, 20 bp, synthetic construct
  misc_feature 1..20: note = CRISPR gRNA sequence
  source 1..20: mol_type = other DNA
cttgtcattagcttattagt

SEQ ID NO: 15581 - DNA, 20 bp, synthetic construct
  misc_feature 1..20: note = CRISPR gRNA sequence
  source 1..20: mol_type = other DNA
caaaaacatttaaaaaaaat

SEQ ID NO: 15582 - DNA, 20 bp, synthetic construct
  misc_feature 1..20: note = CRISPR gRNA sequence
  source 1..20: mol_type = other DNA
aaaaacatttaaaaaaaata

SEQ ID NO: 15583 - DNA, 20 bp, synthetic construct
  misc_feature 1..20: note = CRISPR gRNA sequence
  source 1..20: mol_type = other DNA
aaaaaaaataaggaaaaact

SEQ ID NO: 15584 - DNA, 20 bp, synthetic construct
  misc_feature 1..20: note = CRISPR gRNA sequence
  source 1..20: mol_type = other DNA
aaaaaaataaggaaaaacta

SEQ ID NO: 15585 - DNA, 20 bp, synthetic construct
  misc_feature 1..20: note = CRISPR gRNA sequence
  source 1..20: mol_type = other DNA
aaaaaataaggaaaaactaa

SEQ ID NO: 15586 - DNA, 20 bp, synthetic construct
  misc_feature 1..20: note = CRISPR gRNA sequence
  source 1..20: mol_type = other DNA
aataaggaaaaactaagggt

SEQ ID NO: 15587 - DNA, 20 bp, synthetic construct
  misc_feature 1..20: note = CRISPR gRNA sequence
  source 1..20: mol_type = other DNA
aaggaaaaactaagggtcag

SEQ ID NO: 15588 - DNA, 20 bp, synthetic construct
  misc_feature 1..20: note = CRISPR gRNA sequence
  source 1..20: mol_type = other DNA
aggaaaaactaagggtcaga

SEQ ID NO: 15589 - DNA, 20 bp, synthetic construct
  misc_feature 1..20: note = CRISPR gRNA sequence
  source 1..20: mol_type = other DNA
ggaaaaactaagggtcagaa

SEQ ID NO: 15590 - DNA, 20 bp, synthetic construct
  misc_feature 1..20: note = CRISPR gRNA sequence
  source 1..20: mol_type = other DNA
gaaaaactaagggtcagaag

SEQ ID NO: 15591 - DNA, 20 bp, synthetic construct
  misc_feature 1..20: note = CRISPR gRNA sequence
  source 1..20: mol_type = other DNA
aactaagggtcagaagggga

SEQ ID NO: 15592 - DNA, 20 bp, synthetic construct
  misc_feature 1..20: note = CRISPR gRNA sequence
  source 1..20: mol_type = other DNA
cagaaggggaaagcaacata

SEQ ID NO: 15593 - DNA, 20 bp, synthetic construct
  misc_feature 1..20: note = CRISPR gRNA sequence
  source 1..20: mol_type = other DNA
aaggggaaagcaacatatgg

SEQ ID NO: 15594 - DNA, 20 bp, synthetic construct
  misc_feature 1..20: note = CRISPR gRNA sequence
  source 1..20: mol_type = other DNA
aggggaaagcaacatatgga

SEQ ID NO: 15595 - DNA, 20 bp, synthetic construct
  misc_feature 1..20: note = CRISPR gRNA sequence
  source 1..20: mol_type = other DNA
gaaggccacacaaccactct

SEQ ID NO: 15596 - DNA, 20 bp, synthetic construct
  misc_feature 1..20: note = CRISPR gRNA sequence
  source 1..20: mol_type = other DNA
accactcttggtcatgcacc

SEQ ID NO: 15597 - DNA, 20 bp, synthetic construct
  misc_feature 1..20: note = CRISPR gRNA sequence
  source 1..20: mol_type = other DNA
gtcatgcacccagaccacct

SEQ ID NO: 15598 - DNA, 20 bp, synthetic construct
  misc_feature 1..20: note = CRISPR gRNA sequence
  source 1..20: mol_type = other DNA
tcatgcacccagaccacctc

SEQ ID NO: 15599 - DNA, 20 bp, synthetic construct
  misc_feature 1..20: note = CRISPR gRNA sequence
  source 1..20: mol_type = other DNA
tgctcttctgctttgatttt

SEQ ID NO: 15600 - DNA, 20 bp, synthetic construct
  misc_feature 1..20: note = CRISPR gRNA sequence
  source 1..20: mol_type = other DNA
gctcttctgctttgattttt

SEQ ID NO: 15601 - DNA, 20 bp, synthetic construct
  misc_feature 1..20: note = CRISPR gRNA sequence
  source 1..20: mol_type = other DNA
ctgctttgatttttgggaaa

SEQ ID NO: 15602 - DNA, 20 bp, synthetic construct
  misc_feature 1..20: note = CRISPR gRNA sequence
  source 1..20: mol_type = other DNA
tgctttgatttttgggaaat

SEQ ID NO: 15603 - DNA, 20 bp, synthetic construct
  misc_feature 1..20: note = CRISPR gRNA sequence
  source 1..20: mol_type = other DNA
gctttgatttttgggaaata

SEQ ID NO: 15604 - DNA, 20 bp, synthetic construct
  misc_feature 1..20: note = CRISPR gRNA sequence
  source 1..20: mol_type = other DNA
tgatttttgggaaataggga

SEQ ID NO: 15605 - DNA, 20 bp, synthetic construct
  misc_feature 1..20: note = CRISPR gRNA sequence
  source 1..20: mol_type = other DNA
atttttgggaaatagggaca

SEQ ID NO: 15606 - DNA, 20 bp, synthetic construct
  misc_feature 1..20: note = CRISPR gRNA sequence
  source 1..20: mol_type = other DNA
ttgggaaatagggacagaga

SEQ ID NO: 15607 - DNA, 20 bp, synthetic construct
  misc_feature 1..20: note = CRISPR gRNA sequence
  source 1..20: mol_type = other DNA
agggacagagaaagttgtgc

SEQ ID NO: 15608 - DNA, 20 bp, synthetic construct
  misc_feature 1..20: note = CRISPR gRNA sequence
  source 1..20: mol_type = other DNA
gggacagagaaagttgtgct

SEQ ID NO: 15609 - DNA, 20 bp, synthetic construct
  misc_feature 1..20: note = CRISPR gRNA sequence
  source 1..20: mol_type = other DNA
ggacagagaaagttgtgctg

SEQ ID NO: 15610 - DNA, 20 bp, synthetic construct
  misc_feature 1..20: note = CRISPR gRNA sequence
  source 1..20: mol_type = other DNA
acagagaaagttgtgctggg

SEQ ID NO: 15611 - DNA, 20 bp, synthetic construct
  misc_feature 1..20: note = CRISPR gRNA sequence
  source 1..20: mol_type = other DNA
cagagaaagttgtgctgggg

SEQ ID NO: 15612 - DNA, 20 bp, synthetic construct
  misc_feature 1..20: note = CRISPR gRNA sequence
  source 1..20: mol_type = other DNA
agagaaagttgtgctgggga

SEQ ID NO: 15613 - DNA, 20 bp, synthetic construct
  misc_feature 1..20: note = CRISPR gRNA sequence
  source 1..20: mol_type = other DNA
agaaagttgtgctggggagg

SEQ ID NO: 15614 - DNA, 20 bp, synthetic construct
  misc_feature 1..20: note = CRISPR gRNA sequence
  source 1..20: mol_type = other DNA
gaaagttgtgctggggaggg

SEQ ID NO: 15615 - DNA, 20 bp, synthetic construct
  misc_feature 1..20: note = CRISPR gRNA sequence
  source 1..20: mol_type = other DNA
tgctggggagggaggatcat

SEQ ID NO: 15616 - DNA, 20 bp, synthetic construct
  misc_feature 1..20: note = CRISPR gRNA sequence
  source 1..20: mol_type = other DNA
tggggagggaggatcatgag

SEQ ID NO: 15617 - DNA, 20 bp, synthetic construct
  misc_feature 1..20: note = CRISPR gRNA sequence
  source 1..20: mol_type = other DNA
ggggagggaggatcatgaga

SEQ ID NO: 15618 - DNA, 20 bp, synthetic construct
  misc_feature 1..20: note = CRISPR gRNA sequence
  source 1..20: mol_type = other DNA
ggaggatcatgagaaggtgc

SEQ ID NO: 15619 - DNA, 20 bp, synthetic construct
  misc_feature 1..20: note = CRISPR gRNA sequence
  source 1..20: mol_type = other DNA
gaggatcatgagaaggtgct

SEQ ID NO: 15620 - DNA, 20 bp, synthetic construct
  misc_feature 1..20: note = CRISPR gRNA sequence
  source 1..20: mol_type = other DNA
aggatcatgagaaggtgcta

SEQ ID NO: 15621 - DNA, 20 bp, synthetic construct
  misc_feature 1..20: note = CRISPR gRNA sequence
  source 1..20: mol_type = other DNA
ggtgctagggcaccactgcc

SEQ ID NO: 15622 - DNA, 20 bp, synthetic construct
  misc_feature 1..20: note = CRISPR gRNA sequence
  source 1..20: mol_type = other DNA
gggcaccactgccaagtgca

SEQ ID NO: 15623 - DNA, 20 bp, synthetic construct
  misc_feature 1..20: note = CRISPR gRNA sequence
  source 1..20: mol_type = other DNA
gcaccactgccaagtgcatg

SEQ ID NO: 15624 - DNA, 20 bp, synthetic construct
  misc_feature 1..20: note = CRISPR gRNA sequence
  source 1..20: mol_type = other DNA
actgccaagtgcatggagta

SEQ ID NO: 15625 - DNA, 20 bp, synthetic construct
  misc_feature 1..20: note = CRISPR gRNA sequence
  source 1..20: mol_type = other DNA
ctgccaagtgcatggagtat

SEQ ID NO: 15626 - DNA, 20 bp, synthetic construct
  misc_feature 1..20: note = CRISPR gRNA sequence
  source 1..20: mol_type = other DNA
tgccaagtgcatggagtatg

SEQ ID NO: 15627 - DNA, 20 bp, synthetic construct
  misc_feature 1..20: note = CRISPR gRNA sequence
  source 1..20: mol_type = other DNA
ccaagtgcatggagtatggg

SEQ ID NO: 15628 - DNA, 20 bp, synthetic construct
  misc_feature 1..20: note = CRISPR gRNA sequence
  source 1..20: mol_type = other DNA
caagtgcatggagtatgggg

SEQ ID NO: 15629 - DNA, 20 bp, synthetic construct
  misc_feature 1..20: note = CRISPR gRNA sequence
  source 1..20: mol_type = other DNA
gcatggagtatggggaggat

SEQ ID NO: 15630 - DNA, 20 bp, synthetic construct
  misc_feature 1..20: note = CRISPR gRNA sequence
  source 1..20: mol_type = other DNA
catggagtatggggaggatg

SEQ ID NO: 15631 - DNA, 20 bp, synthetic construct
  misc_feature 1..20: note = CRISPR gRNA sequence
  source 1..20: mol_type = other DNA
gagtatggggaggatgaggt

SEQ ID NO: 15632 - DNA, 20 bp, synthetic construct
  misc_feature 1..20: note = CRISPR gRNA sequence
  source 1..20: mol_type = other DNA
agtatggggaggatgaggtc

SEQ ID NO: 15633 - DNA, 20 bp, synthetic construct
  misc_feature 1..20: note = CRISPR gRNA sequence
  source 1..20: mol_type = other DNA
gtatggggaggatgaggtca

SEQ ID NO: 15634 - DNA, 20 bp, synthetic construct
  misc_feature 1..20: note = CRISPR gRNA sequence
  source 1..20: mol_type = other DNA
atggggaggatgaggtcagg

SEQ ID NO: 15635 - DNA, 20 bp, synthetic construct
  misc_feature 1..20: note = CRISPR gRNA sequence
  source 1..20: mol_type = other DNA
gggaggatgaggtcagggag

SEQ ID NO: 15636 - DNA, 20 bp, synthetic construct
  misc_feature 1..20: note = CRISPR gRNA sequence
  source 1..20: mol_type = other DNA
ggatgaggtcagggagcagt

SEQ ID NO: 15637 - DNA, 20 bp, synthetic construct
  misc_feature 1..20: note = CRISPR gRNA sequence
  source 1..20: mol_type = other DNA
gatgaggtcagggagcagtc

SEQ ID NO: 15638 - DNA, 20 bp, synthetic construct
  misc_feature 1..20: note = CRISPR gRNA sequence
  source 1..20: mol_type = other DNA
gaggtcagggagcagtcagg

SEQ ID NO: 15639 - DNA, 20 bp, synthetic construct
  misc_feature 1..20: note = CRISPR gRNA sequence
  source 1..20: mol_type = other DNA
aggtcagggagcagtcaggt

SEQ ID NO: 15640 - DNA, 20 bp, synthetic construct
  misc_feature 1..20: note = CRISPR gRNA sequence
  source 1..20: mol_type = other DNA
gtcagggagcagtcaggtag

SEQ ID NO: 15641 - DNA, 20 bp, synthetic construct
  misc_feature 1..20: note = CRISPR gRNA sequence
  source 1..20: mol_type = other DNA
tcagggagcagtcaggtagg

SEQ ID NO: 15642 - DNA, 20 bp, synthetic construct
  misc_feature 1..20: note = CRISPR gRNA sequence
  source 1..20: mol_type = other DNA
cagggagcagtcaggtagga

SEQ ID NO: 15643 - DNA, 20 bp, synthetic construct
  misc_feature 1..20: note = CRISPR gRNA sequence
  source 1..20: mol_type = other DNA
gggagcagtcaggtaggagg

SEQ ID NO: 15644 - DNA, 20 bp, synthetic construct
  misc_feature 1..20: note = CRISPR gRNA sequence
  source 1..20: mol_type = other DNA
gagcagtcaggtaggaggga

SEQ ID NO: 15645 - DNA, 20 bp, synthetic construct
  misc_feature 1..20: note = CRISPR gRNA sequence
  source 1..20: mol_type = other DNA
agcagtcaggtaggagggag

SEQ ID NO: 15646 - DNA, 20 bp, synthetic construct
  misc_feature 1..20: note = CRISPR gRNA sequence
  source 1..20: mol_type = other DNA
agtcaggtaggagggagagg

SEQ ID NO: 15647 - DNA, 20 bp, synthetic construct
  misc_feature 1..20: note = CRISPR gRNA sequence
  source 1..20: mol_type = other DNA
aggtaggagggagaggtggt

SEQ ID NO: 15648 - DNA, 20 bp, synthetic construct
  misc_feature 1..20: note = CRISPR gRNA sequence
  source 1..20: mol_type = other DNA
ggtaggagggagaggtggtc

SEQ ID NO: 15649 - DNA, 20 bp, synthetic construct
  misc_feature 1..20: note = CRISPR gRNA sequence
  source 1..20: mol_type = other DNA
gtaggagggagaggtggtcg

SEQ ID NO: 15650 - DNA, 20 bp, synthetic construct
  misc_feature 1..20: note = CRISPR gRNA sequence
  source 1..20: mol_type = other DNA
aggagggagaggtggtcggg

SEQ ID NO: 15651 - DNA, 20 bp, synthetic construct
  misc_feature 1..20: note = CRISPR gRNA sequence
  source 1..20: mol_type = other DNA
gggagaggtggtcggggagc

SEQ ID NO: 15652 - DNA, 20 bp, synthetic construct
  misc_feature 1..20: note = CRISPR gRNA sequence
  source 1..20: mol_type = other DNA
ggagaggtggtcggggagcc

SEQ ID NO: 15653 - DNA, 20 bp, synthetic construct
  misc_feature 1..20: note = CRISPR gRNA sequence
  source 1..20: mol_type = other DNA
gccaggccccgcactcacca

SEQ ID NO: 15654 - DNA, 20 bp, synthetic construct
  misc_feature 1..20: note = CRISPR gRNA sequence
  source 1..20: mol_type = other DNA
aggccccgcactcaccatgg

SEQ ID NO: 15655 - DNA, 20 bp, synthetic construct
  misc_feature 1..20: note = CRISPR gRNA sequence
  source 1..20: mol_type = other DNA
accatggtagatgaatatac

SEQ ID NO: 15656 - DNA, 20 bp, synthetic construct
  misc_feature 1..20: note = CRISPR gRNA sequence
  source 1..20: mol_type = other DNA
catggtagatgaatatactg

SEQ ID NO: 15657 - DNA, 20 bp, synthetic construct
  misc_feature 1..20: note = CRISPR gRNA sequence
  source 1..20: mol_type = other DNA
tatactggagacccctgttc

SEQ ID NO: 15658 - DNA, 20 bp, synthetic construct
  misc_feature 1..20: note = CRISPR gRNA sequence
  source 1..20: mol_type = other DNA
ggagacccctgttccagcct

SEQ ID NO: 15659 - DNA, 20 bp, synthetic construct
  misc_feature 1..20: note = CRISPR gRNA sequence
  source 1..20: mol_type = other DNA
agacccctgttccagcctca

SEQ ID NO: 15660 - DNA, 20 bp, synthetic construct
  misc_feature 1..20: note = CRISPR gRNA sequence
  source 1..20: mol_type = other DNA
ttccagcctcagagatttgc

SEQ ID NO: 15661 - DNA, 20 bp, synthetic construct
  misc_feature 1..20: note = CRISPR gRNA sequence
  source 1..20: mol_type = other DNA
ccagcctcagagatttgcca

SEQ ID NO: 15662 - DNA, 20 bp, synthetic construct
  misc_feature 1..20: note = CRISPR gRNA sequence
  source 1..20: mol_type = other DNA
cagagatttgccagagccca

SEQ ID NO: 15663 - DNA, 20 bp, synthetic construct
  misc_feature 1..20: note = CRISPR gRNA sequence
  source 1..20: mol_type = other DNA
agagatttgccagagcccat

SEQ ID NO: 15664 - DNA, 20 bp, synthetic construct
  misc_feature 1..20: note = CRISPR gRNA sequence
  source 1..20: mol_type = other DNA
gagatttgccagagcccatg

SEQ ID NO: 15665 - DNA, 20 bp, synthetic construct
  misc_feature 1..20: note = CRISPR gRNA sequence
  source 1..20: mol_type = other DNA
atttgccagagcccatgggg

SEQ ID NO: 15666 - DNA, 20 bp, synthetic construct
  misc_feature 1..20: note = CRISPR gRNA sequence
  source 1..20: mol_type = other DNA
ttgccagagcccatggggca

SEQ ID NO: 15667 - DNA, 20 bp, synthetic construct
  misc_feature 1..20: note = CRISPR gRNA sequence
  source 1..20: mol_type = other DNA
ccagagcccatggggcagag

SEQ ID NO: 15668 - DNA, 20 bp, synthetic construct
  misc_feature 1..20: note = CRISPR gRNA sequence
  source 1..20: mol_type = other DNA
agagcccatggggcagagtg

SEQ ID NO: 15669 - DNA, 20 bp, synthetic construct
  misc_feature 1..20: note = CRISPR gRNA sequence
  source 1..20: mol_type = other DNA
cccatggggcagagtggaga

SEQ ID NO: 15670 - DNA, 20 bp, synthetic construct
  misc_feature 1..20: note = CRISPR gRNA sequence
  source 1..20: mol_type = other DNA
atggggcagagtggagatgg

SEQ ID NO: 15671 - DNA, 20 bp, synthetic construct
  misc_feature 1..20: note = CRISPR gRNA sequence
  source 1..20: mol_type = other DNA
tggggcagagtggagatggt

SEQ ID NO: 15672 - DNA, 20 bp, synthetic construct
  misc_feature 1..20: note = CRISPR gRNA sequence
  source 1..20: mol_type = other DNA
ggggcagagtggagatggtg

SEQ ID NO: 15673 - DNA, 20 bp, synthetic construct
  misc_feature 1..20: note = CRISPR gRNA sequence
  source 1..20: mol_type = other DNA
tggagatggtggggacaaac

SEQ ID NO: 15674 - DNA, 20 bp, synthetic construct
  misc_feature 1..20: note = CRISPR gRNA sequence
  source 1..20: mol_type = other DNA
gatggtggggacaaactgga

SEQ ID NO: 15675 - DNA, 20 bp, synthetic construct
  misc_feature 1..20: note = CRISPR gRNA sequence
  source 1..20: mol_type = other DNA
atggtggggacaaactggat

SEQ ID NO: 15676 - DNA, 20 bp, synthetic construct
  misc_feature 1..20: note = CRISPR gRNA sequence
  source 1..20: mol_type = other DNA
gacaaactggatgggtccct

SEQ ID NO: 15677 - DNA, 20 bp, synthetic construct
  misc_feature 1..20: note = CRISPR gRNA sequence
  source 1..20: mol_type = other DNA
acaaactggatgggtccctc

SEQ ID NO: 15678 - DNA, 20 bp, synthetic construct
  misc_feature 1..20: note = CRISPR gRNA sequence
  source 1..20: mol_type = other DNA
caaactggatgggtccctca

SEQ ID NO: 15679 - DNA, 20 bp, synthetic construct
  misc_feature 1..20: note = CRISPR gRNA sequence
  source 1..20: mol_type = other DNA
aactggatgggtccctcagg

SEQ ID NO: 15680 - DNA, 20 bp, synthetic construct
  misc_feature 1..20: note = CRISPR gRNA sequence
  source 1..20: mol_type = other DNA
atgggtccctcagggagatt

SEQ ID NO: 15681 - DNA, 20 bp, synthetic construct
  misc_feature 1..20: note = CRISPR gRNA sequence
  source 1..20: mol_type = other DNA
tgggtccctcagggagattc

SEQ ID NO: 15682 - DNA, 20 bp, synthetic construct
  misc_feature 1..20: note = CRISPR gRNA sequence
  source 1..20: mol_type = other DNA
gtccctcagggagattcagg

SEQ ID NO: 15683 - DNA, 20 bp, synthetic construct
  misc_feature 1..20: note = CRISPR gRNA sequence
  source 1..20: mol_type = other DNA
ggagattcaggcagctcaac

SEQ ID NO: 15684 - DNA, 20 bp, synthetic construct
  misc_feature 1..20: note = CRISPR gRNA sequence
  source 1..20: mol_type = other DNA
gagattcaggcagctcaacg

SEQ ID NO: 15685 - DNA, 20 bp, synthetic construct
  misc_feature 1..20: note = CRISPR gRNA sequence
  source 1..20: mol_type = other DNA
caggcagctcaacgaggaac

SEQ ID NO: 15686 - DNA, 20 bp, synthetic construct
  misc_feature 1..20: note = CRISPR gRNA sequence
  source 1..20: mol_type = other DNA
ggcagctcaacgaggaactg

SEQ ID NO: 15687 - DNA, 20 bp, synthetic construct
  misc_feature 1..20: note = CRISPR gRNA sequence
  source 1..20: mol_type = other DNA
gctcaacgaggaactggaga

SEQ ID NO: 15688 - DNA, 20 bp, synthetic construct
  misc_feature 1..20: note = CRISPR gRNA sequence
  source 1..20: mol_type = other DNA
ctcaacgaggaactggagaa

SEQ ID NO: 15689 - DNA, 20 bp, synthetic construct
  misc_feature 1..20: note = CRISPR gRNA sequence
  source 1..20: mol_type = other DNA
gaactggagaaaggcactgc

SEQ ID NO: 15690 - DNA, 20 bp, synthetic construct
  misc_feature 1..20: note = CRISPR gRNA sequence
  source 1..20: mol_type = other DNA
actggagaaaggcactgcaa

SEQ ID NO: 15691 - DNA, 20 bp, synthetic construct
  misc_feature 1..20: note = CRISPR gRNA sequence
  source 1..20: mol_type = other DNA
gaaaggcactgcaagagaca

SEQ ID NO: 15692 - DNA, 20 bp, synthetic construct
  misc_feature 1..20: note = CRISPR gRNA sequence
  source 1..20: mol_type = other DNA
aaaggcactgcaagagacaa

SEQ ID NO: 15693 - DNA, 20 bp, synthetic construct
  misc_feature 1..20: note = CRISPR gRNA sequence
  source 1..20: mol_type = other DNA
ggcactgcaagagacaaagg

SEQ ID NO: 15694 - DNA, 20 bp, synthetic construct
  misc_feature 1..20: note = CRISPR gRNA sequence
  source 1..20: mol_type = other DNA
ctgcaagagacaaaggcagt

SEQ ID NO: 15695 - DNA, 20 bp, synthetic construct
  misc_feature 1..20: note = CRISPR gRNA sequence
  source 1..20: mol_type = other DNA
tgcaagagacaaaggcagtg

SEQ ID NO: 15696 - DNA, 20 bp, synthetic construct
  misc_feature 1..20: note = CRISPR gRNA sequence
  source 1..20: mol_type = other DNA
aagagacaaaggcagtgagg

SEQ ID NO: 15697 - DNA, 20 bp, synthetic construct
  misc_feature 1..20: note = CRISPR gRNA sequence
  source 1..20: mol_type = other DNA
agagacaaaggcagtgaggt

SEQ ID NO: 15698 - DNA, 20 bp, synthetic construct
  misc_feature 1..20: note = CRISPR gRNA sequence
  source 1..20: mol_type = other DNA
cagtgaggtgggatcttgca

SEQ ID NO: 15699 - DNA, 20 bp, synthetic construct
  misc_feature 1..20: note = CRISPR gRNA sequence
  source 1..20: mol_type = other DNA
attaatgtctgaccccccta

SEQ ID NO: 15700 - DNA, 20 bp, synthetic construct
  misc_feature 1..20: note = CRISPR gRNA sequence
  source 1..20: mol_type = other DNA
ttaatgtctgacccccctaa

SEQ ID NO: 15701 - DNA, 20 bp, synthetic construct
  misc_feature 1..20: note = CRISPR gRNA sequence
  source 1..20: mol_type = other DNA
taatgtctgacccccctaaa

SEQ ID NO: 15702 - DNA, 20 bp, synthetic construct
  misc_feature 1..20: note = CRISPR gRNA sequence
  source 1..20: mol_type = other DNA
taaagggccctaatttccct

SEQ ID NO: 15703 - DNA, 20 bp, synthetic construct
  misc_feature 1..20: note = CRISPR gRNA sequence
  source 1..20: mol_type = other DNA
aagggccctaatttccctaa

SEQ ID NO: 15704 - DNA, 20 bp, synthetic construct
  misc_feature 1..20: note = CRISPR gRNA sequence
  source 1..20: mol_type = other DNA
ggccctaatttccctaagag

SEQ ID NO: 15705 - DNA, 20 bp, synthetic construct
  misc_feature 1..20: note = CRISPR gRNA sequence
  source 1..20: mol_type = other DNA
cctaatttccctaagagcag

SEQ ID NO: 15706 - DNA, 20 bp, synthetic construct
  misc_feature 1..20: note = CRISPR gRNA sequence
  source 1..20: mol_type = other DNA
ctgtttctgtcctgccctga

SEQ ID NO: 15707 - DNA, 20 bp, synthetic construct
  misc_feature 1..20: note = CRISPR gRNA sequence
  source 1..20: mol_type = other DNA
tcctgccctgatggaattct

SEQ ID NO: 15708 - DNA, 20 bp, synthetic construct
  misc_feature 1..20: note = CRISPR gRNA sequence
  source 1..20: mol_type = other DNA
ctgatggaattcttagcacc

SEQ ID NO: 15709 - DNA, 20 bp, synthetic construct
  misc_feature 1..20: note = CRISPR gRNA sequence
  source 1..20: mol_type = other DNA
atggaattcttagcacctag

SEQ ID NO: 15710 - DNA, 20 bp, synthetic construct
  misc_feature 1..20: note = CRISPR gRNA sequence
  source 1..20: mol_type = other DNA
ggaattcttagcacctagca

SEQ ID NO: 15711 - DNA, 20 bp, synthetic construct
  misc_feature 1..20: note = CRISPR gRNA sequence
  source 1..20: mol_type = other DNA
attcttagcacctagcagag

SEQ ID NO: 15712 - DNA, 20 bp, synthetic construct
  misc_feature 1..20: note = CRISPR gRNA sequence
  source 1..20: mol_type = other DNA
ttagcacctagcagagcagt

SEQ ID NO: 15713 - DNA, 20 bp, synthetic construct
  misc_feature 1..20: note = CRISPR gRNA sequence
  source 1..20: mol_type = other DNA
acctagcagagcagttggca

SEQ ID NO: 15714 - DNA, 20 bp, synthetic construct
  misc_feature 1..20: note = CRISPR gRNA sequence
  source 1..20: mol_type = other DNA
ctagcagagcagttggcaca

SEQ ID NO: 15715 - DNA, 20 bp, synthetic construct
  misc_feature 1..20: note = CRISPR gRNA sequence
  source 1..20: mol_type = other DNA
gcagagcagttggcacagag

SEQ ID NO: 15716 - DNA, 20 bp, synthetic construct
  misc_feature 1..20: note = CRISPR gRNA sequence
  source 1..20: mol_type = other DNA
cagagcagttggcacagaga

SEQ ID NO: 15717 - DNA, 20 bp, synthetic construct
  misc_feature 1..20: note = CRISPR gRNA sequence
  source 1..20: mol_type = other DNA
agagcagttggcacagagaa

SEQ ID NO: 15718 - DNA, 20 bp, synthetic construct
  misc_feature 1..20: note = CRISPR gRNA sequence
  source 1..20: mol_type = other DNA
gagcagttggcacagagaag

SEQ ID NO: 15719 - DNA, 20 bp, synthetic construct
  misc_feature 1..20: note = CRISPR gRNA sequence
  source 1..20: mol_type = other DNA
cacagagaaggggctccatg

SEQ ID NO: 15720 - DNA, 20 bp, synthetic construct
  misc_feature 1..20: note = CRISPR gRNA sequence
  source 1..20: mol_type = other DNA
cagagaaggggctccatgaa

SEQ ID NO: 15721 - DNA, 20 bp, synthetic construct
  misc_feature 1..20: note = CRISPR gRNA sequence
  source 1..20: mol_type = other DNA
tgaagagctgatgaacgaat

SEQ ID NO: 15722 - DNA, 20 bp, synthetic construct
  misc_feature 1..20: note = CRISPR gRNA sequence
  source 1..20: mol_type = other DNA
gaagagctgatgaacgaata

SEQ ID NO: 15723 - DNA, 20 bp, synthetic construct
  misc_feature 1..20: note = CRISPR gRNA sequence
  source 1..20: mol_type = other DNA
agctgatgaacgaataaggc

SEQ ID NO: 15724 - DNA, 20 bp, synthetic construct
  misc_feature 1..20: note = CRISPR gRNA sequence
  source 1..20: mol_type = other DNA
tgatgaacgaataaggctgg

SEQ ID NO: 15725 - DNA, 20 bp, synthetic construct
  misc_feature 1..20: note = CRISPR gRNA sequence
  source 1..20: mol_type = other DNA
gatgaacgaataaggctggc

SEQ ID NO: 15726 - DNA, 20 bp, synthetic construct
  misc_feature 1..20: note = CRISPR gRNA sequence
  source 1..20: mol_type = other DNA
tggcaggtgaatgctctaat

SEQ ID NO: 15727 - DNA, 20 bp, synthetic construct
  misc_feature 1..20: note = CRISPR gRNA sequence
  source 1..20: mol_type = other DNA
caggtgaatgctctaattgg

SEQ ID NO: 15728 - DNA, 20 bp, synthetic construct
  misc_feature 1..20: note = CRISPR gRNA sequence
  source 1..20: mol_type = other DNA
ggtgaatgctctaattggtg

SEQ ID NO: 15729 - DNA, 20 bp, synthetic construct
  misc_feature 1..20: note = CRISPR gRNA sequence
  source 1..20: mol_type = other DNA
attccctcctgatgctcgca

SEQ ID NO: 15730 - DNA, 20 bp, synthetic construct
  misc_feature 1..20: note = CRISPR gRNA sequence
  source 1..20: mol_type = other DNA
gcacggatgtgtttccttct

SEQ ID NO: 15731 - DNA, 20 bp, synthetic construct
  misc_feature 1..20: note = CRISPR gRNA sequence
  source 1..20: mol_type = other DNA
cacggatgtgtttccttctg

SEQ ID NO: 15732 - DNA, 20 bp, synthetic construct
  misc_feature 1..20: note = CRISPR gRNA sequence
  source 1..20: mol_type = other DNA
ttctgaggcatgttctctgc

SEQ ID NO: 15733 - DNA, 20 bp, synthetic construct
  misc_feature 1..20: note = CRISPR gRNA sequence
  source 1..20: mol_type = other DNA
tctgaggcatgttctctgcc

SEQ ID NO: 15734 - DNA, 20 bp, synthetic construct
  misc_feature 1..20: note = CRISPR gRNA sequence
  source 1..20: mol_type = other DNA
ctgaggcatgttctctgcca

SEQ ID NO: 15735 - DNA, 20 bp, synthetic construct
  misc_feature 1..20: note = CRISPR gRNA sequence
  source 1..20: mol_type = other DNA
catgttctctgccagggatt

SEQ ID NO: 15736 - DNA, 20 bp, synthetic construct
  misc_feature 1..20: note = CRISPR gRNA sequence
  source 1..20: mol_type = other DNA
tctgccagggattgagctga

SEQ ID NO: 15737 - DNA, 20 bp, synthetic construct
  misc_feature 1..20: note = CRISPR gRNA sequence
  source 1..20: mol_type = other DNA
ctgccagggattgagctgac

SEQ ID NO: 15738 - DNA, 20 bp, synthetic construct
  misc_feature 1..20: note = CRISPR gRNA sequence
  source 1..20: mol_type = other DNA
tgccagggattgagctgacg

SEQ ID NO: 15739 - DNA, 20 bp, synthetic construct
  misc_feature 1..20: note = CRISPR gRNA sequence
  source 1..20: mol_type = other DNA
gccagggattgagctgacgg

SEQ ID NO: 15740 - DNA, 20 bp, synthetic construct
  misc_feature 1..20: note = CRISPR gRNA sequence
  source 1..20: mol_type = other DNA
attgagctgacgggggcccc

SEQ ID NO: 15741 - DNA, 20 bp, synthetic construct
  misc_feature 1..20: note = CRISPR gRNA sequence
  source 1..20: mol_type = other DNA
ttgagctgacgggggcccca

SEQ ID NO: 15742 - DNA, 20 bp, synthetic construct
  misc_feature 1..20: note = CRISPR gRNA sequence
  source 1..20: mol_type = other DNA
gggggccccaaggataaaac

SEQ ID NO: 15743 - DNA, 20 bp, synthetic construct
  misc_feature 1..20: note = CRISPR gRNA sequence
  source 1..20: mol_type = other DNA
gccccaaggataaaactggc

SEQ ID NO: 15744 - DNA, 20 bp, synthetic construct
  misc_feature 1..20: note = CRISPR gRNA sequence
  source 1..20: mol_type = other DNA
ccccaaggataaaactggct

SEQ ID NO: 15745 - DNA, 20 bp, synthetic construct
  misc_feature 1..20: note = CRISPR gRNA sequence
  source 1..20: mol_type = other DNA
cccaaggataaaactggctg

SEQ ID NO: 15746 - DNA, 20 bp, synthetic construct
  misc_feature 1..20: note = CRISPR gRNA sequence
  source 1..20: mol_type = other DNA
aaggataaaactggctgggg

SEQ ID NO: 15747 - DNA, 20 bp, synthetic construct
  misc_feature 1..20: note = CRISPR gRNA sequence
  source 1..20: mol_type = other DNA
ggataaaactggctggggca

SEQ ID NO: 15748 - DNA, 20 bp, synthetic construct
  misc_feature 1..20: note = CRISPR gRNA sequence
  source 1..20: mol_type = other DNA
gataaaactggctggggcag

SEQ ID NO: 15749 - DNA, 20 bp, synthetic construct
  misc_feature 1..20: note = CRISPR gRNA sequence
  source 1..20: mol_type = other DNA
aaactggctggggcagaggt

SEQ ID NO: 15750 - DNA, 20 bp, synthetic construct
  misc_feature 1..20: note = CRISPR gRNA sequence
  source 1..20: mol_type = other DNA
gcagaggtgagtgacactga

SEQ ID NO: 15751 - DNA, 20 bp, synthetic construct
  misc_feature 1..20: note = CRISPR gRNA sequence
  source 1..20: mol_type = other DNA
cagaggtgagtgacactgat

SEQ ID NO: 15752 - DNA, 20 bp, synthetic construct
  misc_feature 1..20: note = CRISPR gRNA sequence
  source 1..20: mol_type = other DNA
agaggtgagtgacactgata

SEQ ID NO: 15753 - DNA, 20 bp, synthetic construct
  misc_feature 1..20: note = CRISPR gRNA sequence
  source 1..20: mol_type = other DNA
gtgagtgacactgatagggt

SEQ ID NO: 15754 - DNA, 20 bp, synthetic construct
  misc_feature 1..20: note = CRISPR gRNA sequence
  source 1..20: mol_type = other DNA
tgagtgacactgatagggtt

SEQ ID NO: 15755 - DNA, 20 bp, synthetic construct
  misc_feature 1..20: note = CRISPR gRNA sequence
  source 1..20: mol_type = other DNA
gagtgacactgatagggttg

SEQ ID NO: 15756 - DNA, 20 bp, synthetic construct
  misc_feature 1..20: note = CRISPR gRNA sequence
  source 1..20: mol_type = other DNA
gtgacactgatagggttggg

SEQ ID NO: 15757 - DNA, 20 bp, synthetic construct
  misc_feature 1..20: note = CRISPR gRNA sequence
  source 1..20: mol_type = other DNA
gacactgatagggttgggga

SEQ ID NO: 15758 - DNA, 20 bp, synthetic construct
  misc_feature 1..20: note = CRISPR gRNA sequence
  source 1..20: mol_type = other DNA
acactgatagggttggggag

SEQ ID NO: 15759 - DNA, 20 bp, synthetic construct
  misc_feature 1..20: note = CRISPR gRNA sequence
  source 1..20: mol_type = other DNA
tgatagggttggggagaggt

SEQ ID NO: 15760 - DNA, 20 bp, synthetic construct
  misc_feature 1..20: note = CRISPR gRNA sequence
  source 1..20: mol_type = other DNA
gatagggttggggagaggtg

SEQ ID NO: 15761 - DNA, 20 bp, synthetic construct
  misc_feature 1..20: note = CRISPR gRNA sequence
  source 1..20: mol_type = other DNA
ggttggggagaggtgaggtc

SEQ ID NO: 15762 - DNA, 20 bp, synthetic construct
  misc_feature 1..20: note = CRISPR gRNA sequence
  source 1..20: mol_type = other DNA
aggtgaggtccagttcctga

SEQ ID NO: 15763 - DNA, 20 bp, synthetic construct
  misc_feature 1..20: note = CRISPR gRNA sequence
  source 1..20: mol_type = other DNA
gttcctgacagtccctgcct

SEQ ID NO: 15764 - DNA, 20 bp, synthetic construct
  misc_feature 1..20: note = CRISPR gRNA sequence
  source 1..20: mol_type = other DNA
caactccttatccacctccc

SEQ ID NO: 15765 - DNA, 20 bp, synthetic construct
  misc_feature 1..20: note = CRISPR gRNA sequence
  source 1..20: mol_type = other DNA
actccttatccacctcccaa

SEQ ID NO: 15766 - DNA, 20 bp, synthetic construct
  misc_feature 1..20: note = CRISPR gRNA sequence
  source 1..20: mol_type = other DNA
ctccttatccacctcccaag

SEQ ID NO: 15767 - DNA, 20 bp, synthetic construct
  misc_feature 1..20: note = CRISPR gRNA sequence
  source 1..20: mol_type = other DNA
tccttatccacctcccaaga

SEQ ID NO: 15768 - DNA, 20 bp, synthetic construct
  misc_feature 1..20: note = CRISPR gRNA sequence
  source 1..20: mol_type = other DNA
cttatccacctcccaagagg

SEQ ID NO: 15769 - DNA, 20 bp, synthetic construct
  misc_feature 1..20: note = CRISPR gRNA sequence
  source 1..20: mol_type = other DNA
tccacctcccaagagggaga

SEQ ID NO: 15770 - DNA, 20 bp, synthetic construct
  misc_feature 1..20: note = CRISPR gRNA sequence
  source 1..20: mol_type = other DNA
ggagaaagcccactctctcc

SEQ ID NO: 15771 - DNA, 20 bp, synthetic construct
  misc_feature 1..20: note = CRISPR gRNA sequence
  source 1..20: mol_type = other DNA
ctccaagccccctaacatac

SEQ ID NO: 15772 - DNA, 20 bp, synthetic construct
  misc_feature 1..20: note = CRISPR gRNA sequence
  source 1..20: mol_type = other DNA
tccaagccccctaacatact

SEQ ID NO: 15773 - DNA, 20 bp, synthetic construct
  misc_feature 1..20: note = CRISPR gRNA sequence
  source 1..20: mol_type = other DNA
cccctaacatactgggaatc

SEQ ID NO: 15774 - DNA, 20 bp, synthetic construct
  misc_feature 1..20: note = CRISPR gRNA sequence
  source 1..20: mol_type = other DNA
taacatactgggaatctggt

SEQ ID NO: 15775 - DNA, 20 bp, synthetic construct
  misc_feature 1..20: note = CRISPR gRNA sequence
  source 1..20: mol_type = other DNA
ggaatctggtcggttttctc

SEQ ID NO: 15776 - DNA, 20 bp, synthetic construct
  misc_feature 1..20: note = CRISPR gRNA sequence
  source 1..20: mol_type = other DNA
gaatctggtcggttttctcc

SEQ ID NO: 15777 - DNA, 20 bp, synthetic construct
  misc_feature 1..20: note = CRISPR gRNA sequence
  source 1..20: mol_type = other DNA
cggttttctccaggcgcatc

SEQ ID NO: 15778 - DNA, 20 bp, synthetic construct
  misc_feature 1..20: note = CRISPR gRNA sequence
  source 1..20: mol_type = other DNA
tttctccaggcgcatctggc

SEQ ID NO: 15779 - DNA, 20 bp, synthetic construct
  misc_feature 1..20: note = CRISPR gRNA sequence
  source 1..20: mol_type = other DNA
tctccaggcgcatctggccg

SEQ ID NO: 15780 - DNA, 20 bp, synthetic construct
  misc_feature 1..20: note = CRISPR gRNA sequence
  source 1..20: mol_type = other DNA
ctccaggcgcatctggccgg

SEQ ID NO: 15781 - DNA, 20 bp, synthetic construct
  misc_feature 1..20: note = CRISPR gRNA sequence
  source 1..20: mol_type = other DNA
aggcgcatctggccggaggc

SEQ ID NO: 15782 - DNA, 20 bp, synthetic construct
  misc_feature 1..20: note = CRISPR gRNA sequence
  source 1..20: mol_type = other DNA
tctggccggaggctggctcc

SEQ ID NO: 15783 - DNA, 20 bp, synthetic construct
  misc_feature 1..20: note = CRISPR gRNA sequence
  source 1..20: mol_type = other DNA
gaggctggctcctggttgaa

SEQ ID NO: 15784 - DNA, 20 bp, synthetic construct
  misc_feature 1..20: note = CRISPR gRNA sequence
  source 1..20: mol_type = other DNA
tggctcctggttgaacagcg

SEQ ID NO: 15785 - DNA, 20 bp, synthetic construct
  misc_feature 1..20: note = CRISPR gRNA sequence
  source 1..20: mol_type = other DNA
ggctcctggttgaacagcgc

SEQ ID NO: 15786 - DNA, 20 bp, synthetic construct
  misc_feature 1..20: note = CRISPR gRNA sequence
  source 1..20: mol_type = other DNA
tcctggttgaacagcgcagg

SEQ ID NO: 15787 - DNA, 20 bp, synthetic construct
  misc_feature 1..20: note = CRISPR gRNA sequence
  source 1..20: mol_type = other DNA
tggttgaacagcgcaggcag

SEQ ID NO: 15788 - DNA, 20 bp, synthetic construct
  misc_feature 1..20: note = CRISPR gRNA sequence
  source 1..20: mol_type = other DNA
ttgaacagcgcaggcagtgg

SEQ ID NO: 15789 - DNA, 20 bp, synthetic construct
  misc_feature 1..20: note = CRISPR gRNA sequence
  source 1..20: mol_type = other DNA
tgaacagcgcaggcagtggc

SEQ ID NO: 15790 - DNA, 20 bp, synthetic construct
  misc_feature 1..20: note = CRISPR gRNA sequence
  source 1..20: mol_type = other DNA
acagcgcaggcagtggcagg

SEQ ID NO: 15791 - DNA, 20 bp, synthetic construct
  misc_feature 1..20: note = CRISPR gRNA sequence
  source 1..20: mol_type = other DNA
cagcgcaggcagtggcaggc

SEQ ID NO: 15792 - DNA, 20 bp, synthetic construct
  misc_feature 1..20: note = CRISPR gRNA sequence
  source 1..20: mol_type = other DNA
agcgcaggcagtggcaggca

SEQ ID NO: 15793 - DNA, 20 bp, synthetic construct
  misc_feature 1..20: note = CRISPR gRNA sequence
  source 1..20: mol_type = other DNA
gcaggcagtggcaggcaggg

SEQ ID NO: 15794 - DNA, 20 bp, synthetic construct
  misc_feature 1..20: note = CRISPR gRNA sequence
  source 1..20: mol_type = other DNA
caggcagtggcaggcagggc

SEQ ID NO: 15795 - DNA, 20 bp, synthetic construct
  misc_feature 1..20: note = CRISPR gRNA sequence
  source 1..20: mol_type = other DNA
aggcagtggcaggcagggca

SEQ ID NO: 15796 - DNA, 20 bp, synthetic construct
  misc_feature 1..20: note = CRISPR gRNA sequence
  source 1..20: mol_type = other DNA
cagtggcaggcagggcaggg

SEQ ID NO: 15797 - DNA, 20 bp, synthetic construct
  misc_feature 1..20: note = CRISPR gRNA sequence
  source 1..20: mol_type = other DNA
gtggcaggcagggcagggtg

SEQ ID NO: 15798 - DNA, 20 bp, synthetic construct
  misc_feature 1..20: note = CRISPR gRNA sequence
  source 1..20: mol_type = other DNA
gcaggcagggcagggtggag

SEQ ID NO: 15799 - DNA, 20 bp, synthetic construct
  misc_feature 1..20: note = CRISPR gRNA sequence
  source 1..20: mol_type = other DNA
agggtggagcagtcgctcac

SEQ ID NO: 15800 - DNA, 20 bp, synthetic construct
  misc_feature 1..20: note = CRISPR gRNA sequence
  source 1..20: mol_type = other DNA
cagtcgctcactggtctcac

SEQ ID NO: 15801 - DNA, 20 bp, synthetic construct
  misc_feature 1..20: note = CRISPR gRNA sequence
  source 1..20: mol_type = other DNA
agtcgctcactggtctcact

SEQ ID NO: 15802 - DNA, 20 bp, synthetic construct
  misc_feature 1..20: note = CRISPR gRNA sequence
  source 1..20: mol_type = other DNA
tcgctcactggtctcactag

SEQ ID NO: 15803 - DNA, 20 bp, synthetic construct
  misc_feature 1..20: note = CRISPR gRNA sequence
  source 1..20: mol_type = other DNA
tggtctcactaggagactgc

SEQ ID NO: 15804 - DNA, 20 bp, synthetic construct
  misc_feature 1..20: note = CRISPR gRNA sequence
  source 1..20: mol_type = other DNA
taggagactgccagtcacca

SEQ ID NO: 15805 - DNA, 20 bp, synthetic construct
  misc_feature 1..20: note = CRISPR gRNA sequence
  source 1..20: mol_type = other DNA
gagactgccagtcaccacag

SEQ ID NO: 15806 - DNA, 20 bp, synthetic construct
  misc_feature 1..20: note = CRISPR gRNA sequence
  source 1..20: mol_type = other DNA
agactgccagtcaccacagt

SEQ ID NO: 15807 - DNA, 20 bp, synthetic construct
  misc_feature 1..20: note = CRISPR gRNA sequence
  source 1..20: mol_type = other DNA
gactgccagtcaccacagtg

SEQ ID NO: 15808 - DNA, 20 bp, synthetic construct
  misc_feature 1..20: note = CRISPR gRNA sequence
  source 1..20: mol_type = other DNA
actgccagtcaccacagtgg

SEQ ID NO: 15809 - DNA, 20 bp, synthetic construct
  misc_feature 1..20: note = CRISPR gRNA sequence
  source 1..20: mol_type = other DNA
ctgccagtcaccacagtggg

SEQ ID NO: 15810 - DNA, 20 bp, synthetic construct
  misc_feature 1..20: note = CRISPR gRNA sequence
  source 1..20: mol_type = other DNA
agtcaccacagtggggggct

SEQ ID NO: 15811 - DNA, 20 bp, synthetic construct
  misc_feature 1..20: note = CRISPR gRNA sequence
  source 1..20: mol_type = other DNA
acagtggggggctcagctgt

SEQ ID NO: 15812 - DNA, 20 bp, synthetic construct
  misc_feature 1..20: note = CRISPR gRNA sequence
  source 1..20: mol_type = other DNA
cagtggggggctcagctgtg

SEQ ID NO: 15813 - DNA, 20 bp, synthetic construct
  misc_feature 1..20: note = CRISPR gRNA sequence
  source 1..20: mol_type = other DNA
tggggggctcagctgtgagg

SEQ ID NO: 15814 - DNA, 20 bp, synthetic construct
  misc_feature 1..20: note = CRISPR gRNA sequence
  source 1..20: mol_type = other DNA
ggggctcagctgtgaggaag

SEQ ID NO: 15815 - DNA, 20 bp, synthetic construct
  misc_feature 1..20: note = CRISPR gRNA sequence
  source 1..20: mol_type = other DNA
gggctcagctgtgaggaagt

SEQ ID NO: 15816 - DNA, 20 bp, synthetic construct
  misc_feature 1..20: note = CRISPR gRNA sequence
  source 1..20: mol_type = other DNA
tgtgaggaagtgggctgtgt

SEQ ID NO: 15817 - DNA, 20 bp, synthetic construct
  misc_feature 1..20: note = CRISPR gRNA sequence
  source 1..20: mol_type = other DNA
tgaggaagtgggctgtgtta

SEQ ID NO: 15818 - DNA, 20 bp, synthetic construct
  misc_feature 1..20: note = CRISPR gRNA sequence
  source 1..20: mol_type = other DNA
aagtgggctgtgttagagac

SEQ ID NO: 15819 - DNA, 20 bp, synthetic construct
  misc_feature 1..20: note = CRISPR gRNA sequence
  source 1..20: mol_type = other DNA
agtgggctgtgttagagact

SEQ ID NO: 15820 - DNA, 20 bp, synthetic construct
  misc_feature 1..20: note = CRISPR gRNA sequence
  source 1..20: mol_type = other DNA
tgtgttagagactgggtgct

SEQ ID NO: 15821 - DNA, 20 bp, synthetic construct
  misc_feature 1..20: note = CRISPR gRNA sequence
  source 1..20: mol_type = other DNA
tgttagagactgggtgcttg

SEQ ID NO: 15822 - DNA, 20 bp, synthetic construct
  misc_feature 1..20: note = CRISPR gRNA sequence
  source 1..20: mol_type = other DNA
gttagagactgggtgcttgg

SEQ ID NO: 15823 - DNA, 20 bp, synthetic construct
  misc_feature 1..20: note = CRISPR gRNA sequence
  source 1..20: mol_type = other DNA
ttagagactgggtgcttgga

SEQ ID NO: 15824 - DNA, 20 bp, synthetic construct
  misc_feature 1..20: note = CRISPR gRNA sequence
  source 1..20: mol_type = other DNA
tagagactgggtgcttggag

SEQ ID NO: 15825 - DNA, 20 bp, synthetic construct
  misc_feature 1..20: note = CRISPR gRNA sequence
  source 1..20: mol_type = other DNA
ggtgcttggaggggccttcc

SEQ ID NO: 15826 - DNA, 20 bp, synthetic construct
  misc_feature 1..20: note = CRISPR gRNA sequence
  source 1..20: mol_type = other DNA
gtgcttggaggggccttcct

SEQ ID NO: 15827 - DNA, 20 bp, synthetic construct
  misc_feature 1..20: note = CRISPR gRNA sequence
  source 1..20: mol_type = other DNA
ttggaggggccttcctggga

SEQ ID NO: 15828 - DNA, 20 bp, synthetic construct
  misc_feature 1..20: note = CRISPR gRNA sequence
  source 1..20: mol_type = other DNA
tggaggggccttcctgggat

SEQ ID NO: 15829 - DNA, 20 bp, synthetic construct
  misc_feature 1..20: note = CRISPR gRNA sequence
  source 1..20: mol_type = other DNA
ggaggggccttcctgggatg

SEQ ID NO: 15830 - DNA, 20 bp, synthetic construct
  misc_feature 1..20: note = CRISPR gRNA sequence
  source 1..20: mol_type = other DNA
aggggccttcctgggatggg

SEQ ID NO: 15831 - DNA, 20 bp, synthetic construct
  misc_feature 1..20: note = CRISPR gRNA sequence
  source 1..20: mol_type = other DNA
ggggccttcctgggatgggg

SEQ ID NO: 15832 - DNA, 20 bp, synthetic construct
  misc_feature 1..20: note = CRISPR gRNA sequence
  source 1..20: mol_type = other DNA
gggccttcctgggatgggga

SEQ ID NO: 15833 - DNA, 20 bp, synthetic construct
  misc_feature 1..20: note = CRISPR gRNA sequence
  source 1..20: mol_type = other DNA
tcctgggatggggagggccc

SEQ ID NO: 15834 - DNA, 20 bp, synthetic construct
  misc_feature 1..20: note = CRISPR gRNA sequence
  source 1..20: mol_type = other DNA
ctgggatggggagggccctg

SEQ ID NO: 15835 - DNA, 20 bp, synthetic construct
  misc_feature 1..20: note = CRISPR gRNA sequence
  source 1..20: mol_type = other DNA
ggatggggagggccctggag

SEQ ID NO: 15836 - DNA, 20 bp, synthetic construct
  misc_feature 1..20: note = CRISPR gRNA sequence
  source 1..20: mol_type = other DNA
gggagggccctggagtggca

SEQ ID NO: 15837 - DNA, 20 bp, synthetic construct
  misc_feature 1..20: note = CRISPR gRNA sequence
  source 1..20: mol_type = other DNA
ggcatggatgtctctcctga

SEQ ID NO: 15838 - DNA, 20 bp, synthetic construct
  misc_feature 1..20: note = CRISPR gRNA sequence
  source 1..20: mol_type = other DNA
catggatgtctctcctgaca

SEQ ID NO: 15839 - DNA, 20 bp, synthetic construct
  misc_feature 1..20: note = CRISPR gRNA sequence
  source 1..20: mol_type = other DNA
atggatgtctctcctgacag

SEQ ID NO: 15840 - DNA, 20 bp, synthetic construct
  misc_feature 1..20: note = CRISPR gRNA sequence
  source 1..20: mol_type = other DNA
ggaaatgcttgtcatcttct

SEQ ID NO: 15841 - DNA, 20 bp, synthetic construct
  misc_feature 1..20: note = CRISPR gRNA sequence
  source 1..20: mol_type = other DNA
gcttgtcatcttctcagccc

SEQ ID NO: 15842 - DNA, 20 bp, synthetic construct
  misc_feature 1..20: note = CRISPR gRNA sequence
  source 1..20: mol_type = other DNA
catcttctcagccctggctg

SEQ ID NO: 15843 - DNA, 20 bp, synthetic construct
  misc_feature 1..20: note = CRISPR gRNA sequence
  source 1..20: mol_type = other DNA
ctggctgcagctgtgttgat

SEQ ID NO: 15844 - DNA, 20 bp, synthetic construct
  misc_feature 1..20: note = CRISPR gRNA sequence
  source 1..20: mol_type = other DNA
gatcagcaactgctctgtgc

SEQ ID NO: 15845 - DNA, 20 bp, synthetic construct
  misc_feature 1..20: note = CRISPR gRNA sequence
  source 1..20: mol_type = other DNA
atcagcaactgctctgtgcc

SEQ ID NO: 15846 - DNA, 20 bp, synthetic construct
  misc_feature 1..20: note = CRISPR gRNA sequence
  source 1..20: mol_type = other DNA
agcaactgctctgtgccagg

SEQ ID NO: 15847 - DNA, 20 bp, synthetic construct
  misc_feature 1..20: note = CRISPR gRNA sequence
  source 1..20: mol_type = other DNA
ctctgtgccaggcagtcccc

SEQ ID NO: 15848 - DNA, 20 bp, synthetic construct
  misc_feature 1..20: note = CRISPR gRNA sequence
  source 1..20: mol_type = other DNA
ccagtcctctccttgtgact

SEQ ID NO: 15849 - DNA, 20 bp, synthetic construct
  misc_feature 1..20: note = CRISPR gRNA sequence
  source 1..20: mol_type = other DNA
tctccttgtgacttggctct

SEQ ID NO: 15850 - DNA, 20 bp, synthetic construct
  misc_feature 1..20: note = CRISPR gRNA sequence
  source 1..20: mol_type = other DNA
tccttgtgacttggctctga

SEQ ID NO: 15851 - DNA, 20 bp, synthetic construct
  misc_feature 1..20: note = CRISPR gRNA sequence
  source 1..20: mol_type = other DNA
ttggctctgagagctatgct

SEQ ID NO: 15852 - DNA, 20 bp, synthetic construct
  misc_feature 1..20: note = CRISPR gRNA sequence
  source 1..20: mol_type = other DNA
gctctgagagctatgctgag

SEQ ID NO: 15853 - DNA, 20 bp, synthetic construct
  misc_feature 1..20: note = CRISPR gRNA sequence
  source 1..20: mol_type = other DNA
ctctgagagctatgctgagc

SEQ ID NO: 15854 - DNA, 20 bp, synthetic construct
  misc_feature 1..20: note = CRISPR gRNA sequence
  source 1..20: mol_type = other DNA
agctatgctgagcaggaccc

SEQ ID NO: 15855 - DNA, 20 bp, synthetic construct
  misc_feature 1..20: note = CRISPR gRNA sequence
  source 1..20: mol_type = other DNA
gctatgctgagcaggaccct

SEQ ID NO: 15856 - DNA, 20 bp, synthetic construct
  misc_feature 1..20: note = CRISPR gRNA sequence
  source 1..20: mol_type = other DNA
ctatgctgagcaggacccta

SEQ ID NO: 15857 - DNA, 20 bp, synthetic construct
  misc_feature 1..20: note = CRISPR gRNA sequence
  source 1..20: mol_type = other DNA
aggaccctagggcctccaca

SEQ ID NO: 15858 - DNA, 20 bp, synthetic construct
  misc_feature 1..20: note = CRISPR gRNA sequence
  source 1..20: mol_type = other DNA
gaccctagggcctccacacg

SEQ ID NO: 15859 - DNA, 20 bp, synthetic construct
  misc_feature 1..20: note = CRISPR gRNA sequence
  source 1..20: mol_type = other DNA
ccctagggcctccacacgga

SEQ ID NO: 15860 - DNA, 20 bp, synthetic construct
  misc_feature 1..20: note = CRISPR gRNA sequence
  source 1..20: mol_type = other DNA
agggcctccacacggagagc

SEQ ID NO: 15861 - DNA, 20 bp, synthetic construct
  misc_feature 1..20: note = CRISPR gRNA sequence
  source 1..20: mol_type = other DNA
gggcctccacacggagagct

SEQ ID NO: 15862 - DNA, 20 bp, synthetic construct
  misc_feature 1..20: note = CRISPR gRNA sequence
  source 1..20: mol_type = other DNA
ggcctccacacggagagctg

SEQ ID NO: 15863 - DNA, 20 bp, synthetic construct
  misc_feature 1..20: note = CRISPR gRNA sequence
  source 1..20: mol_type = other DNA
ctccacacggagagctgggg

SEQ ID NO: 15864 - DNA, 20 bp, synthetic construct
  misc_feature 1..20: note = CRISPR gRNA sequence
  source 1..20: mol_type = other DNA
cacggagagctggggcagaa

SEQ ID NO: 15865 - DNA, 20 bp, synthetic construct
  misc_feature 1..20: note = CRISPR gRNA sequence
  source 1..20: mol_type = other DNA
agaacctatgaacaatctgt

SEQ ID NO: 15866 - DNA, 20 bp, synthetic construct
  misc_feature 1..20: note = CRISPR gRNA sequence
  source 1..20: mol_type = other DNA
atgaacaatctgttagctcc

SEQ ID NO: 15867 - DNA, 20 bp, synthetic construct
  misc_feature 1..20: note = CRISPR gRNA sequence
  source 1..20: mol_type = other DNA
cccctaccaccttccacaaa

SEQ ID NO: 15868 - DNA, 20 bp, synthetic construct
  misc_feature 1..20: note = CRISPR gRNA sequence
  source 1..20: mol_type = other DNA
caccttccacaaacagtcgt

SEQ ID NO: 15869 - DNA, 20 bp, synthetic construct
  misc_feature 1..20: note = CRISPR gRNA sequence
  source 1..20: mol_type = other DNA
acaaacagtcgtgagcccct

SEQ ID NO: 15870 - DNA, 20 bp, synthetic construct
  misc_feature 1..20: note = CRISPR gRNA sequence
  source 1..20: mol_type = other DNA
aaacagtcgtgagcccctta

SEQ ID NO: 15871 - DNA, 20 bp, synthetic construct
  misc_feature 1..20: note = CRISPR gRNA sequence
  source 1..20: mol_type = other DNA
aacagtcgtgagccccttag

SEQ ID NO: 15872 - DNA, 20 bp, synthetic construct
  misc_feature 1..20: note = CRISPR gRNA sequence
  source 1..20: mol_type = other DNA
tgagccccttagaggactct

SEQ ID NO: 15873 - DNA, 20 bp, synthetic construct
  misc_feature 1..20: note = CRISPR gRNA sequence
  source 1..20: mol_type = other DNA
gagccccttagaggactcta

SEQ ID NO: 15874 - DNA, 20 bp, synthetic construct
  misc_feature 1..20: note = CRISPR gRNA sequence
  source 1..20: mol_type = other DNA
agccccttagaggactctaa

SEQ ID NO: 15875 - DNA, 20 bp, synthetic construct
  misc_feature 1..20: note = CRISPR gRNA sequence
  source 1..20: mol_type = other DNA
agaggactctaagggacccc

SEQ ID NO: 15876 - DNA, 20 bp, synthetic construct
  misc_feature 1..20: note = CRISPR gRNA sequence
  source 1..20: mol_type = other DNA
tctaagggaccccaagctct

SEQ ID NO: 15877 - DNA, 20 bp, synthetic construct
  misc_feature 1..20: note = CRISPR gRNA sequence
  source 1..20: mol_type = other DNA
aagctctcagcctctaccca

SEQ ID NO: 15878 - DNA, 20 bp, synthetic construct
  misc_feature 1..20: note = CRISPR gRNA sequence
  source 1..20: mol_type = other DNA
ctctcagcctctacccaaag

SEQ ID NO: 15879 - DNA, 20 bp, synthetic construct
  misc_feature 1..20: note = CRISPR gRNA sequence
  source 1..20: mol_type = other DNA
tctcagcctctacccaaaga

SEQ ID NO: 15880 - DNA, 20 bp, synthetic construct
  misc_feature 1..20: note = CRISPR gRNA sequence
  source 1..20: mol_type = other DNA
ctcagcctctacccaaagaa

SEQ ID NO: 15881 - DNA, 20 bp, synthetic construct
  misc_feature 1..20: note = CRISPR gRNA sequence
  source 1..20: mol_type = other DNA
agcctctacccaaagaaggg

SEQ ID NO: 15882 - DNA, 20 bp, synthetic construct
  misc_feature 1..20: note = CRISPR gRNA sequence
  source 1..20: mol_type = other DNA
gcctctacccaaagaagggc

SEQ ID NO: 15883 - DNA, 20 bp, synthetic construct
  misc_feature 1..20: note = CRISPR gRNA sequence
  source 1..20: mol_type = other DNA
cctctacccaaagaagggca

SEQ ID NO: 15884 - DNA, 20 bp, synthetic construct
  misc_feature 1..20: note = CRISPR gRNA sequence
  source 1..20: mol_type = other DNA
ctctacccaaagaagggcag

SEQ ID NO: 15885 - DNA, 20 bp, synthetic construct
  misc_feature 1..20: note = CRISPR gRNA sequence
  source 1..20: mol_type = other DNA
gcaccatgcaccatccccat

SEQ ID NO: 15886 - DNA, 20 bp, synthetic construct
  misc_feature 1..20: note = CRISPR gRNA sequence
  source 1..20: mol_type = other DNA
tgcaccatccccatcagact

SEQ ID NO: 15887 - DNA, 20 bp, synthetic construct
  misc_feature 1..20: note = CRISPR gRNA sequence
  source 1..20: mol_type = other DNA
gcaccatccccatcagactt

SEQ ID NO: 15888 - DNA, 20 bp, synthetic construct
  misc_feature 1..20: note = CRISPR gRNA sequence
  source 1..20: mol_type = other DNA
catccccatcagacttgggc

SEQ ID NO: 15889 - DNA, 20 bp, synthetic construct
  misc_feature 1..20: note = CRISPR gRNA sequence
  source 1..20: mol_type = other DNA
atccccatcagacttgggcc

SEQ ID NO: 15890 - DNA, 20 bp, synthetic construct
  misc_feature 1..20: note = CRISPR gRNA sequence
  source 1..20: mol_type = other DNA
ccccatcagacttgggccag

SEQ ID NO: 15891 - DNA, 20 bp, synthetic construct
  misc_feature 1..20: note = CRISPR gRNA sequence
  source 1..20: mol_type = other DNA
atctcttccatcccctcccc

SEQ ID NO: 15892 - DNA, 20 bp, synthetic construct
  misc_feature 1..20: note = CRISPR gRNA sequence
  source 1..20: mol_type = other DNA
tctcttccatcccctcccca

SEQ ID NO: 15893 - DNA, 20 bp, synthetic construct
  misc_feature 1..20: note = CRISPR gRNA sequence
  source 1..20: mol_type = other DNA
gcatccacccttcccaaccc

SEQ ID NO: 15894 - DNA, 20 bp, synthetic construct
  misc_feature 1..20: note = CRISPR gRNA sequence
  source 1..20: mol_type = other DNA
gcccacctgccctgcacacc

SEQ ID NO: 15895 - DNA, 20 bp, synthetic construct
  misc_feature 1..20: note = CRISPR gRNA sequence
  source 1..20: mol_type = other DNA
tgccctgcacacctggcttc

SEQ ID NO: 15896 - DNA, 20 bp, synthetic construct
  misc_feature 1..20: note = CRISPR gRNA sequence
  source 1..20: mol_type = other DNA
acacctggcttccagtgctt

SEQ ID NO: 15897 - DNA, 20 bp, synthetic construct
  misc_feature 1..20: note = CRISPR gRNA sequence
  source 1..20: mol_type = other DNA
cacctggcttccagtgcttc

SEQ ID NO: 15898 - DNA, 20 bp, synthetic construct
  misc_feature 1..20: note = CRISPR gRNA sequence
  source 1..20: mol_type = other DNA
ttccagtgcttcaggtctgc

SEQ ID NO: 15899 - DNA, 20 bp, synthetic construct
  misc_feature 1..20: note = CRISPR gRNA sequence
  source 1..20: mol_type = other DNA
cagtgcttcaggtctgccgg

SEQ ID NO: 15900 - DNA, 20 bp, synthetic construct
  misc_feature 1..20: note = CRISPR gRNA sequence
  source 1..20: mol_type = other DNA
aggtctgccggaagctcctc

SEQ ID NO: 15901 - DNA, 20 bp, synthetic construct
  misc_feature 1..20: note = CRISPR gRNA sequence
  source 1..20: mol_type = other DNA
ggtctgccggaagctcctct

SEQ ID NO: 15902 - DNA, 20 bp, synthetic construct
  misc_feature 1..20: note = CRISPR gRNA sequence
  source 1..20: mol_type = other DNA
ctgccggaagctcctctggg

SEQ ID NO: 15903 - DNA, 20 bp, synthetic construct
  misc_feature 1..20: note = CRISPR gRNA sequence
  source 1..20: mol_type = other DNA
tgccggaagctcctctggga

SEQ ID NO: 15904 - DNA, 20 bp, synthetic construct
  misc_feature 1..20: note = CRISPR gRNA sequence
  source 1..20: mol_type = other DNA
aagctcctctgggaaggctg

SEQ ID NO: 15905 - DNA, 20 bp, synthetic construct
  misc_feature 1..20: note = CRISPR gRNA sequence
  source 1..20: mol_type = other DNA
gctcctctgggaaggctgca

SEQ ID NO: 15906 - DNA, 20 bp, synthetic construct
  misc_feature 1..20: note = CRISPR gRNA sequence
  source 1..20: mol_type = other DNA
ctgcagagaaaacatgtgat

SEQ ID NO: 15907 - DNA, 20 bp, synthetic construct
  misc_feature 1..20: note = CRISPR gRNA sequence
  source 1..20: mol_type = other DNA
aaacatgtgatcagctgccc

SEQ ID NO: 15908 - DNA, 20 bp, synthetic construct
  misc_feature 1..20: note = CRISPR gRNA sequence
  source 1..20: mol_type = other DNA
aacatgtgatcagctgcccc

SEQ ID NO: 15909 - DNA, 20 bp, synthetic construct
  misc_feature 1..20: note = CRISPR gRNA sequence
  source 1..20: mol_type = other DNA
acatgtgatcagctgcccca

SEQ ID NO: 15910 - DNA, 20 bp, synthetic construct
  misc_feature 1..20: note = CRISPR gRNA sequence
  source 1..20: mol_type = other DNA
atgtgatcagctgccccagg

SEQ ID NO: 15911 - DNA, 20 bp, synthetic construct
  misc_feature 1..20: note = CRISPR gRNA sequence
  source 1..20: mol_type = other DNA
gtgatcagctgccccaggga

SEQ ID NO: 15912 - DNA, 20 bp, synthetic construct
  misc_feature 1..20: note = CRISPR gRNA sequence
  source 1..20: mol_type = other DNA
tgatcagctgccccagggag

SEQ ID NO: 15913 - DNA, 20 bp, synthetic construct
  misc_feature 1..20: note = CRISPR gRNA sequence
  source 1..20: mol_type = other DNA
ccccagggagaggatgtccc

SEQ ID NO: 15914 - DNA, 20 bp, synthetic construct
  misc_feature 1..20: note = CRISPR gRNA sequence
  source 1..20: mol_type = other DNA
agggagaggatgtcccaagc

SEQ ID NO: 15915 - DNA, 20 bp, synthetic construct
  misc_feature 1..20: note = CRISPR gRNA sequence
  source 1..20: mol_type = other DNA
gagaggatgtcccaagccag

SEQ ID NO: 15916 - DNA, 20 bp, synthetic construct
  misc_feature 1..20: note = CRISPR gRNA sequence
  source 1..20: mol_type = other DNA
agaggatgtcccaagccaga

SEQ ID NO: 15917 - DNA, 20 bp, synthetic construct
  misc_feature 1..20: note = CRISPR gRNA sequence
  source 1..20: mol_type = other DNA
gaggatgtcccaagccagaa

SEQ ID NO: 15918 - DNA, 20 bp, synthetic construct
  misc_feature 1..20: note = CRISPR gRNA sequence
  source 1..20: mol_type = other DNA
aggatgtcccaagccagaag

SEQ ID NO: 15919 - DNA, 20 bp, synthetic construct
  misc_feature 1..20: note = CRISPR gRNA sequence
  source 1..20: mol_type = other DNA
gtcccaagccagaaggggct

SEQ ID NO: 15920 - DNA, 20 bp, synthetic construct
  misc_feature 1..20: note = CRISPR gRNA sequence
  source 1..20: mol_type = other DNA
tcccaagccagaaggggctc

SEQ ID NO: 15921 - DNA, 20 bp, synthetic construct
  misc_feature 1..20: note = CRISPR gRNA sequence
  source 1..20: mol_type = other DNA
ccagaaggggctcaggactc

SEQ ID NO: 15922 - DNA, 20 bp, synthetic construct
  misc_feature 1..20: note = CRISPR gRNA sequence
  source 1..20: mol_type = other DNA
gaaggggctcaggactctag

SEQ ID NO: 15923 - DNA, 20 bp, synthetic construct
  misc_feature 1..20: note = CRISPR gRNA sequence
  source 1..20: mol_type = other DNA
aaggggctcaggactctagc

SEQ ID NO: 15924 - DNA, 20 bp, synthetic construct
  misc_feature 1..20: note = CRISPR gRNA sequence
  source 1..20: mol_type = other DNA
caggactctagcaggctata

SEQ ID NO: 15925 - DNA, 20 bp, synthetic construct
  misc_feature 1..20: note = CRISPR gRNA sequence
  source 1..20: mol_type = other DNA
ggctatacggccttaacttc

SEQ ID NO: 15926 - DNA, 20 bp, synthetic construct
  misc_feature 1..20: note = CRISPR gRNA sequence
  source 1..20: mol_type = other DNA
gctatacggccttaacttca

SEQ ID NO: 15927 - DNA, 20 bp, synthetic construct
  misc_feature 1..20: note = CRISPR gRNA sequence
  source 1..20: mol_type = other DNA
tacggccttaacttcaaggc

SEQ ID NO: 15928 - DNA, 20 bp, synthetic construct
  misc_feature 1..20: note = CRISPR gRNA sequence
  source 1..20: mol_type = other DNA
acggccttaacttcaaggct

SEQ ID NO: 15929 - DNA, 20 bp, synthetic construct
  misc_feature 1..20: note = CRISPR gRNA sequence
  source 1..20: mol_type = other DNA
gccttaacttcaaggctggg

SEQ ID NO: 15930 - DNA, 20 bp, synthetic construct
  misc_feature 1..20: note = CRISPR gRNA sequence
  source 1..20: mol_type = other DNA
ttaacttcaaggctgggtag

SEQ ID NO: 15931 - DNA, 20 bp, synthetic construct
  misc_feature 1..20: note = CRISPR gRNA sequence
  source 1..20: mol_type = other DNA
tcaaggctgggtagtggtct

SEQ ID NO: 15932 - DNA, 20 bp, synthetic construct
  misc_feature 1..20: note = CRISPR gRNA sequence
  source 1..20: mol_type = other DNA
caaggctgggtagtggtctt

SEQ ID NO: 15933 - DNA, 20 bp, synthetic construct
  misc_feature 1..20: note = CRISPR gRNA sequence
  source 1..20: mol_type = other DNA
aaggctgggtagtggtcttg

SEQ ID NO: 15934 - DNA, 20 bp, synthetic construct
  misc_feature 1..20: note = CRISPR gRNA sequence
  source 1..20: mol_type = other DNA
aggctgggtagtggtcttgg

SEQ ID NO: 15935 - DNA, 20 bp, synthetic construct
  misc_feature 1..20: note = CRISPR gRNA sequence
  source 1..20: mol_type = other DNA
tcgctctaacattccaaccc

SEQ ID NO: 15936 - DNA, 20 bp, synthetic construct
  misc_feature 1..20: note = CRISPR gRNA sequence
  source 1..20: mol_type = other DNA
acattccaaccccagctcct

SEQ ID NO: 15937 - DNA, 20 bp, synthetic construct
  misc_feature 1..20: note = CRISPR gRNA sequence
  source 1..20: mol_type = other DNA
aaccccatctcaaaccatac

SEQ ID NO: 15938 - DNA, 20 bp, synthetic construct
  misc_feature 1..20: note = CRISPR gRNA sequence
  source 1..20: mol_type = other DNA
accccatctcaaaccatacc

SEQ ID NO: 15939 - DNA, 20 bp, synthetic construct
  misc_feature 1..20: note = CRISPR gRNA sequence
  source 1..20: mol_type = other DNA
ccatctcaaaccataccagg

SEQ ID NO: 15940 - DNA, 20 bp, synthetic construct
  misc_feature 1..20: note = CRISPR gRNA sequence
  source 1..20: mol_type = other DNA
tcaaaccataccaggcagtg

SEQ ID NO: 15941 - DNA, 20 bp, synthetic construct
  misc_feature 1..20: note = CRISPR gRNA sequence
  source 1..20: mol_type = other DNA
aaccataccaggcagtgtag

SEQ ID NO: 15942 - DNA, 20 bp, synthetic construct
  misc_feature 1..20: note = CRISPR gRNA sequence
  source 1..20: mol_type = other DNA
cataccaggcagtgtagcag

SEQ ID NO: 15943 - DNA, 20 bp, synthetic construct
  misc_feature 1..20: note = CRISPR gRNA sequence
  source 1..20: mol_type = other DNA
accaggcagtgtagcagcag

SEQ ID NO: 15944 - DNA, 20 bp, synthetic construct
  misc_feature 1..20: note = CRISPR gRNA sequence
  source 1..20: mol_type = other DNA
caggcagtgtagcagcagaa

SEQ ID NO: 15945 - DNA, 20 bp, synthetic construct
  misc_feature 1..20: note = CRISPR gRNA sequence
  source 1..20: mol_type = other DNA
aggcagtgtagcagcagaag

SEQ ID NO: 15946 - DNA, 20 bp, synthetic construct
  misc_feature 1..20: note = CRISPR gRNA sequence
  source 1..20: mol_type = other DNA
gtgtagcagcagaagaggcc

SEQ ID NO: 15947 - DNA, 20 bp, synthetic construct
  misc_feature 1..20: note = CRISPR gRNA sequence
  source 1..20: mol_type = other DNA
agaagaggccgagtcacaaa

SEQ ID NO: 15948 - DNA, 20 bp, synthetic construct
  misc_feature 1..20: note = CRISPR gRNA sequence
  source 1..20: mol_type = other DNA
gaagaggccgagtcacaaat

SEQ ID NO: 15949 - DNA, 20 bp, synthetic construct
  misc_feature 1..20: note = CRISPR gRNA sequence
  source 1..20: mol_type = other DNA
aagaggccgagtcacaaatg

SEQ ID NO: 15950 - DNA, 20 bp, synthetic construct
  misc_feature 1..20: note = CRISPR gRNA sequence
  source 1..20: mol_type = other DNA
tcacaaatggggacacaaca

SEQ ID NO: 15951 - DNA, 20 bp, synthetic construct
  misc_feature 1..20: note = CRISPR gRNA sequence
  source 1..20: mol_type = other DNA
cacaaatggggacacaacat

SEQ ID NO: 15952 - DNA, 20 bp, synthetic construct
  misc_feature 1..20: note = CRISPR gRNA sequence
  source 1..20: mol_type = other DNA
tggggacacaacatgggttt

SEQ ID NO: 15953 - DNA, 20 bp, synthetic construct
  misc_feature 1..20: note = CRISPR gRNA sequence
  source 1..20: mol_type = other DNA
aaacaaaacaaaacaaaaca

SEQ ID NO: 15954 - DNA, 20 bp, synthetic construct
  misc_feature 1..20: note = CRISPR gRNA sequence
  source 1..20: mol_type = other DNA
aacaaaacaaaacaaaacaa

SEQ ID NO: 15955 - DNA, 20 bp, synthetic construct
  misc_feature 1..20: note = CRISPR gRNA sequence
  source 1..20: mol_type = other DNA
cctgcttttgaaccgcttcc

SEQ ID NO: 15956 - DNA, 20 bp, synthetic construct
  misc_feature 1..20: note = CRISPR gRNA sequence
  source 1..20: mol_type = other DNA
agctgtgtgcctttgcaatg

SEQ ID NO: 15957 - DNA, 20 bp, synthetic construct
  misc_feature 1..20: note = CRISPR gRNA sequence
  source 1..20: mol_type = other DNA
ttgatctcacatctatgaaa

SEQ ID NO: 15958 - DNA, 20 bp, synthetic construct
  misc_feature 1..20: note = CRISPR gRNA sequence
  source 1..20: mol_type = other DNA
tgatctcacatctatgaaat

SEQ ID NO: 15959 - DNA, 20 bp, synthetic construct
  misc_feature 1..20: note = CRISPR gRNA sequence
  source 1..20: mol_type = other DNA
gatctcacatctatgaaatg

SEQ ID NO: 15960 - DNA, 20 bp, synthetic construct
  misc_feature 1..20: note = CRISPR gRNA sequence
  source 1..20: mol_type = other DNA
atctcacatctatgaaatgg

SEQ ID NO: 15961 - DNA, 20 bp, synthetic construct
  misc_feature 1..20: note = CRISPR gRNA sequence
  source 1..20: mol_type = other DNA
tcacatctatgaaatggggg

SEQ ID NO: 15962 - DNA, 20 bp, synthetic construct
  misc_feature 1..20: note = CRISPR gRNA sequence
  source 1..20: mol_type = other DNA
catctatgaaatgggggtgg

SEQ ID NO: 15963 - DNA, 20 bp, synthetic construct
  misc_feature 1..20: note = CRISPR gRNA sequence
  source 1..20: mol_type = other DNA
gggtggtggttcctacattg

SEQ ID NO: 15964 - DNA, 20 bp, synthetic construct
  misc_feature 1..20: note = CRISPR gRNA sequence
  source 1..20: mol_type = other DNA
ggtggtggttcctacattgc

SEQ ID NO: 15965 - DNA, 20 bp, synthetic construct
  misc_feature 1..20: note = CRISPR gRNA sequence
  source 1..20: mol_type = other DNA
tggtggttcctacattgcag

SEQ ID NO: 15966 - DNA, 20 bp, synthetic construct
  misc_feature 1..20: note = CRISPR gRNA sequence
  source 1..20: mol_type = other DNA
cctacattgcaggagtatgc

SEQ ID NO: 15967 - DNA, 20 bp, synthetic construct
  misc_feature 1..20: note = CRISPR gRNA sequence
  source 1..20: mol_type = other DNA
tgcaggagtatgccagaaat

SEQ ID NO: 15968 - DNA, 20 bp, synthetic construct
  misc_feature 1..20: note = CRISPR gRNA sequence
  source 1..20: mol_type = other DNA
ggagtatgccagaaatcagt

SEQ ID NO: 15969 - DNA, 20 bp, synthetic construct
  misc_feature 1..20: note = CRISPR gRNA sequence
  source 1..20: mol_type = other DNA
tatgccagaaatcagtgagt

SEQ ID NO: 15970 - DNA, 20 bp, synthetic construct
  misc_feature 1..20: note = CRISPR gRNA sequence
  source 1..20: mol_type = other DNA
gaaatcagtgagtgagtatc

SEQ ID NO: 15971 - DNA, 20 bp, synthetic construct
  misc_feature 1..20: note = CRISPR gRNA sequence
  source 1..20: mol_type = other DNA
gagtgagtatcaagcactca

SEQ ID NO: 15972 - DNA, 20 bp, synthetic construct
  misc_feature 1..20: note = CRISPR gRNA sequence
  source 1..20: mol_type = other DNA
gtatcaagcactcacagcaa

SEQ ID NO: 15973 - DNA, 20 bp, synthetic construct
  misc_feature 1..20: note = CRISPR gRNA sequence
  source 1..20: mol_type = other DNA
ttaaaaacccacgtgtccct

SEQ ID NO: 15974 - DNA, 20 bp, synthetic construct
  misc_feature 1..20: note = CRISPR gRNA sequence
  source 1..20: mol_type = other DNA
aaacccacgtgtcccttagc

SEQ ID NO: 15975 - DNA, 20 bp, synthetic construct
  misc_feature 1..20: note = CRISPR gRNA sequence
  source 1..20: mol_type = other DNA
aacccacgtgtcccttagca

SEQ ID NO: 15976 - DNA, 20 bp, synthetic construct
  misc_feature 1..20: note = CRISPR gRNA sequence
  source 1..20: mol_type = other DNA
acccacgtgtcccttagcaa

SEQ ID NO: 15977 - DNA, 20 bp, synthetic construct
  misc_feature 1..20: note = CRISPR gRNA sequence
  source 1..20: mol_type = other DNA
gggactgcttaaacaaatta

SEQ ID NO: 15978 - DNA, 20 bp, synthetic construct
  misc_feature 1..20: note = CRISPR gRNA sequence
  source 1..20: mol_type = other DNA
ctacccaacgaaacactgca

SEQ ID NO: 15979 - DNA, 20 bp, synthetic construct
  misc_feature 1..20: note = CRISPR gRNA sequence
  source 1..20: mol_type = other DNA
gaaacactgcatggccttaa

SEQ ID NO: 15980 - DNA, 20 bp, synthetic construct
  misc_feature 1..20: note = CRISPR gRNA sequence
  source 1..20: mol_type = other DNA
cactgcatggccttaaaaga

SEQ ID NO: 15981 - DNA, 20 bp, synthetic construct
  misc_feature 1..20: note = CRISPR gRNA sequence
  source 1..20: mol_type = other DNA
actgcatggccttaaaagaa

SEQ ID NO: 15982 - DNA, 20 bp, synthetic construct
  misc_feature 1..20: note = CRISPR gRNA sequence
  source 1..20: mol_type = other DNA
ccttaaaagaaaggatgctg

SEQ ID NO: 15983 - DNA, 20 bp, synthetic construct
  misc_feature 1..20: note = CRISPR gRNA sequence
  source 1..20: mol_type = other DNA
gaaaggatgctgaagtacac

SEQ ID NO: 15984 - DNA, 20 bp, synthetic construct
  misc_feature 1..20: note = CRISPR gRNA sequence
  source 1..20: mol_type = other DNA
aaaggatgctgaagtacacg

SEQ ID NO: 15985 - DNA, 20 bp, synthetic construct
  misc_feature 1..20: note = CRISPR gRNA sequence
  source 1..20: mol_type = other DNA
aaggatgctgaagtacacga

SEQ ID NO: 15986 - DNA, 20 bp, synthetic construct
  misc_feature 1..20: note = CRISPR gRNA sequence
  source 1..20: mol_type = other DNA
aggatgctgaagtacacgag

SEQ ID NO: 15987 - DNA, 20 bp, synthetic construct
  misc_feature 1..20: note = CRISPR gRNA sequence
  source 1..20: mol_type = other DNA
gatgctgaagtacacgaggg

SEQ ID NO: 15988 - DNA, 20 bp, synthetic construct
  misc_feature 1..20: note = CRISPR gRNA sequence
  source 1..20: mol_type = other DNA
tgtaccaaaaatataatgaa

SEQ ID NO: 15989 - DNA, 20 bp, synthetic construct
  misc_feature 1..20: note = CRISPR gRNA sequence
  source 1..20: mol_type = other DNA
gtaccaaaaatataatgaat

SEQ ID NO: 15990 - DNA, 20 bp, synthetic construct
  misc_feature 1..20: note = CRISPR gRNA sequence
  source 1..20: mol_type = other DNA
aaatataatgaatgggtgtg

SEQ ID NO: 15991 - DNA, 20 bp, synthetic construct
  misc_feature 1..20: note = CRISPR gRNA sequence
  source 1..20: mol_type = other DNA
ataatgaatgggtgtgtgga

SEQ ID NO: 15992 - DNA, 20 bp, synthetic construct
  misc_feature 1..20: note = CRISPR gRNA sequence
  source 1..20: mol_type = other DNA
tgaatgggtgtgtggatgga

SEQ ID NO: 15993 - DNA, 20 bp, synthetic construct
  misc_feature 1..20: note = CRISPR gRNA sequence
  source 1..20: mol_type = other DNA
aatgggtgtgtggatggata

SEQ ID NO: 15994 - DNA, 20 bp, synthetic construct
  misc_feature 1..20: note = CRISPR gRNA sequence
  source 1..20: mol_type = other DNA
atgggtgtgtggatggatag

SEQ ID NO: 15995 - DNA, 20 bp, synthetic construct
  misc_feature 1..20: note = CRISPR gRNA sequence
  source 1..20: mol_type = other DNA
tgggtgtgtggatggataga

SEQ ID NO: 15996 - DNA, 20 bp, synthetic construct
  misc_feature 1..20: note = CRISPR gRNA sequence
  source 1..20: mol_type = other DNA
tgtgtggatggatagaggga

SEQ ID NO: 15997 - DNA, 20 bp, synthetic construct
  misc_feature 1..20: note = CRISPR gRNA sequence
  source 1..20: mol_type = other DNA
tggatggatagagggatgga

SEQ ID NO: 15998 - DNA, 20 bp, synthetic construct
  misc_feature 1..20: note = CRISPR gRNA sequence
  source 1..20: mol_type = other DNA
tagagggatggacagatgaa

SEQ ID NO: 15999 - DNA, 20 bp, synthetic construct
  misc_feature 1..20: note = CRISPR gRNA sequence
  source 1..20: mol_type = other DNA
gagggatggacagatgaata

SEQ ID NO: 16000 - DNA, 20 bp, synthetic construct
  misc_feature 1..20: note = CRISPR gRNA sequence
  source 1..20: mol_type = other DNA
cagatgaatagagatgtgat

SEQ ID NO: 16001 - DNA, 20 bp, synthetic construct
  misc_feature 1..20: note = CRISPR gRNA sequence
  source 1..20: mol_type = other DNA
ataaaacccaacattaattg

SEQ ID NO: 16002 - DNA, 20 bp, synthetic construct
  misc_feature 1..20: note = CRISPR gRNA sequence
  source 1..20: mol_type = other DNA
cattaattgtagaatcaaaa

SEQ ID NO: 16003 - DNA, 20 bp, synthetic construct
  misc_feature 1..20: note = CRISPR gRNA sequence
  source 1..20: mol_type = other DNA
tgtagaatcaaaatggtaca

SEQ ID NO: 16004 - DNA, 20 bp, synthetic construct
  misc_feature 1..20: note = CRISPR gRNA sequence
  source 1..20: mol_type = other DNA
agaatcaaaatggtacatgg

SEQ ID NO: 16005 - DNA, 20 bp, synthetic construct
  misc_feature 1..20: note = CRISPR gRNA sequence
  source 1..20: mol_type = other DNA
gaatcaaaatggtacatggt

SEQ ID NO: 16006 - DNA, 20 bp, synthetic construct
  misc_feature 1..20: note = CRISPR gRNA sequence
  source 1..20: mol_type = other DNA
aatggtacatggtgggtata

SEQ ID NO: 16007 - DNA, 20 bp, synthetic construct
  misc_feature 1..20: note = CRISPR gRNA sequence
  source 1..20: mol_type = other DNA
ggtgggtatatggaccttca

SEQ ID NO: 16008 - DNA, 20 bp, synthetic construct
  misc_feature 1..20: note = CRISPR gRNA sequence
  source 1..20: mol_type = other DNA
atttttttttttttttgaaa

SEQ ID NO: 16009 - DNA, 20 bp, synthetic construct
  misc_feature 1..20: note = CRISPR gRNA sequence
  source 1..20: mol_type = other DNA
ttttttttttttttgaaaca

SEQ ID NO: 16010 - DNA, 20 bp, synthetic construct
  misc_feature 1..20: note = CRISPR gRNA sequence
  source 1..20: mol_type = other DNA
tttttttttgaaacagagtc

SEQ ID NO: 16011 - DNA, 20 bp, synthetic construct
  misc_feature 1..20: note = CRISPR gRNA sequence
  source 1..20: mol_type = other DNA
cagagtctagctctgttgcc

SEQ ID NO: 16012 - DNA, 20 bp, synthetic construct
  misc_feature 1..20: note = CRISPR gRNA sequence
  source 1..20: mol_type = other DNA
agagtctagctctgttgccc

SEQ ID NO: 16013 - DNA, 20 bp, synthetic construct
  misc_feature 1..20: note = CRISPR gRNA sequence
  source 1..20: mol_type = other DNA
tctagctctgttgcccaggc

SEQ ID NO: 16014 - DNA, 20 bp, synthetic construct
  misc_feature 1..20: note = CRISPR gRNA sequence
  source 1..20: mol_type = other DNA
tagctctgttgcccaggctg

SEQ ID NO: 16015 - DNA, 20 bp, synthetic construct
  misc_feature 1..20: note = CRISPR gRNA sequence
  source 1..20: mol_type = other DNA
ttgcccaggctggagtgcac

SEQ ID NO: 16016 - DNA, 20 bp, synthetic construct
  misc_feature 1..20: note = CRISPR gRNA sequence
  source 1..20: mol_type = other DNA
ggagtgcactggcgcaatct

SEQ ID NO: 16017 - DNA, 20 bp, synthetic construct
  misc_feature 1..20: note = CRISPR gRNA sequence
  source 1..20: mol_type = other DNA
tcactgcaacctctgcttct

SEQ ID NO: 16018 - DNA, 20 bp, synthetic construct
  misc_feature 1..20: note = CRISPR gRNA sequence
  source 1..20: mol_type = other DNA
cactgcaacctctgcttctt

SEQ ID NO: 16019 - DNA, 20 bp, synthetic construct
  misc_feature 1..20: note = CRISPR gRNA sequence
  source 1..20: mol_type = other DNA
aacctctgcttcttaggttc

SEQ ID NO: 16020 - DNA, 20 bp, synthetic construct
  misc_feature 1..20: note = CRISPR gRNA sequence
  source 1..20: mol_type = other DNA
ttcaagcgattctcccaccc

SEQ ID NO: 16021 - DNA, 20 bp, synthetic construct
  misc_feature 1..20: note = CRISPR gRNA sequence
  source 1..20: mol_type = other DNA
ttctcccaccctagcctccc

SEQ ID NO: 16022 - DNA, 20 bp, synthetic construct
  misc_feature 1..20: note = CRISPR gRNA sequence
  source 1..20: mol_type = other DNA
tcccaccctagcctccctgg

SEQ ID NO: 16023 - DNA, 20 bp, synthetic construct
  misc_feature 1..20: note = CRISPR gRNA sequence
  source 1..20: mol_type = other DNA
accctagcctccctggtagc

SEQ ID NO: 16024 - DNA, 20 bp, synthetic construct
  misc_feature 1..20: note = CRISPR gRNA sequence
  source 1..20: mol_type = other DNA
ccctagcctccctggtagct

SEQ ID NO: 16025 - DNA, 20 bp, synthetic construct
  misc_feature 1..20: note = CRISPR gRNA sequence
  source 1..20: mol_type = other DNA
ctccctggtagctgggatta

SEQ ID NO: 16026 - DNA, 20 bp, synthetic construct
  misc_feature 1..20: note = CRISPR gRNA sequence
  source 1..20: mol_type = other DNA
tccctggtagctgggattac

SEQ ID NO: 16027 - DNA, 20 bp, synthetic construct
  misc_feature 1..20: note = CRISPR gRNA sequence
  source 1..20: mol_type = other DNA
caggtgttcgccaccacgcc

SEQ ID NO: 16028 - DNA, 20 bp, synthetic construct
  misc_feature 1..20: note = CRISPR gRNA sequence
  source 1..20: mol_type = other DNA
ctggctaatttttgtatttt

SEQ ID NO: 16029 - DNA, 20 bp, synthetic construct
  misc_feature 1..20: note = CRISPR gRNA sequence
  source 1..20: mol_type = other DNA
gctaatttttgtatttttag

SEQ ID NO: 16030 - DNA, 20 bp, synthetic construct
  misc_feature 1..20: note = CRISPR gRNA sequence
  source 1..20: mol_type = other DNA
taatttttgtatttttagta

SEQ ID NO: 16031 - DNA, 20 bp, synthetic construct
  misc_feature 1..20: note = CRISPR gRNA sequence
  source 1..20: mol_type = other DNA
ttttgtatttttagtagaga

SEQ ID NO: 16032 - DNA, 20 bp, synthetic construct
  misc_feature 1..20: note = CRISPR gRNA sequence
  source 1..20: mol_type = other DNA
tttgtatttttagtagagat

SEQ ID NO: 16033 - DNA, 20 bp, synthetic construct
  misc_feature 1..20: note = CRISPR gRNA sequence
  source 1..20: mol_type = other DNA
ttgtatttttagtagagatg

SEQ ID NO: 16034 - DNA, 20 bp, synthetic construct
  misc_feature 1..20: note = CRISPR gRNA sequence
  source 1..20: mol_type = other DNA
gagatggggtttcaccatgt

SEQ ID NO: 16035 - DNA, 20 bp, synthetic construct
  misc_feature 1..20: note = CRISPR gRNA sequence
  source 1..20: mol_type = other DNA
tggggtttcaccatgttggc

SEQ ID NO: 16036 - DNA, 20 bp, synthetic construct
  misc_feature 1..20: note = CRISPR gRNA sequence
  source 1..20: mol_type = other DNA
ggggtttcaccatgttggcc

SEQ ID NO: 16037 - DNA, 20 bp, synthetic construct
  misc_feature 1..20: note = CRISPR gRNA sequence
  source 1..20: mol_type = other DNA
tttcaccatgttggccaggc

SEQ ID NO: 16038 - DNA, 20 bp, synthetic construct
  misc_feature 1..20: note = CRISPR gRNA sequence
  source 1..20: mol_type = other DNA
tggtctcaaactcttgacct

SEQ ID NO: 16039 - DNA, 20 bp, synthetic construct
  misc_feature 1..20: note = CRISPR gRNA sequence
  source 1..20: mol_type = other DNA
ggtctcaaactcttgacctc

SEQ ID NO: 16040 - DNA, 20 bp, synthetic construct
  misc_feature 1..20: note = CRISPR gRNA sequence
  source 1..20: mol_type = other DNA
cttgacctcaggtgatctgc

SEQ ID NO: 16041 - DNA, 20 bp, synthetic construct
  misc_feature 1..20: note = CRISPR gRNA sequence
  source 1..20: mol_type = other DNA
ctcaggtgatctgccagcct

SEQ ID NO: 16042 - DNA, 20 bp, synthetic construct
  misc_feature 1..20: note = CRISPR gRNA sequence
  source 1..20: mol_type = other DNA
ctgccagccttggcctccca

SEQ ID NO: 16043 - DNA, 20 bp, synthetic construct
  misc_feature 1..20: note = CRISPR gRNA sequence
  source 1..20: mol_type = other DNA
gccttggcctcccaaagtgc

SEQ ID NO: 16044 - DNA, 20 bp, synthetic construct
  misc_feature 1..20: note = CRISPR gRNA sequence
  source 1..20: mol_type = other DNA
ccttggcctcccaaagtgct

SEQ ID NO: 16045 - DNA, 20 bp, synthetic construct
  misc_feature 1..20: note = CRISPR gRNA sequence
  source 1..20: mol_type = other DNA
ctcccaaagtgctgggatta

SEQ ID NO: 16046 - DNA, 20 bp, synthetic construct
  misc_feature 1..20: note = CRISPR gRNA sequence
  source 1..20: mol_type = other DNA
agtgctgggattacagatgt

SEQ ID NO: 16047 - DNA, 20 bp, synthetic construct
  misc_feature 1..20: note = CRISPR gRNA sequence
  source 1..20: mol_type = other DNA
cagatgtgagccaccacgcc

SEQ ID NO: 16048 - DNA, 20 bp, synthetic construct
  misc_feature 1..20: note = CRISPR gRNA sequence
  source 1..20: mol_type = other DNA
aaactttcacaataaaatct

SEQ ID NO: 16049 - DNA, 20 bp, synthetic construct
  misc_feature 1..20: note = CRISPR gRNA sequence
  source 1..20: mol_type = other DNA
aactttcacaataaaatctt

SEQ ID NO: 16050 - DNA, 20 bp, synthetic construct
  misc_feature 1..20: note = CRISPR gRNA sequence
  source 1..20: mol_type = other DNA
actttcacaataaaatcttg

SEQ ID NO: 16051 - DNA, 20 bp, synthetic construct
  misc_feature 1..20: note = CRISPR gRNA sequence
  source 1..20: mol_type = other DNA
ctttcacaataaaatcttgg

SEQ ID NO: 16052 - DNA, 20 bp, synthetic construct
  misc_feature 1..20: note = CRISPR gRNA sequence
  source 1..20: mol_type = other DNA
tttcacaataaaatcttggg

SEQ ID NO: 16053 - DNA, 20 bp, synthetic construct
  misc_feature 1..20: note = CRISPR gRNA sequence
  source 1..20: mol_type = other DNA
atttatcaaatgaaaacata

SEQ ID NO: 16054 - DNA, 20 bp, synthetic construct
  misc_feature 1..20: note = CRISPR gRNA sequence
  source 1..20: mol_type = other DNA
tatcaaatgaaaacataaag

SEQ ID NO: 16055 - DNA, 20 bp, synthetic construct
  misc_feature 1..20: note = CRISPR gRNA sequence
  source 1..20: mol_type = other DNA
aaaacataaagaagaaaaac

SEQ ID NO: 16056 - DNA, 20 bp, synthetic construct
  misc_feature 1..20: note = CRISPR gRNA sequence
  source 1..20: mol_type = other DNA
ataaagaagaaaaacaagaa

SEQ ID NO: 16057 - DNA, 20 bp, synthetic construct
  misc_feature 1..20: note = CRISPR gRNA sequence
  source 1..20: mol_type = other DNA
agaagaaaaacaagaaaaga

SEQ ID NO: 16058 - DNA, 20 bp, synthetic construct
  misc_feature 1..20: note = CRISPR gRNA sequence
  source 1..20: mol_type = other DNA
acaagaaaagaaagaaaata

SEQ ID NO: 16059 - DNA, 20 bp, synthetic construct
  misc_feature 1..20: note = CRISPR gRNA sequence
  source 1..20: mol_type = other DNA
agaaaagaaagaaaataaag

SEQ ID NO: 16060 - DNA, 20 bp, synthetic construct
  misc_feature 1..20: note = CRISPR gRNA sequence
  source 1..20: mol_type = other DNA
agaaaataaagaagctgctg

SEQ ID NO: 16061 - DNA, 20 bp, synthetic construct
  misc_feature 1..20: note = CRISPR gRNA sequence
  source 1..20: mol_type = other DNA
aataaagaagctgctgaaga

SEQ ID NO: 16062 - DNA, 20 bp, synthetic construct
  misc_feature 1..20: note = CRISPR gRNA sequence
  source 1..20: mol_type = other DNA
ataaagaagctgctgaagat

SEQ ID NO: 16063 - DNA, 20 bp, synthetic construct
  misc_feature 1..20: note = CRISPR gRNA sequence
  source 1..20: mol_type = other DNA
tgtcctctccctcaataata

SEQ ID NO: 16064 - DNA, 20 bp, synthetic construct
  misc_feature 1..20: note = CRISPR gRNA sequence
  source 1..20: mol_type = other DNA
taatatggaacgtgacctcc

SEQ ID NO: 16065 - DNA, 20 bp, synthetic construct
  misc_feature 1..20: note = CRISPR gRNA sequence
  source 1..20: mol_type = other DNA
atggaacgtgacctcccaga

SEQ ID NO: 16066 - DNA, 20 bp, synthetic construct
  misc_feature 1..20: note = CRISPR gRNA sequence
  source 1..20: mol_type = other DNA
tggaacgtgacctcccagac

SEQ ID NO: 16067 - DNA, 20 bp, synthetic construct
  misc_feature 1..20: note = CRISPR gRNA sequence
  source 1..20: mol_type = other DNA
ggaacgtgacctcccagaca

SEQ ID NO: 16068 - DNA, 20 bp, synthetic construct
  misc_feature 1..20: note = CRISPR gRNA sequence
  source 1..20: mol_type = other DNA
aacgtgacctcccagacagg

SEQ ID NO: 16069 - DNA, 20 bp, synthetic construct
  misc_feature 1..20: note = CRISPR gRNA sequence
  source 1..20: mol_type = other DNA
ctcccagacagggagtaatg

SEQ ID NO: 16070 - DNA, 20 bp, synthetic construct
  misc_feature 1..20: note = CRISPR gRNA sequence
  source 1..20: mol_type = other DNA
agggagtaatgaagtaaatg

SEQ ID NO: 16071 - DNA, 20 bp, synthetic construct
  misc_feature 1..20: note = CRISPR gRNA sequence
  source 1..20: mol_type = other DNA
agtaatgaagtaaatgaaga

SEQ ID NO: 16072 - DNA, 20 bp, synthetic construct
  misc_feature 1..20: note = CRISPR gRNA sequence
  source 1..20: mol_type = other DNA
taaatgaagaaagcaaaatg

SEQ ID NO: 16073 - DNA, 20 bp, synthetic construct
  misc_feature 1..20: note = CRISPR gRNA sequence
  source 1..20: mol_type = other DNA
gaagaaagcaaaatgcagaa

SEQ ID NO: 16074 - DNA, 20 bp, synthetic construct
  misc_feature 1..20: note = CRISPR gRNA sequence
  source 1..20: mol_type = other DNA
agaatagtgtaaataaaatg

SEQ ID NO: 16075 - DNA, 20 bp, synthetic construct
  misc_feature 1..20: note = CRISPR gRNA sequence
  source 1..20: mol_type = other DNA
ataaaatgtggtcatttgca

SEQ ID NO: 16076 - DNA, 20 bp, synthetic construct
  misc_feature 1..20: note = CRISPR gRNA sequence
  source 1..20: mol_type = other DNA
gtcatttgcatggaaaatta

SEQ ID NO: 16077 - DNA, 20 bp, synthetic construct
  misc_feature 1..20: note = CRISPR gRNA sequence
  source 1..20: mol_type = other DNA
atggaaaattaaagcaaata

SEQ ID NO: 16078 - DNA, 20 bp, synthetic construct
  misc_feature 1..20: note = CRISPR gRNA sequence
  source 1..20: mol_type = other DNA
tggaaaattaaagcaaatac

SEQ ID NO: 16079 - DNA, 20 bp, synthetic construct
  misc_feature 1..20: note = CRISPR gRNA sequence
  source 1..20: mol_type = other DNA
gaaaattaaagcaaatacag

SEQ ID NO: 16080 - DNA, 20 bp, synthetic construct
  misc_feature 1..20: note = CRISPR gRNA sequence
  source 1..20: mol_type = other DNA
gagctcgctttatttctgac

SEQ ID NO: 16081 - DNA, 20 bp, synthetic construct
  misc_feature 1..20: note = CRISPR gRNA sequence
  source 1..20: mol_type = other DNA
agctcgctttatttctgaca

SEQ ID NO: 16082 - DNA, 20 bp, synthetic construct
  misc_feature 1..20: note = CRISPR gRNA sequence
  source 1..20: mol_type = other DNA
tttatttctgacaaggcaaa

SEQ ID NO: 16083 - DNA, 20 bp, synthetic construct
  misc_feature 1..20: note = CRISPR gRNA sequence
  source 1..20: mol_type = other DNA
ttatttctgacaaggcaaaa

SEQ ID NO: 16084 - DNA, 20 bp, synthetic construct
  misc_feature 1..20: note = CRISPR gRNA sequence
  source 1..20: mol_type = other DNA
tttctgacaaggcaaaaagg

SEQ ID NO: 16085 - DNA, 20 bp, synthetic construct
  misc_feature 1..20: note = CRISPR gRNA sequence
  source 1..20: mol_type = other DNA
tgacaaggcaaaaaggaagc

SEQ ID NO: 16086 - DNA, 20 bp, synthetic construct
  misc_feature 1..20: note = CRISPR gRNA sequence
  source 1..20: mol_type = other DNA
caaaaaggaagctggtcaca

SEQ ID NO: 16087 - DNA, 20 bp, synthetic construct
  misc_feature 1..20: note = CRISPR gRNA sequence
  source 1..20: mol_type = other DNA
aaaaaggaagctggtcacat

SEQ ID NO: 16088 - DNA, 20 bp, synthetic construct
  misc_feature 1..20: note = CRISPR gRNA sequence
  source 1..20: mol_type = other DNA
gctggtcacataggttgact

SEQ ID NO: 16089 - DNA, 20 bp, synthetic construct
  misc_feature 1..20: note = CRISPR gRNA sequence
  source 1..20: mol_type = other DNA
gtcacataggttgactaaga

SEQ ID NO: 16090 - DNA, 20 bp, synthetic construct
  misc_feature 1..20: note = CRISPR gRNA sequence
  source 1..20: mol_type = other DNA
tcacataggttgactaagat

SEQ ID NO: 16091 - DNA, 20 bp, synthetic construct
  misc_feature 1..20: note = CRISPR gRNA sequence
  source 1..20: mol_type = other DNA
acataggttgactaagatag

SEQ ID NO: 16092 - DNA, 20 bp, synthetic construct
  misc_feature 1..20: note = CRISPR gRNA sequence
  source 1..20: mol_type = other DNA
actaagataggagcaaaact

SEQ ID NO: 16093 - DNA, 20 bp, synthetic construct
  misc_feature 1..20: note = CRISPR gRNA sequence
  source 1..20: mol_type = other DNA
ctaagataggagcaaaactg

SEQ ID NO: 16094 - DNA, 20 bp, synthetic construct
  misc_feature 1..20: note = CRISPR gRNA sequence
  source 1..20: mol_type = other DNA
taagataggagcaaaactga

SEQ ID NO: 16095 - DNA, 20 bp, synthetic construct
  misc_feature 1..20: note = CRISPR gRNA sequence
  source 1..20: mol_type = other DNA
ggagcaaaactgagggacta

SEQ ID NO: 16096 - DNA, 20 bp, synthetic construct
  misc_feature 1..20: note = CRISPR gRNA sequence
  source 1..20: mol_type = other DNA
aaaactgagggactacagaa

SEQ ID NO: 16097 - DNA, 20 bp, synthetic construct
  misc_feature 1..20: note = CRISPR gRNA sequence
  source 1..20: mol_type = other DNA
aaactgagggactacagaac

SEQ ID NO: 16098 - DNA, 20 bp, synthetic construct
  misc_feature 1..20: note = CRISPR gRNA sequence
  source 1..20: mol_type = other DNA
actgagggactacagaacag

SEQ ID NO: 16099 - DNA, 20 bp, synthetic construct
  misc_feature 1..20: note = CRISPR gRNA sequence
  source 1..20: mol_type = other DNA
gagggactacagaacaggag

SEQ ID NO: 16100 - DNA, 20 bp, synthetic construct
  misc_feature 1..20: note = CRISPR gRNA sequence
  source 1..20: mol_type = other DNA
agggactacagaacaggagt

SEQ ID NO: 16101 - DNA, 20 bp, synthetic construct
  misc_feature 1..20: note = CRISPR gRNA sequence
  source 1..20: mol_type = other DNA
ggactacagaacaggagtgg

SEQ ID NO: 16102 - DNA, 20 bp, synthetic construct
  misc_feature 1..20: note = CRISPR gRNA sequence
  source 1..20: mol_type = other DNA
gactacagaacaggagtggg

SEQ ID NO: 16103 - DNA, 20 bp, synthetic construct
  misc_feature 1..20: note = CRISPR gRNA sequence
  source 1..20: mol_type = other DNA
actacagaacaggagtggga

SEQ ID NO: 16104 - DNA, 20 bp, synthetic construct
  misc_feature 1..20: note = CRISPR gRNA sequence
  source 1..20: mol_type = other DNA
tacagaacaggagtgggagg

SEQ ID NO: 16105 - DNA, 20 bp, synthetic construct
  misc_feature 1..20: note = CRISPR gRNA sequence
  source 1..20: mol_type = other DNA
tttttcactgaatattcttt

SEQ ID NO: 16106 - DNA, 20 bp, synthetic construct
  misc_feature 1..20: note = CRISPR gRNA sequence
  source 1..20: mol_type = other DNA
tcttttggttgttgttgttt

SEQ ID NO: 16107 - DNA, 20 bp, synthetic construct
  misc_feature 1..20: note = CRISPR gRNA sequence
  source 1..20: mol_type = other DNA
ttggttgttgttgtttgaga

SEQ ID NO: 16108 - DNA, 20 bp, synthetic construct
  misc_feature 1..20: note = CRISPR gRNA sequence
  source 1..20: mol_type = other DNA
ggttgttgttgtttgagaca

SEQ ID NO: 16109 - DNA, 20 bp, synthetic construct
  misc_feature 1..20: note = CRISPR gRNA sequence
  source 1..20: mol_type = other DNA
cagagtcttactctgccacc

SEQ ID NO: 16110 - DNA, 20 bp, synthetic construct
  misc_feature 1..20: note = CRISPR gRNA sequence
  source 1..20: mol_type = other DNA
agagtcttactctgccaccc

SEQ ID NO: 16111 - DNA, 20 bp, synthetic construct
  misc_feature 1..20: note = CRISPR gRNA sequence
  source 1..20: mol_type = other DNA
tcttactctgccacccaggc

SEQ ID NO: 16112 - DNA, 20 bp, synthetic construct
  misc_feature 1..20: note = CRISPR gRNA sequence
  source 1..20: mol_type = other DNA
ttactctgccacccaggctg

SEQ ID NO: 16113 - DNA, 20 bp, synthetic construct
  misc_feature 1..20: note = CRISPR gRNA sequence
  source 1..20: mol_type = other DNA
ctgccacccaggctggagtg

SEQ ID NO: 16114 - DNA, 20 bp, synthetic construct
  misc_feature 1..20: note = CRISPR gRNA sequence
  source 1..20: mol_type = other DNA
ccacccaggctggagtgcag

SEQ ID NO: 16115 - DNA, 20 bp, synthetic construct
  misc_feature 1..20: note = CRISPR gRNA sequence
  source 1..20: mol_type = other DNA
ggagtgcagtggcgtgatct

SEQ ID NO: 16116 - DNA, 20 bp, synthetic construct
  misc_feature 1..20: note = CRISPR gRNA sequence
  source 1..20: mol_type = other DNA
tcactgcaacctccacctcc

SEQ ID NO: 16117 - DNA, 20 bp, synthetic construct
  misc_feature 1..20: note = CRISPR gRNA sequence
  source 1..20: mol_type = other DNA
cactgcaacctccacctcct

SEQ ID NO: 16118 - DNA, 20 bp, synthetic construct
  misc_feature 1..20: note = CRISPR gRNA sequence
  source 1..20: mol_type = other DNA
aacctccacctcctgggttc

SEQ ID NO: 16119 - DNA, 20 bp, synthetic construct
  misc_feature 1..20: note = CRISPR gRNA sequence
  source 1..20: mol_type = other DNA
ttcaagcgattctcctgcct

SEQ ID NO: 16120 - DNA, 20 bp, synthetic construct
  misc_feature 1..20: note = CRISPR gRNA sequence
  source 1..20: mol_type = other DNA
ttctcctgcctcagcctccc

SEQ ID NO: 16121 - DNA, 20 bp, synthetic construct
  misc_feature 1..20: note = CRISPR gRNA sequence
  source 1..20: mol_type = other DNA
tcctgcctcagcctcccgag

SEQ ID NO: 16122 - DNA, 20 bp, synthetic construct
  misc_feature 1..20: note = CRISPR gRNA sequence
  source 1..20: mol_type = other DNA
gcctcagcctcccgagtagc

SEQ ID NO: 16123 - DNA, 20 bp, synthetic construct
  misc_feature 1..20: note = CRISPR gRNA sequence
  source 1..20: mol_type = other DNA
cctcagcctcccgagtagct

SEQ ID NO: 16124 - DNA, 20 bp, synthetic construct
  misc_feature 1..20: note = CRISPR gRNA sequence
  source 1..20: mol_type = other DNA
ctcccgagtagctgggatta

SEQ ID NO: 16125 - DNA, 20 bp, synthetic construct
  misc_feature 1..20: note = CRISPR gRNA sequence
  source 1..20: mol_type = other DNA
tcccgagtagctgggattac

SEQ ID NO: 16126 - DNA, 20 bp, synthetic construct
  misc_feature 1..20: note = CRISPR gRNA sequence
  source 1..20: mol_type = other DNA
caggcgtgcaccaccacacc

SEQ ID NO: 16127 - DNA, 20 bp, synthetic construct
  misc_feature 1..20: note = CRISPR gRNA sequence
  source 1..20: mol_type = other DNA
cggctaatttttgtattttt

SEQ ID NO: 16128 - DNA, 20 bp, synthetic construct
  misc_feature 1..20: note = CRISPR gRNA sequence
  source 1..20: mol_type = other DNA
ctaatttttgtattttttgg

SEQ ID NO: 16129 - DNA, 20 bp, synthetic construct
  misc_feature 1..20: note = CRISPR gRNA sequence
  source 1..20: mol_type = other DNA
aatttttgtattttttggta

SEQ ID NO: 16130 - DNA, 20 bp, synthetic construct
  misc_feature 1..20: note = CRISPR gRNA sequence
  source 1..20: mol_type = other DNA
tgtattttttggtagagacg

SEQ ID NO: 16131 - DNA, 20 bp, synthetic construct
  misc_feature 1..20: note = CRISPR gRNA sequence
  source 1..20: mol_type = other DNA
gagacgcggtttcaccatgt

SEQ ID NO: 16132 - DNA, 20 bp, synthetic construct
  misc_feature 1..20: note = CRISPR gRNA sequence
  source 1..20: mol_type = other DNA
cgcggtttcaccatgttggc

SEQ ID NO: 16133 - DNA, 20 bp, synthetic construct
  misc_feature 1..20: note = CRISPR gRNA sequence
  source 1..20: mol_type = other DNA
gcggtttcaccatgttggcc

SEQ ID NO: 16134 - DNA, 20 bp, synthetic construct
  misc_feature 1..20: note = CRISPR gRNA sequence
  source 1..20: mol_type = other DNA
gtttcaccatgttggccagg

SEQ ID NO: 16135 - DNA, 20 bp, synthetic construct
  misc_feature 1..20: note = CRISPR gRNA sequence
  source 1..20: mol_type = other DNA
tttcaccatgttggccaggc

SEQ ID NO: 16136 - DNA, 20 bp, synthetic construct
  misc_feature 1..20: note = CRISPR gRNA sequence
  source 1..20: mol_type = other DNA
ggtatcaaactcctgacctc

SEQ ID NO: 16137 - DNA, 20 bp, synthetic construct
  misc_feature 1..20: note = CRISPR gRNA sequence
  source 1..20: mol_type = other DNA
ctcaagtgatccgtccccct

SEQ ID NO: 16138 - DNA, 20 bp, synthetic construct
  misc_feature 1..20: note = CRISPR gRNA sequence
  source 1..20: mol_type = other DNA
cccttggcctcccaaactgc

SEQ ID NO: 16139 - DNA, 20 bp, synthetic construct
  misc_feature 1..20: note = CRISPR gRNA sequence
  source 1..20: mol_type = other DNA
ccttggcctcccaaactgct

SEQ ID NO: 16140 - DNA, 20 bp, synthetic construct
  misc_feature 1..20: note = CRISPR gRNA sequence
  source 1..20: mol_type = other DNA
ctcccaaactgctgggatta

SEQ ID NO: 16141 - DNA, 20 bp, synthetic construct
  misc_feature 1..20: note = CRISPR gRNA sequence
  source 1..20: mol_type = other DNA
tcccaaactgctgggattac

SEQ ID NO: 16142 - DNA, 20 bp, synthetic construct
  misc_feature 1..20: note = CRISPR gRNA sequence
  source 1..20: mol_type = other DNA
actgctgggattacaggtgt

SEQ ID NO: 16143 - DNA, 20 bp, synthetic construct
  misc_feature 1..20: note = CRISPR gRNA sequence
  source 1..20: mol_type = other DNA
caggtgtgagccgctgcgcc

SEQ ID NO: 16144 - DNA, 20 bp, synthetic construct
  misc_feature 1..20: note = CRISPR gRNA sequence
  source 1..20: mol_type = other DNA
tgtgtgcgattcacctgttt

SEQ ID NO: 16145 - DNA, 20 bp, synthetic construct
  misc_feature 1..20: note = CRISPR gRNA sequence
  source 1..20: mol_type = other DNA
ctgtttaagaactgaataaa

SEQ ID NO: 16146 - DNA, 20 bp, synthetic construct
  misc_feature 1..20: note = CRISPR gRNA sequence
  source 1..20: mol_type = other DNA
aagaactgaataaatagata

SEQ ID NO: 16147 - DNA, 20 bp, synthetic construct
  misc_feature 1..20: note = CRISPR gRNA sequence
  source 1..20: mol_type = other DNA
agaactgaataaatagatac

SEQ ID NO: 16148 - DNA, 20 bp, synthetic construct
  misc_feature 1..20: note = CRISPR gRNA sequence
  source 1..20: mol_type = other DNA
atagatacaggacttacaca

SEQ ID NO: 16149 - DNA, 20 bp, synthetic construct
  misc_feature 1..20: note = CRISPR gRNA sequence
  source 1..20: mol_type = other DNA
atacaggacttacacatggt

SEQ ID NO: 16150 - DNA, 20 bp, synthetic construct
  misc_feature 1..20: note = CRISPR gRNA sequence
  source 1..20: mol_type = other DNA
cacatggtcagacccataat

SEQ ID NO: 16151 - DNA, 20 bp, synthetic construct
  misc_feature 1..20: note = CRISPR gRNA sequence
  source 1..20: mol_type = other DNA
tcagacccataataagtact

SEQ ID NO: 16152 - DNA, 20 bp, synthetic construct
  misc_feature 1..20: note = CRISPR gRNA sequence
  source 1..20: mol_type = other DNA
taactgttacacccatttta

SEQ ID NO: 16153 - DNA, 20 bp, synthetic construct
  misc_feature 1..20: note = CRISPR gRNA sequence
  source 1..20: mol_type = other DNA
ttacagatgttttcattcaa

SEQ ID NO: 16154 - DNA, 20 bp, synthetic construct
  misc_feature 1..20: note = CRISPR gRNA sequence
  source 1..20: mol_type = other DNA
tcattcaacagatatctact

SEQ ID NO: 16155 - DNA, 20 bp, synthetic construct
  misc_feature 1..20: note = CRISPR gRNA sequence
  source 1..20: mol_type = other DNA
cattcaacagatatctactg

SEQ ID NO: 16156 - DNA, 20 bp, synthetic construct
  misc_feature 1..20: note = CRISPR gRNA sequence
  source 1..20: mol_type = other DNA
actgaggtgctactgcatac

SEQ ID NO: 16157 - DNA, 20 bp, synthetic construct
  misc_feature 1..20: note = CRISPR gRNA sequence
  source 1..20: mol_type = other DNA
ctgaggtgctactgcatacc

SEQ ID NO: 16158 - DNA, 20 bp, synthetic construct
  misc_feature 1..20: note = CRISPR gRNA sequence
  source 1..20: mol_type = other DNA
ctgcataccaggcactgcac

SEQ ID NO: 16159 - DNA, 20 bp, synthetic construct
  misc_feature 1..20: note = CRISPR gRNA sequence
  source 1..20: mol_type = other DNA
ccaggcactgcactagatgc

SEQ ID NO: 16160 - DNA, 20 bp, synthetic construct
  misc_feature 1..20: note = CRISPR gRNA sequence
  source 1..20: mol_type = other DNA
caggcactgcactagatgct

SEQ ID NO: 16161 - DNA, 20 bp, synthetic construct
  misc_feature 1..20: note = CRISPR gRNA sequence
  source 1..20: mol_type = other DNA
aggcactgcactagatgctg

SEQ ID NO: 16162 - DNA, 20 bp, synthetic construct
  misc_feature 1..20: note = CRISPR gRNA sequence
  source 1..20: mol_type = other DNA
tgcactagatgctggggaaa

SEQ ID NO: 16163 - DNA, 20 bp, synthetic construct
  misc_feature 1..20: note = CRISPR gRNA sequence
  source 1..20: mol_type = other DNA
gatgctggggaaacagtcac

SEQ ID NO: 16164 - DNA, 20 bp, synthetic construct
  misc_feature 1..20: note = CRISPR gRNA sequence
  source 1..20: mol_type = other DNA
ctggggaaacagtcacgagc

SEQ ID NO: 16165 - DNA, 20 bp, synthetic construct
  misc_feature 1..20: note = CRISPR gRNA sequence
  source 1..20: mol_type = other DNA
ggaaacagtcacgagcaaga

SEQ ID NO: 16166 - DNA, 20 bp, synthetic construct
  misc_feature 1..20: note = CRISPR gRNA sequence
  source 1..20: mol_type = other DNA
cagtcacgagcaagaaagac

SEQ ID NO: 16167 - DNA, 20 bp, synthetic construct
  misc_feature 1..20: note = CRISPR gRNA sequence
  source 1..20: mol_type = other DNA
agtcacgagcaagaaagaca

SEQ ID NO: 16168 - DNA, 20 bp, synthetic construct
  misc_feature 1..20: note = CRISPR gRNA sequence
  source 1..20: mol_type = other DNA
agacaaggtccctgtcctca

SEQ ID NO: 16169 - DNA, 20 bp, synthetic construct
  misc_feature 1..20: note = CRISPR gRNA sequence
  source 1..20: mol_type = other DNA
caaggtccctgtcctcacag

SEQ ID NO: 16170 - DNA, 20 bp, synthetic construct
  misc_feature 1..20: note = CRISPR gRNA sequence
  source 1..20: mol_type = other DNA
aaggtccctgtcctcacagt

SEQ ID NO: 16171 - DNA, 20 bp, synthetic construct
  misc_feature 1..20: note = CRISPR gRNA sequence
  source 1..20: mol_type = other DNA
ggtccctgtcctcacagtgg

SEQ ID NO: 16172 - DNA, 20 bp, synthetic construct
  misc_feature 1..20: note = CRISPR gRNA sequence
  source 1..20: mol_type = other DNA
tccctgtcctcacagtggga

SEQ ID NO: 16173 - DNA, 20 bp, synthetic construct
  misc_feature 1..20: note = CRISPR gRNA sequence
  source 1..20: mol_type = other DNA
tgtcctcacagtgggagagc

SEQ ID NO: 16174 - DNA, 20 bp, synthetic construct
  misc_feature 1..20: note = CRISPR gRNA sequence
  source 1..20: mol_type = other DNA
gtcctcacagtgggagagca

SEQ ID NO: 16175 - DNA, 20 bp, synthetic construct
  misc_feature 1..20: note = CRISPR gRNA sequence
  source 1..20: mol_type = other DNA
agcaaggcgtaaaatatgtc

SEQ ID NO: 16176 - DNA, 20 bp, synthetic construct
  misc_feature 1..20: note = CRISPR gRNA sequence
  source 1..20: mol_type = other DNA
aggcgtaaaatatgtccaga

SEQ ID NO: 16177 - DNA, 20 bp, synthetic construct
  misc_feature 1..20: note = CRISPR gRNA sequence
  source 1..20: mol_type = other DNA
aaatatgtccagatggtaat

SEQ ID NO: 16178 - DNA, 20 bp, synthetic construct
  misc_feature 1..20: note = CRISPR gRNA sequence
  source 1..20: mol_type = other DNA
ggtaatgagtgctaaactgc

SEQ ID NO: 16179 - DNA, 20 bp, synthetic construct
  misc_feature 1..20: note = CRISPR gRNA sequence
  source 1..20: mol_type = other DNA
gtaatgagtgctaaactgca

SEQ ID NO: 16180 - DNA, 20 bp, synthetic construct
  misc_feature 1..20: note = CRISPR gRNA sequence
  source 1..20: mol_type = other DNA
agtgctaaactgcaaggaaa

SEQ ID NO: 16181 - DNA, 20 bp, synthetic construct
  misc_feature 1..20: note = CRISPR gRNA sequence
  source 1..20: mol_type = other DNA
ctgcaaggaaaaagacacac

SEQ ID NO: 16182 - DNA, 20 bp, synthetic construct
  misc_feature 1..20: note = CRISPR gRNA sequence
  source 1..20: mol_type = other DNA
tgcaaggaaaaagacacaca

SEQ ID NO: 16183 - DNA, 20 bp, synthetic construct
  misc_feature 1..20: note = CRISPR gRNA sequence
  source 1..20: mol_type = other DNA
aggaaaaagacacacaaggt

SEQ ID NO: 16184 - DNA, 20 bp, synthetic construct
  misc_feature 1..20: note = CRISPR gRNA sequence
  source 1..20: mol_type = other DNA
cacacaaggtgagaataact

SEQ ID NO: 16185 - DNA, 20 bp, synthetic construct
  misc_feature 1..20: note = CRISPR gRNA sequence
  source 1..20: mol_type = other DNA
aataactgagctaatctaca

SEQ ID NO: 16186 - DNA, 20 bp, synthetic construct
  misc_feature 1..20: note = CRISPR gRNA sequence
  source 1..20: mol_type = other DNA
aactgagctaatctacatgg

SEQ ID NO: 16187 - DNA, 20 bp, synthetic construct
  misc_feature 1..20: note = CRISPR gRNA sequence
  source 1..20: mol_type = other DNA
actgagctaatctacatgga

SEQ ID NO: 16188 - DNA, 20 bp, synthetic construct
  misc_feature 1..20: note = CRISPR gRNA sequence
  source 1..20: mol_type = other DNA
agctaatctacatggaagga

SEQ ID NO: 16189 - DNA, 20 bp, synthetic construct
  misc_feature 1..20: note = CRISPR gRNA sequence
  source 1..20: mol_type = other DNA
aatctacatggaaggatggt

SEQ ID NO: 16190 - DNA, 20 bp, synthetic construct
  misc_feature 1..20: note = CRISPR gRNA sequence
  source 1..20: mol_type = other DNA
tctacatggaaggatggtca

SEQ ID NO: 16191 - DNA, 20 bp, synthetic construct
  misc_feature 1..20: note = CRISPR gRNA sequence
  source 1..20: mol_type = other DNA
acatggaaggatggtcagag

SEQ ID NO: 16192 - DNA, 20 bp, synthetic construct
  misc_feature 1..20: note = CRISPR gRNA sequence
  source 1..20: mol_type = other DNA
catggaaggatggtcagaga

SEQ ID NO: 16193 - DNA, 20 bp, synthetic construct
  misc_feature 1..20: note = CRISPR gRNA sequence
  source 1..20: mol_type = other DNA
atggaaggatggtcagagaa

SEQ ID NO: 16194 - DNA, 20 bp, synthetic construct
  misc_feature 1..20: note = CRISPR gRNA sequence
  source 1..20: mol_type = other DNA
ggatggtcagagaagggttc

SEQ ID NO: 16195 - DNA, 20 bp, synthetic construct
  misc_feature 1..20: note = CRISPR gRNA sequence
  source 1..20: mol_type = other DNA
gatggtcagagaagggttcc

SEQ ID NO: 16196 - DNA, 20 bp, synthetic construct
  misc_feature 1..20: note = CRISPR gRNA sequence
  source 1..20: mol_type = other DNA
ggtcagagaagggttccagg

SEQ ID NO: 16197 - DNA, 20 bp, synthetic construct
  misc_feature 1..20: note = CRISPR gRNA sequence
  source 1..20: mol_type = other DNA
tcagagaagggttccaggaa

SEQ ID NO: 16198 - DNA, 20 bp, synthetic construct
  misc_feature 1..20: note = CRISPR gRNA sequence
  source 1..20: mol_type = other DNA
cagagaagggttccaggaag

SEQ ID NO: 16199 - DNA, 20 bp, synthetic construct
  misc_feature 1..20: note = CRISPR gRNA sequence
  source 1..20: mol_type = other DNA
agggttccaggaagaggtga

SEQ ID NO: 16200 - DNA, 20 bp, synthetic construct
  misc_feature 1..20: note = CRISPR gRNA sequence
  source 1..20: mol_type = other DNA
tccaggaagaggtgacagtt

SEQ ID NO: 16201 - DNA, 20 bp, synthetic construct
  misc_feature 1..20: note = CRISPR gRNA sequence
  source 1..20: mol_type = other DNA
ggtgacagtttagccaacac

SEQ ID NO: 16202 - DNA, 20 bp, synthetic construct
  misc_feature 1..20: note = CRISPR gRNA sequence
  source 1..20: mol_type = other DNA
acagtttagccaacaccaga

SEQ ID NO: 16203 - DNA, 20 bp, synthetic construct
  misc_feature 1..20: note = CRISPR gRNA sequence
  source 1..20: mol_type = other DNA
gccaacaccagaaagattca

SEQ ID NO: 16204 - DNA, 20 bp, synthetic construct
  misc_feature 1..20: note = CRISPR gRNA sequence
  source 1..20: mol_type = other DNA
ccaacaccagaaagattcaa

SEQ ID NO: 16205 - DNA, 20 bp, synthetic construct
  misc_feature 1..20: note = CRISPR gRNA sequence
  source 1..20: mol_type = other DNA
aacaccagaaagattcaaag

SEQ ID NO: 16206 - DNA, 20 bp, synthetic construct
  misc_feature 1..20: note = CRISPR gRNA sequence
  source 1..20: mol_type = other DNA
ccagaaagattcaaaggagt

SEQ ID NO: 16207 - DNA, 20 bp, synthetic construct
  misc_feature 1..20: note = CRISPR gRNA sequence
  source 1..20: mol_type = other DNA
agattcaaaggagtcagcca

SEQ ID NO: 16208 - DNA, 20 bp, synthetic construct
  misc_feature 1..20: note = CRISPR gRNA sequence
  source 1..20: mol_type = other DNA
gattcaaaggagtcagccat

SEQ ID NO: 16209 - DNA, 20 bp, synthetic construct
  misc_feature 1..20: note = CRISPR gRNA sequence
  source 1..20: mol_type = other DNA
tcaaaggagtcagccatggg

SEQ ID NO: 16210 - DNA, 20 bp, synthetic construct
  misc_feature 1..20: note = CRISPR gRNA sequence
  source 1..20: mol_type = other DNA
gagtcagccatgggaagaac

SEQ ID NO: 16211 - DNA, 20 bp, synthetic construct
  misc_feature 1..20: note = CRISPR gRNA sequence
  source 1..20: mol_type = other DNA
agtcagccatgggaagaact

SEQ ID NO: 16212 - DNA, 20 bp, synthetic construct
  misc_feature 1..20: note = CRISPR gRNA sequence
  source 1..20: mol_type = other DNA
gtcagccatgggaagaactg

SEQ ID NO: 16213 - DNA, 20 bp, synthetic construct
  misc_feature 1..20: note = CRISPR gRNA sequence
  source 1..20: mol_type = other DNA
tcagccatgggaagaactgg

SEQ ID NO: 16214 - DNA, 20 bp, synthetic construct
  misc_feature 1..20: note = CRISPR gRNA sequence
  source 1..20: mol_type = other DNA
gccatgggaagaactggggg

SEQ ID NO: 16215 - DNA, 20 bp, synthetic construct
  misc_feature 1..20: note = CRISPR gRNA sequence
  source 1..20: mol_type = other DNA
ccatgggaagaactggggga

SEQ ID NO: 16216 - DNA, 20 bp, synthetic construct
  misc_feature 1..20: note = CRISPR gRNA sequence
  source 1..20: mol_type = other DNA
catgggaagaactgggggaa

SEQ ID NO: 16217 - DNA, 20 bp, synthetic construct
  misc_feature 1..20: note = CRISPR gRNA sequence
  source 1..20: mol_type = other DNA
gaactgggggaagggcattc

SEQ ID NO: 16218 - DNA, 20 bp, synthetic construct
  misc_feature 1..20: note = CRISPR gRNA sequence
  source 1..20: mol_type = other DNA
tgggggaagggcattccaga

SEQ ID NO: 16219 - DNA, 20 bp, synthetic construct
  misc_feature 1..20: note = CRISPR gRNA sequence
  source 1..20: mol_type = other DNA
ggggaagggcattccagata

SEQ ID NO: 16220 - DNA, 20 bp, synthetic construct
  misc_feature 1..20: note = CRISPR gRNA sequence
  source 1..20: mol_type = other DNA
ggcattccagatagagacta

SEQ ID NO: 16221 - DNA, 20 bp, synthetic construct
  misc_feature 1..20: note = CRISPR gRNA sequence
  source 1..20: mol_type = other DNA
tagagactatagcaactgca

SEQ ID NO: 16222 - DNA, 20 bp, synthetic construct
  misc_feature 1..20: note = CRISPR gRNA sequence
  source 1..20: mol_type = other DNA
agagactatagcaactgcaa

SEQ ID NO: 16223 - DNA, 20 bp, synthetic construct
  misc_feature 1..20: note = CRISPR gRNA sequence
  source 1..20: mol_type = other DNA
atagcaactgcaaaggcccc

SEQ ID NO: 16224 - DNA, 20 bp, synthetic construct
  misc_feature 1..20: note = CRISPR gRNA sequence
  source 1..20: mol_type = other DNA
tagcaactgcaaaggccccg

SEQ ID NO: 16225 - DNA, 20 bp, synthetic construct
  misc_feature 1..20: note = CRISPR gRNA sequence
  source 1..20: mol_type = other DNA
gcaaaggccccgaggcttga

SEQ ID NO: 16226 - DNA, 20 bp, synthetic construct
  misc_feature 1..20: note = CRISPR gRNA sequence
  source 1..20: mol_type = other DNA
caaaggccccgaggcttgaa

SEQ ID NO: 16227 - DNA, 20 bp, synthetic construct
  misc_feature 1..20: note = CRISPR gRNA sequence
  source 1..20: mol_type = other DNA
aaaggccccgaggcttgaaa

SEQ ID NO: 16228 - DNA, 20 bp, synthetic construct
  misc_feature 1..20: note = CRISPR gRNA sequence
  source 1..20: mol_type = other DNA
ccgaggcttgaaagggcaca

SEQ ID NO: 16229 - DNA, 20 bp, synthetic construct
  misc_feature 1..20: note = CRISPR gRNA sequence
  source 1..20: mol_type = other DNA
cgaggcttgaaagggcacat

SEQ ID NO: 16230 - DNA, 20 bp, synthetic construct
  misc_feature 1..20: note = CRISPR gRNA sequence
  source 1..20: mol_type = other DNA
ttgaaagggcacatgggtta

SEQ ID NO: 16231 - DNA, 20 bp, synthetic construct
  misc_feature 1..20: note = CRISPR gRNA sequence
  source 1..20: mol_type = other DNA
tgaaagggcacatgggttat

SEQ ID NO: 16232 - DNA, 20 bp, synthetic construct
  misc_feature 1..20: note = CRISPR gRNA sequence
  source 1..20: mol_type = other DNA
aaagggcacatgggttatag

SEQ ID NO: 16233 - DNA, 20 bp, synthetic construct
  misc_feature 1..20: note = CRISPR gRNA sequence
  source 1..20: mol_type = other DNA
gggcacatgggttataggag

SEQ ID NO: 16234 - DNA, 20 bp, synthetic construct
  misc_feature 1..20: note = CRISPR gRNA sequence
  source 1..20: mol_type = other DNA
gcacatgggttataggagtg

SEQ ID NO: 16235 - DNA, 20 bp, synthetic construct
  misc_feature 1..20: note = CRISPR gRNA sequence
  source 1..20: mol_type = other DNA
catgggttataggagtggag

SEQ ID NO: 16236 - DNA, 20 bp, synthetic construct
  misc_feature 1..20: note = CRISPR gRNA sequence
  source 1..20: mol_type = other DNA
ggttataggagtggagaagc

SEQ ID NO: 16237 - DNA, 20 bp, synthetic construct
  misc_feature 1..20: note = CRISPR gRNA sequence
  source 1..20: mol_type = other DNA
tataggagtggagaagctgg

SEQ ID NO: 16238 - DNA, 20 bp, synthetic construct
  misc_feature 1..20: note = CRISPR gRNA sequence
  source 1..20: mol_type = other DNA
aggagtggagaagctggtgg

SEQ ID NO: 16239 - DNA, 20 bp, synthetic construct
  misc_feature 1..20: note = CRISPR gRNA sequence
  source 1..20: mol_type = other DNA
ggagaagctggtggtggctg

SEQ ID NO: 16240 - DNA, 20 bp, synthetic construct
  misc_feature 1..20: note = CRISPR gRNA sequence
  source 1..20: mol_type = other DNA
agctggtggtggctgaagtg

SEQ ID NO: 16241 - DNA, 20 bp, synthetic construct
  misc_feature 1..20: note = CRISPR gRNA sequence
  source 1..20: mol_type = other DNA
ggctgaagtgtggtgtctca

SEQ ID NO: 16242 - DNA, 20 bp, synthetic construct
  misc_feature 1..20: note = CRISPR gRNA sequence
  source 1..20: mol_type = other DNA
tgaagtgtggtgtctcatag

SEQ ID NO: 16243 - DNA, 20 bp, synthetic construct
  misc_feature 1..20: note = CRISPR gRNA sequence
  source 1..20: mol_type = other DNA
gaagtgtggtgtctcatagt

SEQ ID NO: 16244 - DNA, 20 bp, synthetic construct
  misc_feature 1..20: note = CRISPR gRNA sequence
  source 1..20: mol_type = other DNA
gtggtgtctcatagtgggtt

SEQ ID NO: 16245 - DNA, 20 bp, synthetic construct
  misc_feature 1..20: note = CRISPR gRNA sequence
  source 1..20: mol_type = other DNA
ggtgtctcatagtgggtttg

SEQ ID NO: 16246 - DNA, 20 bp, synthetic construct
  misc_feature 1..20: note = CRISPR gRNA sequence
  source 1..20: mol_type = other DNA
tgtctcatagtgggtttgga

SEQ ID NO: 16247 - DNA, 20 bp, synthetic construct
  misc_feature 1..20: note = CRISPR gRNA sequence
  source 1..20: mol_type = other DNA
gtctcatagtgggtttggag

SEQ ID NO: 16248 - DNA, 20 bp, synthetic construct
  misc_feature 1..20: note = CRISPR gRNA sequence
  source 1..20: mol_type = other DNA
tctcatagtgggtttggaga

SEQ ID NO: 16249 - DNA, 20 bp, synthetic construct
  misc_feature 1..20: note = CRISPR gRNA sequence
  source 1..20: mol_type = other DNA
tcatagtgggtttggagagg

SEQ ID NO: 16250 - DNA, 20 bp, synthetic construct
  misc_feature 1..20: note = CRISPR gRNA sequence
  source 1..20: mol_type = other DNA
catagtgggtttggagaggg

SEQ ID NO: 16251 - DNA, 20 bp, synthetic construct
  misc_feature 1..20: note = CRISPR gRNA sequence
  source 1..20: mol_type = other DNA
agtgggtttggagagggagg

SEQ ID NO: 16252 - DNA, 20 bp, synthetic construct
  misc_feature 1..20: note = CRISPR gRNA sequence
  source 1..20: mol_type = other DNA
gtgggtttggagagggagga

SEQ ID NO: 16253 - DNA, 20 bp, synthetic construct
  misc_feature 1..20: note = CRISPR gRNA sequence
  source 1..20: mol_type = other DNA
tgggtttggagagggaggaa

SEQ ID NO: 16254 - DNA, 20 bp, synthetic construct
  misc_feature 1..20: note = CRISPR gRNA sequence
  source 1..20: mol_type = other DNA
gagagggaggaagggccata

SEQ ID NO: 16255 - DNA, 20 bp, synthetic construct
  misc_feature 1..20: note = CRISPR gRNA sequence
  source 1..20: mol_type = other DNA
agagggaggaagggccatac

SEQ ID NO: 16256 - DNA, 20 bp, synthetic construct
  misc_feature 1..20: note = CRISPR gRNA sequence
  source 1..20: mol_type = other DNA
gaagggccatacaggccttg

SEQ ID NO: 16257 - DNA, 20 bp, synthetic construct
  misc_feature 1..20: note = CRISPR gRNA sequence
  source 1..20: mol_type = other DNA
gccttgtggcatgtattttg

SEQ ID NO: 16258 - DNA, 20 bp, synthetic construct
  misc_feature 1..20: note = CRISPR gRNA sequence
  source 1..20: mol_type = other DNA
ggcatgtattttgtagccat

SEQ ID NO: 16259 - DNA, 20 bp, synthetic construct
  misc_feature 1..20: note = CRISPR gRNA sequence
  source 1..20: mol_type = other DNA
catgtattttgtagccattg

SEQ ID NO: 16260 - DNA, 20 bp, synthetic construct
  misc_feature 1..20: note = CRISPR gRNA sequence
  source 1..20: mol_type = other DNA
atgtattttgtagccattgg

SEQ ID NO: 16261 - DNA, 20 bp, synthetic construct
  misc_feature 1..20: note = CRISPR gRNA sequence
  source 1..20: mol_type = other DNA
tgtattttgtagccattgga

SEQ ID NO: 16262 - DNA, 20 bp, synthetic construct
  misc_feature 1..20: note = CRISPR gRNA sequence
  source 1..20: mol_type = other DNA
tgtagccattggagggttat

SEQ ID NO: 16263 - DNA, 20 bp, synthetic construct
  misc_feature 1..20: note = CRISPR gRNA sequence
  source 1..20: mol_type = other DNA
gtagccattggagggttatc

SEQ ID NO: 16264 - DNA, 20 bp, synthetic construct
  misc_feature 1..20: note = CRISPR gRNA sequence
  source 1..20: mol_type = other DNA
tagccattggagggttatca

SEQ ID NO: 16265 - DNA, 20 bp, synthetic construct
  misc_feature 1..20: note = CRISPR gRNA sequence
  source 1..20: mol_type = other DNA
tatcagggccatgaaataat

SEQ ID NO: 16266 - DNA, 20 bp, synthetic construct
  misc_feature 1..20: note = CRISPR gRNA sequence
  source 1..20: mol_type = other DNA
aataatcagatgtacatttt

SEQ ID NO: 16267 - DNA, 20 bp, synthetic construct
  misc_feature 1..20: note = CRISPR gRNA sequence
  source 1..20: mol_type = other DNA
ataatcagatgtacatttta

SEQ ID NO: 16268 - DNA, 20 bp, synthetic construct
  misc_feature 1..20: note = CRISPR gRNA sequence
  source 1..20: mol_type = other DNA
gtacattttaaggctcctgt

SEQ ID NO: 16269 - DNA, 20 bp, synthetic construct
  misc_feature 1..20: note = CRISPR gRNA sequence
  source 1..20: mol_type = other DNA
aaggctcctgttggctttta

SEQ ID NO: 16270 - DNA, 20 bp, synthetic construct
  misc_feature 1..20: note = CRISPR gRNA sequence
  source 1..20: mol_type = other DNA
aggctcctgttggcttttaa

SEQ ID NO: 16271 - DNA, 20 bp, synthetic construct
  misc_feature 1..20: note = CRISPR gRNA sequence
  source 1..20: mol_type = other DNA
ggctcctgttggcttttaaa

SEQ ID NO: 16272 - DNA, 20 bp, synthetic construct
  misc_feature 1..20: note = CRISPR gRNA sequence
  source 1..20: mol_type = other DNA
cttttaaagggcctcccaac

SEQ ID NO: 16273 - DNA, 20 bp, synthetic construct
  misc_feature 1..20: note = CRISPR gRNA sequence
  source 1..20: mol_type = other DNA
taaagggcctcccaaccaga

SEQ ID NO: 16274 - DNA, 20 bp, synthetic construct
  misc_feature 1..20: note = CRISPR gRNA sequence
  source 1..20: mol_type = other DNA
aaagggcctcccaaccagac

SEQ ID NO: 16275 - DNA, 20 bp, synthetic construct
  misc_feature 1..20: note = CRISPR gRNA sequence
  source 1..20: mol_type = other DNA
cctcccaaccagacaggact

SEQ ID NO: 16276 - DNA, 20 bp, synthetic construct
  misc_feature 1..20: note = CRISPR gRNA sequence
  source 1..20: mol_type = other DNA
ccaaccagacaggacttagc

SEQ ID NO: 16277 - DNA, 20 bp, synthetic construct
  misc_feature 1..20: note = CRISPR gRNA sequence
  source 1..20: mol_type = other DNA
caaccagacaggacttagcg

SEQ ID NO: 16278 - DNA, 20 bp, synthetic construct
  misc_feature 1..20: note = CRISPR gRNA sequence
  source 1..20: mol_type = other DNA
aaccagacaggacttagcga

SEQ ID NO: 16279 - DNA, 20 bp, synthetic construct
  misc_feature 1..20: note = CRISPR gRNA sequence
  source 1..20: mol_type = other DNA
cagacaggacttagcgaggg

SEQ ID NO: 16280 - DNA, 20 bp, synthetic construct
  misc_feature 1..20: note = CRISPR gRNA sequence
  source 1..20: mol_type = other DNA
caggacttagcgagggaagc

SEQ ID NO: 16281 - DNA, 20 bp, synthetic construct
  misc_feature 1..20: note = CRISPR gRNA sequence
  source 1..20: mol_type = other DNA
acttagcgagggaagcaagt

SEQ ID NO: 16282 - DNA, 20 bp, synthetic construct
  misc_feature 1..20: note = CRISPR gRNA sequence
  source 1..20: mol_type = other DNA
agggaagcaagttggaccca

SEQ ID NO: 16283 - DNA, 20 bp, synthetic construct
  misc_feature 1..20: note = CRISPR gRNA sequence
  source 1..20: mol_type = other DNA
gaagcaagttggacccacag

SEQ ID NO: 16284 - DNA, 20 bp, synthetic construct
  misc_feature 1..20: note = CRISPR gRNA sequence
  source 1..20: mol_type = other DNA
aagcaagttggacccacagc

SEQ ID NO: 16285 - DNA, 20 bp, synthetic construct
  misc_feature 1..20: note = CRISPR gRNA sequence
  source 1..20: mol_type = other DNA
gttggacccacagcaggctt

SEQ ID NO: 16286 - DNA, 20 bp, synthetic construct
  misc_feature 1..20: note = CRISPR gRNA sequence
  source 1..20: mol_type = other DNA
tggacccacagcaggctttg

SEQ ID NO: 16287 - DNA, 20 bp, synthetic construct
  misc_feature 1..20: note = CRISPR gRNA sequence
  source 1..20: mol_type = other DNA
ccacagcaggctttggagtc

SEQ ID NO: 16288 - DNA, 20 bp, synthetic construct
  misc_feature 1..20: note = CRISPR gRNA sequence
  source 1..20: mol_type = other DNA
cacagcaggctttggagtca

SEQ ID NO: 16289 - DNA, 20 bp, synthetic construct
  misc_feature 1..20: note = CRISPR gRNA sequence
  source 1..20: mol_type = other DNA
gcaggctttggagtcaagga

SEQ ID NO: 16290 - DNA, 20 bp, synthetic construct
  misc_feature 1..20: note = CRISPR gRNA sequence
  source 1..20: mol_type = other DNA
caggctttggagtcaaggaa

SEQ ID NO: 16291 - DNA, 20 bp, synthetic construct
  misc_feature 1..20: note = CRISPR gRNA sequence
  source 1..20: mol_type = other DNA
ctttggagtcaaggaaaggc

SEQ ID NO: 16292 - DNA, 20 bp, synthetic construct
  misc_feature 1..20: note = CRISPR gRNA sequence
  source 1..20: mol_type = other DNA
tttggagtcaaggaaaggcc

SEQ ID NO: 16293 - DNA, 20 bp, synthetic construct
  misc_feature 1..20: note = CRISPR gRNA sequence
  source 1..20: mol_type = other DNA
tcaaggaaaggccaggtctc

SEQ ID NO: 16294 - DNA, 20 bp, synthetic construct
  misc_feature 1..20: note = CRISPR gRNA sequence
  source 1..20: mol_type = other DNA
ggaaaggccaggtctcaagc

SEQ ID NO: 16295 - DNA, 20 bp, synthetic construct
  misc_feature 1..20: note = CRISPR gRNA sequence
  source 1..20: mol_type = other DNA
gaaaggccaggtctcaagca

SEQ ID NO: 16296 - DNA, 20 bp, synthetic construct
  misc_feature 1..20: note = CRISPR gRNA sequence
  source 1..20: mol_type = other DNA
ggccaggtctcaagcaaggc

SEQ ID NO: 16297 - DNA, 20 bp, synthetic construct
  misc_feature 1..20: note = CRISPR gRNA sequence
  source 1..20: mol_type = other DNA
gccaggtctcaagcaaggct

SEQ ID NO: 16298 - DNA, 20 bp, synthetic construct
  misc_feature 1..20: note = CRISPR gRNA sequence
  source 1..20: mol_type = other DNA
ggtctcaagcaaggctaggt

SEQ ID NO: 16299 - DNA, 20 bp, synthetic construct
  misc_feature 1..20: note = CRISPR gRNA sequence
  source 1..20: mol_type = other DNA
caagcaaggctaggttggat

SEQ ID NO: 16300 - DNA, 20 bp, synthetic construct
  misc_feature 1..20: note = CRISPR gRNA sequence
  source 1..20: mol_type = other DNA
aagcaaggctaggttggatc

SEQ ID NO: 16301 - DNA, 20 bp, synthetic construct
  misc_feature 1..20: note = CRISPR gRNA sequence
  source 1..20: mol_type = other DNA
agcaaggctaggttggatca

SEQ ID NO: 16302 - DNA, 20 bp, synthetic construct
  misc_feature 1..20: note = CRISPR gRNA sequence
  source 1..20: mol_type = other DNA
caaggctaggttggatcagg

SEQ ID NO: 16303 - DNA, 20 bp, synthetic construct
  misc_feature 1..20: note = CRISPR gRNA sequence
  source 1..20: mol_type = other DNA
aaggctaggttggatcaggg

SEQ ID NO: 16304 - DNA, 20 bp, synthetic construct
  misc_feature 1..20: note = CRISPR gRNA sequence
  source 1..20: mol_type = other DNA
aggctaggttggatcaggga

SEQ ID NO: 16305 - DNA, 20 bp, synthetic construct
  misc_feature 1..20: note = CRISPR gRNA sequence
  source 1..20: mol_type = other DNA
ggctaggttggatcagggag

SEQ ID NO: 16306 - DNA, 20 bp, synthetic construct
  misc_feature 1..20: note = CRISPR gRNA sequence
  source 1..20: mol_type = other DNA
cttttctgcccaacttctgc

SEQ ID NO: 16307 - DNA, 20 bp, synthetic construct
  misc_feature 1..20: note = CRISPR gRNA sequence
  source 1..20: mol_type = other DNA
ctctcaccgatcacttcatc

SEQ ID NO: 16308 - DNA, 20 bp, synthetic construct
  misc_feature 1..20: note = CRISPR gRNA sequence
  source 1..20: mol_type = other DNA
ggtcctatgtgctctacttt

SEQ ID NO: 16309 - DNA, 20 bp, synthetic construct
  misc_feature 1..20: note = CRISPR gRNA sequence
  source 1..20: mol_type = other DNA
tgctctactttgagaaaaac

SEQ ID NO: 16310 - DNA, 20 bp, synthetic construct
  misc_feature 1..20: note = CRISPR gRNA sequence
  source 1..20: mol_type = other DNA
ctctactttgagaaaaacca

SEQ ID NO: 16311 - DNA, 20 bp, synthetic construct
  misc_feature 1..20: note = CRISPR gRNA sequence
  source 1..20: mol_type = other DNA
ccaactcacacaatcaatga

SEQ ID NO: 16312 - DNA, 20 bp, synthetic construct
  misc_feature 1..20: note = CRISPR gRNA sequence
  source 1..20: mol_type = other DNA
cacacaatcaatgaaagccc

SEQ ID NO: 16313 - DNA, 20 bp, synthetic construct
  misc_feature 1..20: note = CRISPR gRNA sequence
  source 1..20: mol_type = other DNA
acacaatcaatgaaagccca

SEQ ID NO: 16314 - DNA, 20 bp, synthetic construct
  misc_feature 1..20: note = CRISPR gRNA sequence
  source 1..20: mol_type = other DNA
aatcaatgaaagcccaaggt

SEQ ID NO: 16315 - DNA, 20 bp, synthetic construct
  misc_feature 1..20: note = CRISPR gRNA sequence
  source 1..20: mol_type = other DNA
agtctctattgtacccacct

SEQ ID NO: 16316 - DNA, 20 bp, synthetic construct
  misc_feature 1..20: note = CRISPR gRNA sequence
  source 1..20: mol_type = other DNA
gtctctattgtacccacctt

SEQ ID NO: 16317 - DNA, 20 bp, synthetic construct
  misc_feature 1..20: note = CRISPR gRNA sequence
  source 1..20: mol_type = other DNA
tctctattgtacccaccttg

SEQ ID NO: 16318 - DNA, 20 bp, synthetic construct
  misc_feature 1..20: note = CRISPR gRNA sequence
  source 1..20: mol_type = other DNA
tctattgtacccaccttggg

SEQ ID NO: 16319 - DNA, 20 bp, synthetic construct
  misc_feature 1..20: note = CRISPR gRNA sequence
  source 1..20: mol_type = other DNA
tattgtacccaccttgggga

SEQ ID NO: 16320 - DNA, 20 bp, synthetic construct
  misc_feature 1..20: note = CRISPR gRNA sequence
  source 1..20: mol_type = other DNA
attgtacccaccttggggag

SEQ ID NO: 16321 - DNA, 20 bp, synthetic construct
  misc_feature 1..20: note = CRISPR gRNA sequence
  source 1..20: mol_type = other DNA
ttgtacccaccttggggaga

SEQ ID NO: 16322 - DNA, 20 bp, synthetic construct
  misc_feature 1..20: note = CRISPR gRNA sequence
  source 1..20: mol_type = other DNA
tgtacccaccttggggagag

SEQ ID NO: 16323 - DNA, 20 bp, synthetic construct
  misc_feature 1..20: note = CRISPR gRNA sequence
  source 1..20: mol_type = other DNA
tctgactgcccatcaatgaa

SEQ ID NO: 16324 - DNA, 20 bp, synthetic construct
  misc_feature 1..20: note = CRISPR gRNA sequence
  source 1..20: mol_type = other DNA
gcccatcaatgaatggtcgt

SEQ ID NO: 16325 - DNA, 20 bp, synthetic construct
  misc_feature 1..20: note = CRISPR gRNA sequence
  source 1..20: mol_type = other DNA
cccatcaatgaatggtcgtc

SEQ ID NO: 16326 - DNA, 20 bp, synthetic construct
  misc_feature 1..20: note = CRISPR gRNA sequence
  source 1..20: mol_type = other DNA
aatgaatggtcgtcaggtat

SEQ ID NO: 16327 - DNA, 20 bp, synthetic construct
  misc_feature 1..20: note = CRISPR gRNA sequence
  source 1..20: mol_type = other DNA
atgaatggtcgtcaggtatt

SEQ ID NO: 16328 - DNA, 20 bp, synthetic construct
  misc_feature 1..20: note = CRISPR gRNA sequence
  source 1..20: mol_type = other DNA
tgaatggtcgtcaggtatta

SEQ ID NO: 16329 - DNA, 20 bp, synthetic construct
  misc_feature 1..20: note = CRISPR gRNA sequence
  source 1..20: mol_type = other DNA
tcaggtattagggcaccccc

SEQ ID NO: 16330 - DNA, 20 bp, synthetic construct
  misc_feature 1..20: note = CRISPR gRNA sequence
  source 1..20: mol_type = other DNA
caggtattagggcacccccc

SEQ ID NO: 16331 - DNA, 20 bp, synthetic construct
  misc_feature 1..20: note = CRISPR gRNA sequence
  source 1..20: mol_type = other DNA
aggtattagggcacccccca

SEQ ID NO: 16332 - DNA, 20 bp, synthetic construct
  misc_feature 1..20: note = CRISPR gRNA sequence
  source 1..20: mol_type = other DNA
tagggcaccccccagggaac

SEQ ID NO: 16333 - DNA, 20 bp, synthetic construct
  misc_feature 1..20: note = CRISPR gRNA sequence
  source 1..20: mol_type = other DNA
agggcaccccccagggaaca

SEQ ID NO: 16334 - DNA, 20 bp, synthetic construct
  misc_feature 1..20: note = CRISPR gRNA sequence
  source 1..20: mol_type = other DNA
gcaccccccagggaacaagg

SEQ ID NO: 16335 - DNA, 20 bp, synthetic construct
  misc_feature 1..20: note = CRISPR gRNA sequence
  source 1..20: mol_type = other DNA
caccccccagggaacaaggc

SEQ ID NO: 16336 - DNA, 20 bp, synthetic construct
  misc_feature 1..20: note = CRISPR gRNA sequence
  source 1..20: mol_type = other DNA
agggaacaaggcaggaaatg

SEQ ID NO: 16337 - DNA, 20 bp, synthetic construct
  misc_feature 1..20: note = CRISPR gRNA sequence
  source 1..20: mol_type = other DNA
gggaacaaggcaggaaatgc

SEQ ID NO: 16338 - DNA, 20 bp, synthetic construct
  misc_feature 1..20: note = CRISPR gRNA sequence
  source 1..20: mol_type = other DNA
caaggcaggaaatgcaggct

SEQ ID NO: 16339 - DNA, 20 bp, synthetic construct
  misc_feature 1..20: note = CRISPR gRNA sequence
  source 1..20: mol_type = other DNA
caggaaatgcaggctgagcc

SEQ ID NO: 16340 - DNA, 20 bp, synthetic construct
  misc_feature 1..20: note = CRISPR gRNA sequence
  source 1..20: mol_type = other DNA
ttactgaaaatgtccttgct

SEQ ID NO: 16341 - DNA, 20 bp, synthetic construct
  misc_feature 1..20: note = CRISPR gRNA sequence
  source 1..20: mol_type = other DNA
tactgaaaatgtccttgctc

SEQ ID NO: 16342 - DNA, 20 bp, synthetic construct
  misc_feature 1..20: note = CRISPR gRNA sequence
  source 1..20: mol_type = other DNA
atgtccttgctcaggccctc

SEQ ID NO: 16343 - DNA, 20 bp, synthetic construct
  misc_feature 1..20: note = CRISPR gRNA sequence
  source 1..20: mol_type = other DNA
ccttgctcaggccctccagc

SEQ ID NO: 16344 - DNA, 20 bp, synthetic construct
  misc_feature 1..20: note = CRISPR gRNA sequence
  source 1..20: mol_type = other DNA
cttgctcaggccctccagct

SEQ ID NO: 16345 - DNA, 20 bp, synthetic construct
  misc_feature 1..20: note = CRISPR gRNA sequence
  source 1..20: mol_type = other DNA
tgctcaggccctccagctgg

SEQ ID NO: 16346 - DNA, 20 bp, synthetic construct
  misc_feature 1..20: note = CRISPR gRNA sequence
  source 1..20: mol_type = other DNA
ggccctccagctgggagtcc

SEQ ID NO: 16347 - DNA, 20 bp, synthetic construct
  misc_feature 1..20: note = CRISPR gRNA sequence
  source 1..20: mol_type = other DNA
cctccagctgggagtcctgg

SEQ ID NO: 16348 - DNA, 20 bp, synthetic construct
  misc_feature 1..20: note = CRISPR gRNA sequence
  source 1..20: mol_type = other DNA
gggagtcctggaagacatac

SEQ ID NO: 16349 - DNA, 20 bp, synthetic construct
  misc_feature 1..20: note = CRISPR gRNA sequence
  source 1..20: mol_type = other DNA
tcctggaagacatactggtc

SEQ ID NO: 16350 - DNA, 20 bp, synthetic construct
  misc_feature 1..20: note = CRISPR gRNA sequence
  source 1..20: mol_type = other DNA
actggtccagttccgctgcc

SEQ ID NO: 16351 - DNA, 20 bp, synthetic construct
  misc_feature 1..20: note = CRISPR gRNA sequence
  source 1..20: mol_type = other DNA
tccagttccgctgcccagac

SEQ ID NO: 16352 - DNA, 20 bp, synthetic construct
  misc_feature 1..20: note = CRISPR gRNA sequence
  source 1..20: mol_type = other DNA
ccagttccgctgcccagaca

SEQ ID NO: 16353 - DNA, 20 bp, synthetic construct
  misc_feature 1..20: note = CRISPR gRNA sequence
  source 1..20: mol_type = other DNA
tccgctgcccagacaaggaa

SEQ ID NO: 16354 - DNA, 20 bp, synthetic construct
  misc_feature 1..20: note = CRISPR gRNA sequence
  source 1..20: mol_type = other DNA
tgcccagacaaggaaaagcg

SEQ ID NO: 16355 - DNA, 20 bp, synthetic construct
  misc_feature 1..20: note = CRISPR gRNA sequence
  source 1..20: mol_type = other DNA
gaaaagcgcagtcaatcaac

SEQ ID NO: 16356 - DNA, 20 bp, synthetic construct
  misc_feature 1..20: note = CRISPR gRNA sequence
  source 1..20: mol_type = other DNA
aaaagcgcagtcaatcaaca

SEQ ID NO: 16357 - DNA, 20 bp, synthetic construct
  misc_feature 1..20: note = CRISPR gRNA sequence
  source 1..20: mol_type = other DNA
caatcaacaaggtctaactg

SEQ ID NO: 16358 - DNA, 20 bp, synthetic construct
  misc_feature 1..20: note = CRISPR gRNA sequence
  source 1..20: mol_type = other DNA
aatcaacaaggtctaactga

SEQ ID NO: 16359 - DNA, 20 bp, synthetic construct
  misc_feature 1..20: note = CRISPR gRNA sequence
  source 1..20: mol_type = other DNA
actgaaggcccactgtgtgc

SEQ ID NO: 16360 - DNA, 20 bp, synthetic construct
  misc_feature 1..20: note = CRISPR gRNA sequence
  source 1..20: mol_type = other DNA
ctgaaggcccactgtgtgcc

SEQ ID NO: 16361 - DNA, 20 bp, synthetic construct
  misc_feature 1..20: note = CRISPR gRNA sequence
  source 1..20: mol_type = other DNA
gcccactgtgtgccaggcct

SEQ ID NO: 16362 - DNA, 20 bp, synthetic construct
  misc_feature 1..20: note = CRISPR gRNA sequence
  source 1..20: mol_type = other DNA
cccactgtgtgccaggcctt

SEQ ID NO: 16363 - DNA, 20 bp, synthetic construct
  misc_feature 1..20: note = CRISPR gRNA sequence
  source 1..20: mol_type = other DNA
ctgtgtgccaggccttgggc

SEQ ID NO: 16364 - DNA, 20 bp, synthetic construct
  misc_feature 1..20: note = CRISPR gRNA sequence
  source 1..20: mol_type = other DNA
tgtgtgccaggccttgggct

SEQ ID NO: 16365 - DNA, 20 bp, synthetic construct
  misc_feature 1..20: note = CRISPR gRNA sequence
  source 1..20: mol_type = other DNA
gtgtgccaggccttgggctg

SEQ ID NO: 16366 - DNA, 20 bp, synthetic construct
  misc_feature 1..20: note = CRISPR gRNA sequence
  source 1..20: mol_type = other DNA
gccttgggctggggaacctc

SEQ ID NO: 16367 - DNA, 20 bp, synthetic construct
  misc_feature 1..20: note = CRISPR gRNA sequence
  source 1..20: mol_type = other DNA
ccttgggctggggaacctct

SEQ ID NO: 16368 - DNA, 20 bp, synthetic construct
  misc_feature 1..20: note = CRISPR gRNA sequence
  source 1..20: mol_type = other DNA
ggctggggaacctctgggcc

SEQ ID NO: 16369 - DNA, 20 bp, synthetic construct
  misc_feature 1..20: note = CRISPR gRNA sequence
  source 1..20: mol_type = other DNA
gaacctctgggcctggcaca

SEQ ID NO: 16370 - DNA, 20 bp, synthetic construct
  misc_feature 1..20: note = CRISPR gRNA sequence
  source 1..20: mol_type = other DNA
cctctgggcctggcacacag

SEQ ID NO: 16371 - DNA, 20 bp, synthetic construct
  misc_feature 1..20: note = CRISPR gRNA sequence
  source 1..20: mol_type = other DNA
ctctgggcctggcacacagt

SEQ ID NO: 16372 - DNA, 20 bp, synthetic construct
  misc_feature 1..20: note = CRISPR gRNA sequence
  source 1..20: mol_type = other DNA
tctgggcctggcacacagtg

SEQ ID NO: 16373 - DNA, 20 bp, synthetic construct
  misc_feature 1..20: note = CRISPR gRNA sequence
  source 1..20: mol_type = other DNA
ctggcacacagtggggactc

SEQ ID NO: 16374 - DNA, 20 bp, synthetic construct
  misc_feature 1..20: note = CRISPR gRNA sequence
  source 1..20: mol_type = other DNA
atgaatgaacactgacactc

SEQ ID NO: 16375 - DNA, 20 bp, synthetic construct
  misc_feature 1..20: note = CRISPR gRNA sequence
  source 1..20: mol_type = other DNA
tgaatgaacactgacactcc

SEQ ID NO: 16376 - DNA, 20 bp, synthetic construct
  misc_feature 1..20: note = CRISPR gRNA sequence
  source 1..20: mol_type = other DNA
gaatgaacactgacactcca

SEQ ID NO: 16377 - DNA, 20 bp, synthetic construct
  misc_feature 1..20: note = CRISPR gRNA sequence
  source 1..20: mol_type = other DNA
aatgaacactgacactccag

SEQ ID NO: 16378 - DNA, 20 bp, synthetic construct
  misc_feature 1..20: note = CRISPR gRNA sequence
  source 1..20: mol_type = other DNA
ggggcccttaatctaatcaa

SEQ ID NO: 16379 - DNA, 20 bp, synthetic construct
  misc_feature 1..20: note = CRISPR gRNA sequence
  source 1..20: mol_type = other DNA
gggcccttaatctaatcaaa

SEQ ID NO: 16380 - DNA, 20 bp, synthetic construct
  misc_feature 1..20: note = CRISPR gRNA sequence
  source 1..20: mol_type = other DNA
cttaatctaatcaaaaggat

SEQ ID NO: 16381 - DNA, 20 bp, synthetic construct
  misc_feature 1..20: note = CRISPR gRNA sequence
  source 1..20: mol_type = other DNA
ttaatctaatcaaaaggatg

SEQ ID NO: 16382 - DNA, 20 bp, synthetic construct
  misc_feature 1..20: note = CRISPR gRNA sequence
  source 1..20: mol_type = other DNA
aaaacttatctactgctaca

SEQ ID NO: 16383 - DNA, 20 bp, synthetic construct
  misc_feature 1..20: note = CRISPR gRNA sequence
  source 1..20: mol_type = other DNA
acttatctactgctacaaag

SEQ ID NO: 16384 - DNA, 20 bp, synthetic construct
  misc_feature 1..20: note = CRISPR gRNA sequence
  source 1..20: mol_type = other DNA
ttatctactgctacaaagaa

SEQ ID NO: 16385 - DNA, 20 bp, synthetic construct
  misc_feature 1..20: note = CRISPR gRNA sequence
  source 1..20: mol_type = other DNA
ctactgctacaaagaagagc

SEQ ID NO: 16386 - DNA, 20 bp, synthetic construct
  misc_feature 1..20: note = CRISPR gRNA sequence
  source 1..20: mol_type = other DNA
tactgctacaaagaagagca

SEQ ID NO: 16387 - DNA, 20 bp, synthetic construct
  misc_feature 1..20: note = CRISPR gRNA sequence
  source 1..20: mol_type = other DNA
tgctacaaagaagagcaagg

SEQ ID NO: 16388 - DNA, 20 bp, synthetic construct
  misc_feature 1..20: note = CRISPR gRNA sequence
  source 1..20: mol_type = other DNA
caaagaagagcaaggcagaa

SEQ ID NO: 16389 - DNA, 20 bp, synthetic construct
  misc_feature 1..20: note = CRISPR gRNA sequence
  source 1..20: mol_type = other DNA
agaagagcaaggcagaatgg

SEQ ID NO: 16390 - DNA, 20 bp, synthetic construct
  misc_feature 1..20: note = CRISPR gRNA sequence
  source 1..20: mol_type = other DNA
aagagcaaggcagaatggta

SEQ ID NO: 16391 - DNA, 20 bp, synthetic construct
  misc_feature 1..20: note = CRISPR gRNA sequence
  source 1..20: mol_type = other DNA
gcagaatggtagagttactg

SEQ ID NO: 16392 - DNA, 20 bp, synthetic construct
  misc_feature 1..20: note = CRISPR gRNA sequence
  source 1..20: mol_type = other DNA
cagaatggtagagttactgc

SEQ ID NO: 16393 - DNA, 20 bp, synthetic construct
  misc_feature 1..20: note = CRISPR gRNA sequence
  source 1..20: mol_type = other DNA
gtagagttactgcaggattt

SEQ ID NO: 16394 - DNA, 20 bp, synthetic construct
  misc_feature 1..20: note = CRISPR gRNA sequence
  source 1..20: mol_type = other DNA
attccacctctactttccac

SEQ ID NO: 16395 - DNA, 20 bp, synthetic construct
  misc_feature 1..20: note = CRISPR gRNA sequence
  source 1..20: mol_type = other DNA
ctactttccactagccctac

SEQ ID NO: 16396 - DNA, 20 bp, synthetic construct
  misc_feature 1..20: note = CRISPR gRNA sequence
  source 1..20: mol_type = other DNA
ccctactagctgtgcaatct

SEQ ID NO: 16397 - DNA, 20 bp, synthetic construct
  misc_feature 1..20: note = CRISPR gRNA sequence
  source 1..20: mol_type = other DNA
cctactagctgtgcaatctt

SEQ ID NO: 16398 - DNA, 20 bp, synthetic construct
  misc_feature 1..20: note = CRISPR gRNA sequence
  source 1..20: mol_type = other DNA
ggctacttatttaaccactg

SEQ ID NO: 16399 - DNA, 20 bp, synthetic construct
  misc_feature 1..20: note = CRISPR gRNA sequence
  source 1..20: mol_type = other DNA
gctacttatttaaccactgt

SEQ ID NO: 16400 - DNA, 20 bp, synthetic construct
  misc_feature 1..20: note = CRISPR gRNA sequence
  source 1..20: mol_type = other DNA
ctccattttctcatctgtgt

SEQ ID NO: 16401 - DNA, 20 bp, synthetic construct
  misc_feature 1..20: note = CRISPR gRNA sequence
  source 1..20: mol_type = other DNA
aataaataatgcctactacc

SEQ ID NO: 16402 - DNA, 20 bp, synthetic construct
  misc_feature 1..20: note = CRISPR gRNA sequence
  source 1..20: mol_type = other DNA
ataaataatgcctactaccc

SEQ ID NO: 16403 - DNA, 20 bp, synthetic construct
  misc_feature 1..20: note = CRISPR gRNA sequence
  source 1..20: mol_type = other DNA
gcctactacccaggaatcga

SEQ ID NO: 16404 - DNA, 20 bp, synthetic construct
  misc_feature 1..20: note = CRISPR gRNA sequence
  source 1..20: mol_type = other DNA
caggaatcgatggtgataat

SEQ ID NO: 16405 - DNA, 20 bp, synthetic construct
  misc_feature 1..20: note = CRISPR gRNA sequence
  source 1..20: mol_type = other DNA
ggaatcgatggtgataatta

SEQ ID NO: 16406 - DNA, 20 bp, synthetic construct
  misc_feature 1..20: note = CRISPR gRNA sequence
  source 1..20: mol_type = other DNA
gaatcgatggtgataattag

SEQ ID NO: 16407 - DNA, 20 bp, synthetic construct
  misc_feature 1..20: note = CRISPR gRNA sequence
  source 1..20: mol_type = other DNA
ataattagaggttctacatc

SEQ ID NO: 16408 - DNA, 20 bp, synthetic construct
  misc_feature 1..20: note = CRISPR gRNA sequence
  source 1..20: mol_type = other DNA
aattagaggttctacatcta

SEQ ID NO: 16409 - DNA, 20 bp, synthetic construct
  misc_feature 1..20: note = CRISPR gRNA sequence
  source 1..20: mol_type = other DNA
tacatctagagcatccaaca

SEQ ID NO: 16410 - DNA, 20 bp, synthetic construct
  misc_feature 1..20: note = CRISPR gRNA sequence
  source 1..20: mol_type = other DNA
atctagagcatccaacacag

SEQ ID NO: 16411 - DNA, 20 bp, synthetic construct
  misc_feature 1..20: note = CRISPR gRNA sequence
  source 1..20: mol_type = other DNA
agagcatccaacacagtagc

SEQ ID NO: 16412 - DNA, 20 bp, synthetic construct
  misc_feature 1..20: note = CRISPR gRNA sequence
  source 1..20: mol_type = other DNA
ccaacacagtagctggtata

SEQ ID NO: 16413 - DNA, 20 bp, synthetic construct
  misc_feature 1..20: note = CRISPR gRNA sequence
  source 1..20: mol_type = other DNA
acacagtagctggtatacag

SEQ ID NO: 16414 - DNA, 20 bp, synthetic construct
  misc_feature 1..20: note = CRISPR gRNA sequence
  source 1..20: mol_type = other DNA
cacagtagctggtatacagt

SEQ ID NO: 16415 - DNA, 20 bp, synthetic construct
  misc_feature 1..20: note = CRISPR gRNA sequence
  source 1..20: mol_type = other DNA
gctggtatacagtaggcact

SEQ ID NO: 16416 - DNA, 20 bp, synthetic construct
  misc_feature 1..20: note = CRISPR gRNA sequence
  source 1..20: mol_type = other DNA
tacagtaggcactcagtaaa

SEQ ID NO: 16417 - DNA, 20 bp, synthetic construct
  misc_feature 1..20: note = CRISPR gRNA sequence
  source 1..20: mol_type = other DNA
agtaggcactcagtaaatag

SEQ ID NO: 16418 - DNA, 20 bp, synthetic construct
  misc_feature 1..20: note = CRISPR gRNA sequence
  source 1..20: mol_type = other DNA
taaatagtggtaactatata

SEQ ID NO: 16419 - DNA, 20 bp, synthetic construct
  misc_feature 1..20: note = CRISPR gRNA sequence
  source 1..20: mol_type = other DNA
aaatagtggtaactatataa

SEQ ID NO: 16420 - DNA, 20 bp, synthetic construct
  misc_feature 1..20: note = CRISPR gRNA sequence
  source 1..20: mol_type = other DNA
aatagtggtaactatataaa

SEQ ID NO: 16421 - DNA, 20 bp, synthetic construct
  misc_feature 1..20: note = CRISPR gRNA sequence
  source 1..20: mol_type = other DNA
atagtggtaactatataaag

SEQ ID NO: 16422 - DNA, 20 bp, synthetic construct
  misc_feature 1..20: note = CRISPR gRNA sequence
  source 1..20: mol_type = other DNA
taactatataaaggggtaca

SEQ ID NO: 16423 - DNA, 20 bp, synthetic construct
  misc_feature 1..20: note = CRISPR gRNA sequence
  source 1..20: mol_type = other DNA
atataaaggggtacatggct

SEQ ID NO: 16424 - DNA, 20 bp, synthetic construct
  misc_feature 1..20: note = CRISPR gRNA sequence
  source 1..20: mol_type = other DNA
ataaaggggtacatggctca

SEQ ID NO: 16425 - DNA, 20 bp, synthetic construct
  misc_feature 1..20: note = CRISPR gRNA sequence
  source 1..20: mol_type = other DNA
ggtacatggctcagagccct

SEQ ID NO: 16426 - DNA, 20 bp, synthetic construct
  misc_feature 1..20: note = CRISPR gRNA sequence
  source 1..20: mol_type = other DNA
ggctcagagcccttggaata

SEQ ID NO: 16427 - DNA, 20 bp, synthetic construct
  misc_feature 1..20: note = CRISPR gRNA sequence
  source 1..20: mol_type = other DNA
gctcagagcccttggaatat

SEQ ID NO: 16428 - DNA, 20 bp, synthetic construct
  misc_feature 1..20: note = CRISPR gRNA sequence
  source 1..20: mol_type = other DNA
aatataggcaccatgacatg

SEQ ID NO: 16429 - DNA, 20 bp, synthetic construct
  misc_feature 1..20: note = CRISPR gRNA sequence
  source 1..20: mol_type = other DNA
ggcaccatgacatgaagtcc

SEQ ID NO: 16430 - DNA, 20 bp, synthetic construct
  misc_feature 1..20: note = CRISPR gRNA sequence
  source 1..20: mol_type = other DNA
tgacatgaagtccgagaaaa

SEQ ID NO: 16431 - DNA, 20 bp, synthetic construct
  misc_feature 1..20: note = CRISPR gRNA sequence
  source 1..20: mol_type = other DNA
gacatgaagtccgagaaaaa

SEQ ID NO: 16432 - DNA, 20 bp, synthetic construct
  misc_feature 1..20: note = CRISPR gRNA sequence
  source 1..20: mol_type = other DNA
agtccgagaaaaaaggtgta

SEQ ID NO: 16433 - DNA, 20 bp, synthetic construct
  misc_feature 1..20: note = CRISPR gRNA sequence
  source 1..20: mol_type = other DNA
ccgagaaaaaaggtgtatgg

SEQ ID NO: 16434 - DNA, 20 bp, synthetic construct
  misc_feature 1..20: note = CRISPR gRNA sequence
  source 1..20: mol_type = other DNA
aaaaaaggtgtatggtggaa

SEQ ID NO: 16435 - DNA, 20 bp, synthetic construct
  misc_feature 1..20: note = CRISPR gRNA sequence
  source 1..20: mol_type = other DNA
aaaaaggtgtatggtggaat

SEQ ID NO: 16436 - DNA, 20 bp, synthetic construct
  misc_feature 1..20: note = CRISPR gRNA sequence
  source 1..20: mol_type = other DNA
aaaaggtgtatggtggaata

SEQ ID NO: 16437 - DNA, 20 bp, synthetic construct
  misc_feature 1..20: note = CRISPR gRNA sequence
  source 1..20: mol_type = other DNA
gtatggtggaatagggcaat

SEQ ID NO: 16438 - DNA, 20 bp, synthetic construct
  misc_feature 1..20: note = CRISPR gRNA sequence
  source 1..20: mol_type = other DNA
tatggtggaatagggcaatc

SEQ ID NO: 16439 - DNA, 20 bp, synthetic construct
  misc_feature 1..20: note = CRISPR gRNA sequence
  source 1..20: mol_type = other DNA
atggtggaatagggcaatca

SEQ ID NO: 16440 - DNA, 20 bp, synthetic construct
  misc_feature 1..20: note = CRISPR gRNA sequence
  source 1..20: mol_type = other DNA
gtggaatagggcaatcaggg

SEQ ID NO: 16441 - DNA, 20 bp, synthetic construct
  misc_feature 1..20: note = CRISPR gRNA sequence
  source 1..20: mol_type = other DNA
tggaatagggcaatcaggga

SEQ ID NO: 16442 - DNA, 20 bp, synthetic construct
  misc_feature 1..20: note = CRISPR gRNA sequence
  source 1..20: mol_type = other DNA
ggcaatcagggaaggcttcc

SEQ ID NO: 16443 - DNA, 20 bp, synthetic construct
  misc_feature 1..20: note = CRISPR gRNA sequence
  source 1..20: mol_type = other DNA
caatcagggaaggcttcctg

SEQ ID NO: 16444 - DNA, 20 bp, synthetic construct
  misc_feature 1..20: note = CRISPR gRNA sequence
  source 1..20: mol_type = other DNA
aatcagggaaggcttcctgg

SEQ ID NO: 16445 - DNA, 20 bp, synthetic construct
  misc_feature 1..20: note = CRISPR gRNA sequence
  source 1..20: mol_type = other DNA
cagggaaggcttcctggagg

SEQ ID NO: 16446 - DNA, 20 bp, synthetic construct
  misc_feature 1..20: note = CRISPR gRNA sequence
  source 1..20: mol_type = other DNA
agggaaggcttcctggagga

SEQ ID NO: 16447 - DNA, 20 bp, synthetic construct
  misc_feature 1..20: note = CRISPR gRNA sequence
  source 1..20: mol_type = other DNA
gggaaggcttcctggaggaa

SEQ ID NO: 16448 - DNA, 20 bp, synthetic construct
  misc_feature 1..20: note = CRISPR gRNA sequence
  source 1..20: mol_type = other DNA
cttcctggaggaagggatcc

SEQ ID NO: 16449 - DNA, 20 bp, synthetic construct
  misc_feature 1..20: note = CRISPR gRNA sequence
  source 1..20: mol_type = other DNA
ggaggaagggatcctggaac

SEQ ID NO: 16450 - DNA, 20 bp, synthetic construct
  misc_feature 1..20: note = CRISPR gRNA sequence
  source 1..20: mol_type = other DNA
gaggaagggatcctggaacc

SEQ ID NO: 16451 - DNA, 20 bp, synthetic construct
  misc_feature 1..20: note = CRISPR gRNA sequence
  source 1..20: mol_type = other DNA
atcctggaaccaggccttga

SEQ ID NO: 16452 - DNA, 20 bp, synthetic construct
  misc_feature 1..20: note = CRISPR gRNA sequence
  source 1..20: mol_type = other DNA
ggaaccaggccttgaaagat

SEQ ID NO: 16453 - DNA, 20 bp, synthetic construct
  misc_feature 1..20: note = CRISPR gRNA sequence
  source 1..20: mol_type = other DNA
gaaccaggccttgaaagatg

SEQ ID NO: 16454 - DNA, 20 bp, synthetic construct
  misc_feature 1..20: note = CRISPR gRNA sequence
  source 1..20: mol_type = other DNA
ccaggccttgaaagatgagg

SEQ ID NO: 16455 - DNA, 20 bp, synthetic construct
  misc_feature 1..20: note = CRISPR gRNA sequence
  source 1..20: mol_type = other DNA
aggccttgaaagatgaggca

SEQ ID NO: 16456 - DNA, 20 bp, synthetic construct
  misc_feature 1..20: note = CRISPR gRNA sequence
  source 1..20: mol_type = other DNA
ttgaaagatgaggcagagtc

SEQ ID NO: 16457 - DNA, 20 bp, synthetic construct
  misc_feature 1..20: note = CRISPR gRNA sequence
  source 1..20: mol_type = other DNA
tgaaagatgaggcagagtct

SEQ ID NO: 16458 - DNA, 20 bp, synthetic construct
  misc_feature 1..20: note = CRISPR gRNA sequence
  source 1..20: mol_type = other DNA
aaagatgaggcagagtctgg

SEQ ID NO: 16459 - DNA, 20 bp, synthetic construct
  misc_feature 1..20: note = CRISPR gRNA sequence
  source 1..20: mol_type = other DNA
gatgaggcagagtctgggag

SEQ ID NO: 16460 - DNA, 20 bp, synthetic construct
  misc_feature 1..20: note = CRISPR gRNA sequence
  source 1..20: mol_type = other DNA
atgaggcagagtctgggaga

SEQ ID NO: 16461 - DNA, 20 bp, synthetic construct
  misc_feature 1..20: note = CRISPR gRNA sequence
  source 1..20: mol_type = other DNA
gaggcagagtctgggagaag

SEQ ID NO: 16462 - DNA, 20 bp, synthetic construct
  misc_feature 1..20: note = CRISPR gRNA sequence
  source 1..20: mol_type = other DNA
agagtctgggagaaggagaa

SEQ ID NO: 16463 - DNA, 20 bp, synthetic construct
  misc_feature 1..20: note = CRISPR gRNA sequence
  source 1..20: mol_type = other DNA
tctgggagaaggagaacaga

SEQ ID NO: 16464 - DNA, 20 bp, synthetic construct
  misc_feature 1..20: note = CRISPR gRNA sequence
  source 1..20: mol_type = other DNA
aaggagaacagatagctttc

SEQ ID NO: 16465 - DNA, 20 bp, synthetic construct
  misc_feature 1..20: note = CRISPR gRNA sequence
  source 1..20: mol_type = other DNA
aggagaacagatagctttct

SEQ ID NO: 16466 - DNA, 20 bp, synthetic construct
  misc_feature 1..20: note = CRISPR gRNA sequence
  source 1..20: mol_type = other DNA
acagatagctttctgggtca

SEQ ID NO: 16467 - DNA, 20 bp, synthetic construct
  misc_feature 1..20: note = CRISPR gRNA sequence
  source 1..20: mol_type = other DNA
gatagctttctgggtcacag

SEQ ID NO: 16468 - DNA, 20 bp, synthetic construct
  misc_feature 1..20: note = CRISPR gRNA sequence
  source 1..20: mol_type = other DNA
agctttctgggtcacagtgg

SEQ ID NO: 16469 - DNA, 20 bp, synthetic construct
  misc_feature 1..20: note = CRISPR gRNA sequence
  source 1..20: mol_type = other DNA
ctttctgggtcacagtggca

SEQ ID NO: 16470 - DNA, 20 bp, synthetic construct
  misc_feature 1..20: note = CRISPR gRNA sequence
  source 1..20: mol_type = other DNA
ctgggtcacagtggcagagt

SEQ ID NO: 16471 - DNA, 20 bp, synthetic construct
  misc_feature 1..20: note = CRISPR gRNA sequence
  source 1..20: mol_type = other DNA
tgggtcacagtggcagagtg

SEQ ID NO: 16472 - DNA, 20 bp, synthetic construct
  misc_feature 1..20: note = CRISPR gRNA sequence
  source 1..20: mol_type = other DNA
gcagagtgaggaaacttgtt

SEQ ID NO: 16473 - DNA, 20 bp, synthetic construct
  misc_feature 1..20: note = CRISPR gRNA sequence
  source 1..20: mol_type = other DNA
agagtgaggaaacttgttca

SEQ ID NO: 16474 - DNA, 20 bp, synthetic construct
  misc_feature 1..20: note = CRISPR gRNA sequence
  source 1..20: mol_type = other DNA
aaacttgttcagagtatgtt

SEQ ID NO: 16475 - DNA, 20 bp, synthetic construct
  misc_feature 1..20: note = CRISPR gRNA sequence
  source 1..20: mol_type = other DNA
aacttgttcagagtatgttt

SEQ ID NO: 16476 - DNA, 20 bp, synthetic construct
  misc_feature 1..20: note = CRISPR gRNA sequence
  source 1..20: mol_type = other DNA
gagtatgtttaggaaaccct

SEQ ID NO: 16477 - DNA, 20 bp, synthetic construct
  misc_feature 1..20: note = CRISPR gRNA sequence
  source 1..20: mol_type = other DNA
gtatgtttaggaaaccctga

SEQ ID NO: 16478 - DNA, 20 bp, synthetic construct
  misc_feature 1..20: note = CRISPR gRNA sequence
  source 1..20: mol_type = other DNA
gtttaggaaaccctgagaga

SEQ ID NO: 16479 - DNA, 20 bp, synthetic construct
  misc_feature 1..20: note = CRISPR gRNA sequence
  source 1..20: mol_type = other DNA
tttaggaaaccctgagagat

SEQ ID NO: 16480 - DNA, 20 bp, synthetic construct
  misc_feature 1..20: note = CRISPR gRNA sequence
  source 1..20: mol_type = other DNA
aaaccctgagagataggtga

SEQ ID NO: 16481 - DNA, 20 bp, synthetic construct
  misc_feature 1..20: note = CRISPR gRNA sequence
  source 1..20: mol_type = other DNA
ccctgagagataggtgacgg

SEQ ID NO: 16482 - DNA, 20 bp, synthetic construct
  misc_feature 1..20: note = CRISPR gRNA sequence
  source 1..20: mol_type = other DNA
tgagagataggtgacggtgg

SEQ ID NO: 16483 - DNA, 20 bp, synthetic construct
  misc_feature 1..20: note = CRISPR gRNA sequence
  source 1..20: mol_type = other DNA
gagataggtgacggtggtag

SEQ ID NO: 16484 - DNA, 20 bp, synthetic construct
  misc_feature 1..20: note = CRISPR gRNA sequence
  source 1..20: mol_type = other DNA
cggtggtagaagtttcatgc

SEQ ID NO: 16485 - DNA, 20 bp, synthetic construct
  misc_feature 1..20: note = CRISPR gRNA sequence
  source 1..20: mol_type = other DNA
ggtggtagaagtttcatgct

SEQ ID NO: 16486 - DNA, 20 bp, synthetic construct
  misc_feature 1..20: note = CRISPR gRNA sequence
  source 1..20: mol_type = other DNA
gtggtagaagtttcatgctg

SEQ ID NO: 16487 - DNA, 20 bp, synthetic construct
  misc_feature 1..20: note = CRISPR gRNA sequence
  source 1..20: mol_type = other DNA
tagaagtttcatgctgggga

SEQ ID NO: 16488 - DNA, 20 bp, synthetic construct
  misc_feature 1..20: note = CRISPR gRNA sequence
  source 1..20: mol_type = other DNA
agtttcatgctggggaaagt

SEQ ID NO: 16489 - DNA, 20 bp, synthetic construct
  misc_feature 1..20: note = CRISPR gRNA sequence
  source 1..20: mol_type = other DNA
gtttcatgctggggaaagtt

SEQ ID NO: 16490 - DNA, 20 bp, synthetic construct
  misc_feature 1..20: note = CRISPR gRNA sequence
  source 1..20: mol_type = other DNA
aagttaggacttgattttat

SEQ ID NO: 16491 - DNA, 20 bp, synthetic construct
  misc_feature 1..20: note = CRISPR gRNA sequence
  source 1..20: mol_type = other DNA
ggacttgattttataagcaa

SEQ ID NO: 16492 - DNA, 20 bp, synthetic construct
  misc_feature 1..20: note = CRISPR gRNA sequence
  source 1..20: mol_type = other DNA
gacttgattttataagcaat

SEQ ID NO: 16493 - DNA, 20 bp, synthetic construct
  misc_feature 1..20: note = CRISPR gRNA sequence
  source 1..20: mol_type = other DNA
acttgattttataagcaatg

SEQ ID NO: 16494 - DNA, 20 bp, synthetic construct
  misc_feature 1..20: note = CRISPR gRNA sequence
  source 1..20: mol_type = other DNA
ttgattttataagcaatggg

SEQ ID NO: 16495 - DNA, 20 bp, synthetic construct
  misc_feature 1..20: note = CRISPR gRNA sequence
  source 1..20: mol_type = other DNA
ttataagcaatggggagcca

SEQ ID NO: 16496 - DNA, 20 bp, synthetic construct
  misc_feature 1..20: note = CRISPR gRNA sequence
  source 1..20: mol_type = other DNA
taagcaatggggagccatag

SEQ ID NO: 16497 - DNA, 20 bp, synthetic construct
  misc_feature 1..20: note = CRISPR gRNA sequence
  source 1..20: mol_type = other DNA
aagcaatggggagccataga

SEQ ID NO: 16498 - DNA, 20 bp, synthetic construct
  misc_feature 1..20: note = CRISPR gRNA sequence
  source 1..20: mol_type = other DNA
gggagccatagaaggcttct

SEQ ID NO: 16499 - DNA, 20 bp, synthetic construct
  misc_feature 1..20: note = CRISPR gRNA sequence
  source 1..20: mol_type = other DNA
ccatagaaggcttctgagct

SEQ ID NO: 16500 - DNA, 20 bp, synthetic construct
  misc_feature 1..20: note = CRISPR gRNA sequence
  source 1..20: mol_type = other DNA
catagaaggcttctgagctg

SEQ ID NO: 16501 - DNA, 20 bp, synthetic construct
  misc_feature 1..20: note = CRISPR gRNA sequence
  source 1..20: mol_type = other DNA
aaggcttctgagctgaggaa

SEQ ID NO: 16502 - DNA, 20 bp, synthetic construct
  misc_feature 1..20: note = CRISPR gRNA sequence
  source 1..20: mol_type = other DNA
tgagctgaggaatggaatga

SEQ ID NO: 16503 - DNA, 20 bp, synthetic construct
  misc_feature 1..20: note = CRISPR gRNA sequence
  source 1..20: mol_type = other DNA
atggaatgatggccataatg

SEQ ID NO: 16504 - DNA, 20 bp, synthetic construct
  misc_feature 1..20: note = CRISPR gRNA sequence
  source 1..20: mol_type = other DNA
tggaatgatggccataatga

SEQ ID NO: 16505 - DNA, 20 bp, synthetic construct
  misc_feature 1..20: note = CRISPR gRNA sequence
  source 1..20: mol_type = other DNA
taatgaaggtgatgaaaatg

SEQ ID NO: 16506 - DNA, 20 bp, synthetic construct
  misc_feature 1..20: note = CRISPR gRNA sequence
  source 1..20: mol_type = other DNA
aatgaagatgataataatga

SEQ ID NO: 16507 - DNA, 20 bp, synthetic construct
  misc_feature 1..20: note = CRISPR gRNA sequence
  source 1..20: mol_type = other DNA
gatggtgataataatgataa

SEQ ID NO: 16508 - DNA, 20 bp, synthetic construct
  misc_feature 1..20: note = CRISPR gRNA sequence
  source 1..20: mol_type = other DNA
ggtgataataatgataacgg

SEQ ID NO: 16509 - DNA, 20 bp, synthetic construct
  misc_feature 1..20: note = CRISPR gRNA sequence
  source 1..20: mol_type = other DNA
aataatgataacggtggttg

SEQ ID NO: 16510 - DNA, 20 bp, synthetic construct
  misc_feature 1..20: note = CRISPR gRNA sequence
  source 1..20: mol_type = other DNA
ataatgataacggtggttgt

SEQ ID NO: 16511 - DNA, 20 bp, synthetic construct
  misc_feature 1..20: note = CRISPR gRNA sequence
  source 1..20: mol_type = other DNA
taatgataacggtggttgtg

SEQ ID NO: 16512 - DNA, 20 bp, synthetic construct
  misc_feature 1..20: note = CRISPR gRNA sequence
  source 1..20: mol_type = other DNA
tgataacggtggttgtgggg

SEQ ID NO: 16513 - DNA, 20 bp, synthetic construct
  misc_feature 1..20: note = CRISPR gRNA sequence
  source 1..20: mol_type = other DNA
tttacacattgtaacttatt

SEQ ID NO: 16514 - DNA, 20 bp, synthetic construct
  misc_feature 1..20: note = CRISPR gRNA sequence
  source 1..20: mol_type = other DNA
gtcttacaaccatcccgtga

SEQ ID NO: 16515 - DNA, 20 bp, synthetic construct
  misc_feature 1..20: note = CRISPR gRNA sequence
  source 1..20: mol_type = other DNA
ttacaaccatcccgtgatgg

SEQ ID NO: 16516 - DNA, 20 bp, synthetic construct
  misc_feature 1..20: note = CRISPR gRNA sequence
  source 1..20: mol_type = other DNA
tacaaccatcccgtgatggt

SEQ ID NO: 16517 - DNA, 20 bp, synthetic construct
  misc_feature 1..20: note = CRISPR gRNA sequence
  source 1..20: mol_type = other DNA
ttatctccattttacacatt

SEQ ID NO: 16518 - DNA, 20 bp, synthetic construct
  misc_feature 1..20: note = CRISPR gRNA sequence
  source 1..20: mol_type = other DNA
tctccattttacacatttag

SEQ ID NO: 16519 - DNA, 20 bp, synthetic construct
  misc_feature 1..20: note = CRISPR gRNA sequence
  source 1..20: mol_type = other DNA
attttacacatttagaagct

SEQ ID NO: 16520 - DNA, 20 bp, synthetic construct
  misc_feature 1..20: note = CRISPR gRNA sequence
  source 1..20: mol_type = other DNA
ttttacacatttagaagcta

SEQ ID NO: 16521 - DNA, 20 bp, synthetic construct
  misc_feature 1..20: note = CRISPR gRNA sequence
  source 1..20: mol_type = other DNA
tagaagctaaggtcatattt

SEQ ID NO: 16522 - DNA, 20 bp, synthetic construct
  misc_feature 1..20: note = CRISPR gRNA sequence
  source 1..20: mol_type = other DNA
agaagctaaggtcatatttc

SEQ ID NO: 16523 - DNA, 20 bp, synthetic construct
  misc_feature 1..20: note = CRISPR gRNA sequence
  source 1..20: mol_type = other DNA
catatttcaggatgctgcaa

SEQ ID NO: 16524 - DNA, 20 bp, synthetic construct
  misc_feature 1..20: note = CRISPR gRNA sequence
  source 1..20: mol_type = other DNA
gctgcaaaagaatacttgcc

SEQ ID NO: 16525 - DNA, 20 bp, synthetic construct
  misc_feature 1..20: note = CRISPR gRNA sequence
  source 1..20: mol_type = other DNA
ctgcaaaagaatacttgccc

SEQ ID NO: 16526 - DNA, 20 bp, synthetic construct
  misc_feature 1..20: note = CRISPR gRNA sequence
  source 1..20: mol_type = other DNA
aaagaatacttgcccaggcc

SEQ ID NO: 16527 - DNA, 20 bp, synthetic construct
  misc_feature 1..20: note = CRISPR gRNA sequence
  source 1..20: mol_type = other DNA
aagaatacttgcccaggcct

SEQ ID NO: 16528 - DNA, 20 bp, synthetic construct
  misc_feature 1..20: note = CRISPR gRNA sequence
  source 1..20: mol_type = other DNA
caggcctgggcttcaccttc

SEQ ID NO: 16529 - DNA, 20 bp, synthetic construct
  misc_feature 1..20: note = CRISPR gRNA sequence
  source 1..20: mol_type = other DNA
gcctgggcttcaccttccag

SEQ ID NO: 16530 - DNA, 20 bp, synthetic construct
  misc_feature 1..20: note = CRISPR gRNA sequence
  source 1..20: mol_type = other DNA
tgggcttcaccttccagaag

SEQ ID NO: 16531 - DNA, 20 bp, synthetic construct
  misc_feature 1..20: note = CRISPR gRNA sequence
  source 1..20: mol_type = other DNA
ggcttcaccttccagaagca

SEQ ID NO: 16532 - DNA, 20 bp, synthetic construct
  misc_feature 1..20: note = CRISPR gRNA sequence
  source 1..20: mol_type = other DNA
cttcaccttccagaagcaga

SEQ ID NO: 16533 - DNA, 20 bp, synthetic construct
  misc_feature 1..20: note = CRISPR gRNA sequence
  source 1..20: mol_type = other DNA
agaagcagagagaaaaccca

SEQ ID NO: 16534 - DNA, 20 bp, synthetic construct
  misc_feature 1..20: note = CRISPR gRNA sequence
  source 1..20: mol_type = other DNA
gagagaaaacccacagactt

SEQ ID NO: 16535 - DNA, 20 bp, synthetic construct
  misc_feature 1..20: note = CRISPR gRNA sequence
  source 1..20: mol_type = other DNA
agagaaaacccacagacttg

SEQ ID NO: 16536 - DNA, 20 bp, synthetic construct
  misc_feature 1..20: note = CRISPR gRNA sequence
  source 1..20: mol_type = other DNA
agaaaacccacagacttgag

SEQ ID NO: 16537 - DNA, 20 bp, synthetic construct
  misc_feature 1..20: note = CRISPR gRNA sequence
  source 1..20: mol_type = other DNA
aaacccacagacttgaggag

SEQ ID NO: 16538 - DNA, 20 bp, synthetic construct
  misc_feature 1..20: note = CRISPR gRNA sequence
  source 1..20: mol_type = other DNA
acagacttgaggagcagact

SEQ ID NO: 16539 - DNA, 20 bp, synthetic construct
  misc_feature 1..20: note = CRISPR gRNA sequence
  source 1..20: mol_type = other DNA
cagacttgaggagcagactt

SEQ ID NO: 16540 - DNA, 20 bp, synthetic construct
  misc_feature 1..20: note = CRISPR gRNA sequence
  source 1..20: mol_type = other DNA
ttgaggagcagacttgggtg

SEQ ID NO: 16541 - DNA, 20 bp, synthetic construct
  misc_feature 1..20: note = CRISPR gRNA sequence
  source 1..20: mol_type = other DNA
tataaatgtaatcccctatg

SEQ ID NO: 16542 - DNA, 20 bp, synthetic construct
  misc_feature 1..20: note = CRISPR gRNA sequence
  source 1..20: mol_type = other DNA
aaatgtaatcccctatgtgg

SEQ ID NO: 16543 - DNA, 20 bp, synthetic construct
  misc_feature 1..20: note = CRISPR gRNA sequence
  source 1..20: mol_type = other DNA
atcccctatgtggcagtatt

SEQ ID NO: 16544 - DNA, 20 bp, synthetic construct
  misc_feature 1..20: note = CRISPR gRNA sequence
  source 1..20: mol_type = other DNA
cccctatgtggcagtattga

SEQ ID NO: 16545 - DNA, 20 bp, synthetic construct
  misc_feature 1..20: note = CRISPR gRNA sequence
  source 1..20: mol_type = other DNA
ccctatgtggcagtattgag

SEQ ID NO: 16546 - DNA, 20 bp, synthetic construct
  misc_feature 1..20: note = CRISPR gRNA sequence
  source 1..20: mol_type = other DNA
tatgtggcagtattgagagg

SEQ ID NO: 16547 - DNA, 20 bp, synthetic construct
  misc_feature 1..20: note = CRISPR gRNA sequence
  source 1..20: mol_type = other DNA
atgtggcagtattgagaggt

SEQ ID NO: 16548 - DNA, 20 bp, synthetic construct
  misc_feature 1..20: note = CRISPR gRNA sequence
  source 1..20: mol_type = other DNA
tgtggcagtattgagaggtg

SEQ ID NO: 16549 - DNA, 20 bp, synthetic construct
  misc_feature 1..20: note = CRISPR gRNA sequence
  source 1..20: mol_type = other DNA
tattgagaggtggggccttt

SEQ ID NO: 16550 - DNA, 20 bp, synthetic construct
  misc_feature 1..20: note = CRISPR gRNA sequence
  source 1..20: mol_type = other DNA
ttgagaggtggggcctttaa

SEQ ID NO: 16551 - DNA, 20 bp, synthetic construct
  misc_feature 1..20: note = CRISPR gRNA sequence
  source 1..20: mol_type = other DNA
tgagaggtggggcctttaag

SEQ ID NO: 16552 - DNA, 20 bp, synthetic construct
  misc_feature 1..20: note = CRISPR gRNA sequence
  source 1..20: mol_type = other DNA
tggggcctttaagaggtgac

SEQ ID NO: 16553 - DNA, 20 bp, synthetic construct
  misc_feature 1..20: note = CRISPR gRNA sequence
  source 1..20: mol_type = other DNA
ggggcctttaagaggtgact

SEQ ID NO: 16554 - DNA, 20 bp, synthetic construct
  misc_feature 1..20: note = CRISPR gRNA sequence
  source 1..20: mol_type = other DNA
gggcctttaagaggtgactg

SEQ ID NO: 16555 - DNA, 20 bp, synthetic construct
  misc_feature 1..20: note = CRISPR gRNA sequence
  source 1..20: mol_type = other DNA
tggggcttttccttgatgaa

SEQ ID NO: 16556 - DNA, 20 bp, synthetic construct
  misc_feature 1..20: note = CRISPR gRNA sequence
  source 1..20: mol_type = other DNA
ggggcttttccttgatgaat

SEQ ID NO: 16557 - DNA, 20 bp, synthetic construct
  misc_feature 1..20: note = CRISPR gRNA sequence
  source 1..20: mol_type = other DNA
tgaatgggttaatccgttca

SEQ ID NO: 16558 - DNA, 20 bp, synthetic construct
  misc_feature 1..20: note = CRISPR gRNA sequence
  source 1..20: mol_type = other DNA
gggttaatccgttcatggat

SEQ ID NO: 16559 - DNA, 20 bp, synthetic construct
  misc_feature 1..20: note = CRISPR gRNA sequence
  source 1..20: mol_type = other DNA
ttaatccgttcatggattag

SEQ ID NO: 16560 - DNA, 20 bp, synthetic construct
  misc_feature 1..20: note = CRISPR gRNA sequence
  source 1..20: mol_type = other DNA
ttcatggattagtggataaa

SEQ ID NO: 16561 - DNA, 20 bp, synthetic construct
  misc_feature 1..20: note = CRISPR gRNA sequence
  source 1..20: mol_type = other DNA
tcatggattagtggataaac

SEQ ID NO: 16562 - DNA, 20 bp, synthetic construct
  misc_feature 1..20: note = CRISPR gRNA sequence
  source 1..20: mol_type = other DNA
tagtggataaacaggttaat

SEQ ID NO: 16563 - DNA, 20 bp, synthetic construct
  misc_feature 1..20: note = CRISPR gRNA sequence
  source 1..20: mol_type = other DNA
taaacaggttaataagttaa

SEQ ID NO: 16564 - DNA, 20 bp, synthetic construct
  misc_feature 1..20: note = CRISPR gRNA sequence
  source 1..20: mol_type = other DNA
aaacaggttaataagttaat

SEQ ID NO: 16565 - DNA, 20 bp, synthetic construct
  misc_feature 1..20: note = CRISPR gRNA sequence
  source 1..20: mol_type = other DNA
aataagttaatgggttgtcg

SEQ ID NO: 16566 - DNA, 20 bp, synthetic construct
  misc_feature 1..20: note = CRISPR gRNA sequence
  source 1..20: mol_type = other DNA
ataagttaatgggttgtcgt

SEQ ID NO: 16567 - DNA, 20 bp, synthetic construct
  misc_feature 1..20: note = CRISPR gRNA sequence
  source 1..20: mol_type = other DNA
aagttaatgggttgtcgtgg

SEQ ID NO: 16568 - DNA, 20 bp, synthetic construct
  misc_feature 1..20: note = CRISPR gRNA sequence
  source 1..20: mol_type = other DNA
taatgggttgtcgtgggagt

SEQ ID NO: 16569 - DNA, 20 bp, synthetic construct
  misc_feature 1..20: note = CRISPR gRNA sequence
  source 1..20: mol_type = other DNA
ggttgtcgtgggagtaagac

SEQ ID NO: 16570 - DNA, 20 bp, synthetic construct
  misc_feature 1..20: note = CRISPR gRNA sequence
  source 1..20: mol_type = other DNA
tgtcgtgggagtaagactag

SEQ ID NO: 16571 - DNA, 20 bp, synthetic construct
  misc_feature 1..20: note = CRISPR gRNA sequence
  source 1..20: mol_type = other DNA
agtaagactagtggttttat

SEQ ID NO: 16572 - DNA, 20 bp, synthetic construct
  misc_feature 1..20: note = CRISPR gRNA sequence
  source 1..20: mol_type = other DNA
aagactagtggttttatgag

SEQ ID NO: 16573 - DNA, 20 bp, synthetic construct
  misc_feature 1..20: note = CRISPR gRNA sequence
  source 1..20: mol_type = other DNA
gactagtggttttatgagaa

SEQ ID NO: 16574 - DNA, 20 bp, synthetic construct
  misc_feature 1..20: note = CRISPR gRNA sequence
  source 1..20: mol_type = other DNA
actagtggttttatgagaag

SEQ ID NO: 16575 - DNA, 20 bp, synthetic construct
  misc_feature 1..20: note = CRISPR gRNA sequence
  source 1..20: mol_type = other DNA
agtggttttatgagaagagg

SEQ ID NO: 16576 - DNA, 20 bp, synthetic construct
  misc_feature 1..20: note = CRISPR gRNA sequence
  source 1..20: mol_type = other DNA
tggttttatgagaagaggaa

SEQ ID NO: 16577 - DNA, 20 bp, synthetic construct
  misc_feature 1..20: note = CRISPR gRNA sequence
  source 1..20: mol_type = other DNA
gttttatgagaagaggaaga

SEQ ID NO: 16578 - DNA, 20 bp, synthetic construct
  misc_feature 1..20: note = CRISPR gRNA sequence
  source 1..20: mol_type = other DNA
cgtgatgccccacactgcct

SEQ ID NO: 16579 - DNA, 20 bp, synthetic construct
  misc_feature 1..20: note = CRISPR gRNA sequence
  source 1..20: mol_type = other DNA
gtgatgccccacactgcctt

SEQ ID NO: 16580 - DNA, 20 bp, synthetic construct
  misc_feature 1..20: note = CRISPR gRNA sequence
  source 1..20: mol_type = other DNA
cacactgccttgggactctg

SEQ ID NO: 16581 - DNA, 20 bp, synthetic construct
  misc_feature 1..20: note = CRISPR gRNA sequence
  source 1..20: mol_type = other DNA
cactgccttgggactctgca

SEQ ID NO: 16582 - DNA, 20 bp, synthetic construct
  misc_feature 1..20: note = CRISPR gRNA sequence
  source 1..20: mol_type = other DNA
ctgccttgggactctgcaga

SEQ ID NO: 16583 - DNA, 20 bp, synthetic construct
  misc_feature 1..20: note = CRISPR gRNA sequence
  source 1..20: mol_type = other DNA
actctgcagagagtcctcac

SEQ ID NO: 16584 - DNA, 20 bp, synthetic construct
  misc_feature 1..20: note = CRISPR gRNA sequence
  source 1..20: mol_type = other DNA
tgcagagagtcctcaccagt

SEQ ID NO: 16585 - DNA, 20 bp, synthetic construct
  misc_feature 1..20: note = CRISPR gRNA sequence
  source 1..20: mol_type = other DNA
agagagtcctcaccagtaag

SEQ ID NO: 16586 - DNA, 20 bp, synthetic construct
  misc_feature 1..20: note = CRISPR gRNA sequence
  source 1..20: mol_type = other DNA
gagagtcctcaccagtaaga

SEQ ID NO: 16587 - DNA, 20 bp, synthetic construct
  misc_feature 1..20: note = CRISPR gRNA sequence
  source 1..20: mol_type = other DNA
accagtaagaaggccctcac

SEQ ID NO: 16588 - DNA, 20 bp, synthetic construct
  misc_feature 1..20: note = CRISPR gRNA sequence
  source 1..20: mol_type = other DNA
aagaaggccctcaccagatg

SEQ ID NO: 16589 - DNA, 20 bp, synthetic construct
  misc_feature 1..20: note = CRISPR gRNA sequence
  source 1..20: mol_type = other DNA
ccagatgcagcccctaacct

SEQ ID NO: 16590 - DNA, 20 bp, synthetic construct
  misc_feature 1..20: note = CRISPR gRNA sequence
  source 1..20: mol_type = other DNA
gcccctaaccttggacttct

SEQ ID NO: 16591 - DNA, 20 bp, synthetic construct
  misc_feature 1..20: note = CRISPR gRNA sequence
  source 1..20: mol_type = other DNA
ttctcagcctccataactgt

SEQ ID NO: 16592 - DNA, 20 bp, synthetic construct
  misc_feature 1..20: note = CRISPR gRNA sequence
  source 1..20: mol_type = other DNA
ttttttctttataaattact

SEQ ID NO: 16593 - DNA, 20 bp, synthetic construct
  misc_feature 1..20: note = CRISPR gRNA sequence
  source 1..20: mol_type = other DNA
ctttataaattactcagtgt

SEQ ID NO: 16594 - DNA, 20 bp, synthetic construct
  misc_feature 1..20: note = CRISPR gRNA sequence
  source 1..20: mol_type = other DNA
tttataaattactcagtgtc

SEQ ID NO: 16595 - DNA, 20 bp, synthetic construct
  misc_feature 1..20: note = CRISPR gRNA sequence
  source 1..20: mol_type = other DNA
agtgtcaggtatgttgtttt

SEQ ID NO: 16596 - DNA, 20 bp, synthetic construct
  misc_feature 1..20: note = CRISPR gRNA sequence
  source 1..20: mol_type = other DNA
ttgttttaagcaacaaaaaa

SEQ ID NO: 16597 - DNA, 20 bp, synthetic construct
  misc_feature 1..20: note = CRISPR gRNA sequence
  source 1..20: mol_type = other DNA
cactgcctcacctatttgct

SEQ ID NO: 16598 - DNA, 20 bp, synthetic construct
  misc_feature 1..20: note = CRISPR gRNA sequence
  source 1..20: mol_type = other DNA
gcctcacctatttgcttaga

SEQ ID NO: 16599 - DNA, 20 bp, synthetic construct
  misc_feature 1..20: note = CRISPR gRNA sequence
  source 1..20: mol_type = other DNA
tagacagctttcgctgcctg

SEQ ID NO: 16600 - DNA, 20 bp, synthetic construct
  misc_feature 1..20: note = CRISPR gRNA sequence
  source 1..20: mol_type = other DNA
gacagctttcgctgcctgtg

SEQ ID NO: 16601 - DNA, 20 bp, synthetic construct
  misc_feature 1..20: note = CRISPR gRNA sequence
  source 1..20: mol_type = other DNA
ctgcctgtggagatgccact

SEQ ID NO: 16602 - DNA, 20 bp, synthetic construct
  misc_feature 1..20: note = CRISPR gRNA sequence
  source 1..20: mol_type = other DNA
tgcctgtggagatgccacta

SEQ ID NO: 16603 - DNA, 20 bp, synthetic construct
  misc_feature 1..20: note = CRISPR gRNA sequence
  source 1..20: mol_type = other DNA
gcctgtggagatgccactaa

SEQ ID NO: 16604 - DNA, 20 bp, synthetic construct
  misc_feature 1..20: note = CRISPR gRNA sequence
  source 1..20: mol_type = other DNA
cctgtggagatgccactaag

SEQ ID NO: 16605 - DNA, 20 bp, synthetic construct
  misc_feature 1..20: note = CRISPR gRNA sequence
  source 1..20: mol_type = other DNA
ctgtggagatgccactaagg

SEQ ID NO: 16606 - DNA, 20 bp, synthetic construct
  misc_feature 1..20: note = CRISPR gRNA sequence
  source 1..20: mol_type = other DNA
tgtggagatgccactaaggg

SEQ ID NO: 16607 - DNA, 20 bp, synthetic construct
  misc_feature 1..20: note = CRISPR gRNA sequence
  source 1..20: mol_type = other DNA
tggagatgccactaaggggg

SEQ ID NO: 16608 - DNA, 20 bp, synthetic construct
  misc_feature 1..20: note = CRISPR gRNA sequence
  source 1..20: mol_type = other DNA
aaatccttaatgactgcctc

SEQ ID NO: 16609 - DNA, 20 bp, synthetic construct
  misc_feature 1..20: note = CRISPR gRNA sequence
  source 1..20: mol_type = other DNA
taatgactgcctccagttgt

SEQ ID NO: 16610 - DNA, 20 bp, synthetic construct
  misc_feature 1..20: note = CRISPR gRNA sequence
  source 1..20: mol_type = other DNA
aatgactgcctccagttgtg

SEQ ID NO: 16611 - DNA, 20 bp, synthetic construct
  misc_feature 1..20: note = CRISPR gRNA sequence
  source 1..20: mol_type = other DNA
tgaggaaatgtgaatgtcct

SEQ ID NO: 16612 - DNA, 20 bp, synthetic construct
  misc_feature 1..20: note = CRISPR gRNA sequence
  source 1..20: mol_type = other DNA
gcttcccccatgtaaatccc

SEQ ID NO: 16613 - DNA, 20 bp, synthetic construct
  misc_feature 1..20: note = CRISPR gRNA sequence
  source 1..20: mol_type = other DNA
cttcccccatgtaaatcccc

SEQ ID NO: 16614 - DNA, 20 bp, synthetic construct
  misc_feature 1..20: note = CRISPR gRNA sequence
  source 1..20: mol_type = other DNA
cccccatgtaaatccccagg

SEQ ID NO: 16615 - DNA, 20 bp, synthetic construct
  misc_feature 1..20: note = CRISPR gRNA sequence
  source 1..20: mol_type = other DNA
ccccatgtaaatccccagga

SEQ ID NO: 16616 - DNA, 20 bp, synthetic construct
  misc_feature 1..20: note = CRISPR gRNA sequence
  source 1..20: mol_type = other DNA
cccatgtaaatccccaggaa

SEQ ID NO: 16617 - DNA, 20 bp, synthetic construct
  misc_feature 1..20: note = CRISPR gRNA sequence
  source 1..20: mol_type = other DNA
atgtaaatccccaggaaggg

SEQ ID NO: 16618 - DNA, 20 bp, synthetic construct
  misc_feature 1..20: note = CRISPR gRNA sequence
  source 1..20: mol_type = other DNA
tgtaaatccccaggaaggga

SEQ ID NO: 16619 - DNA, 20 bp, synthetic construct
  misc_feature 1..20: note = CRISPR gRNA sequence
  source 1..20: mol_type = other DNA
aaatccccaggaagggaagg

SEQ ID NO: 16620 - DNA, 20 bp, synthetic construct
  misc_feature 1..20: note = CRISPR gRNA sequence
  source 1..20: mol_type = other DNA
tccccaggaagggaaggaag

SEQ ID NO: 16621 - DNA, 20 bp, synthetic construct
  misc_feature 1..20: note = CRISPR gRNA sequence
  source 1..20: mol_type = other DNA
aggaagggaaggaagcagtc

SEQ ID NO: 16622 - DNA, 20 bp, synthetic construct
  misc_feature 1..20: note = CRISPR gRNA sequence
  source 1..20: mol_type = other DNA
gaaggaagcagtcaagctct

SEQ ID NO: 16623 - DNA, 20 bp, synthetic construct
  misc_feature 1..20: note = CRISPR gRNA sequence
  source 1..20: mol_type = other DNA
tctgaaacatgaacaattac

SEQ ID NO: 16624 - DNA, 20 bp, synthetic construct
  misc_feature 1..20: note = CRISPR gRNA sequence
  source 1..20: mol_type = other DNA
gtcccctccattttcttcct

SEQ ID NO: 16625 - DNA, 20 bp, synthetic construct
  misc_feature 1..20: note = CRISPR gRNA sequence
  source 1..20: mol_type = other DNA
attttcaatacactgtgctc

SEQ ID NO: 16626 - DNA, 20 bp, synthetic construct
  misc_feature 1..20: note = CRISPR gRNA sequence
  source 1..20: mol_type = other DNA
ttttcaatacactgtgctct

SEQ ID NO: 16627 - DNA, 20 bp, synthetic construct
  misc_feature 1..20: note = CRISPR gRNA sequence
  source 1..20: mol_type = other DNA
tttcaatacactgtgctctg

SEQ ID NO: 16628 - DNA, 20 bp, synthetic construct
  misc_feature 1..20: note = CRISPR gRNA sequence
  source 1..20: mol_type = other DNA
actgtgctctggggaaaaat

SEQ ID NO: 16629 - DNA, 20 bp, synthetic construct
  misc_feature 1..20: note = CRISPR gRNA sequence
  source 1..20: mol_type = other DNA
ggggaaaaattggccacatt

SEQ ID NO: 16630 - DNA, 20 bp, synthetic construct
  misc_feature 1..20: note = CRISPR gRNA sequence
  source 1..20: mol_type = other DNA
aaattggccacatttggatc

SEQ ID NO: 16631 - DNA, 20 bp, synthetic construct
  misc_feature 1..20: note = CRISPR gRNA sequence
  source 1..20: mol_type = other DNA
ggccacatttggatcaagca

SEQ ID NO: 16632 - DNA, 20 bp, synthetic construct
  misc_feature 1..20: note = CRISPR gRNA sequence
  source 1..20: mol_type = other DNA
ctgctgaatgctgctgttcc

SEQ ID NO: 16633 - DNA, 20 bp, synthetic construct
  misc_feature 1..20: note = CRISPR gRNA sequence
  source 1..20: mol_type = other DNA
tgctgaatgctgctgttcct

SEQ ID NO: 16634 - DNA, 20 bp, synthetic construct
  misc_feature 1..20: note = CRISPR gRNA sequence
  source 1..20: mol_type = other DNA
gaatgctgctgttcctgggt

SEQ ID NO: 16635 - DNA, 20 bp, synthetic construct
  misc_feature 1..20: note = CRISPR gRNA sequence
  source 1..20: mol_type = other DNA
tgctgctgttcctgggttgg

SEQ ID NO: 16636 - DNA, 20 bp, synthetic construct
  misc_feature 1..20: note = CRISPR gRNA sequence
  source 1..20: mol_type = other DNA
gctgctgttcctgggttggc

SEQ ID NO: 16637 - DNA, 20 bp, synthetic construct
  misc_feature 1..20: note = CRISPR gRNA sequence
  source 1..20: mol_type = other DNA
gctgttcctgggttggcagg

SEQ ID NO: 16638 - DNA, 20 bp, synthetic construct
  misc_feature 1..20: note = CRISPR gRNA sequence
  source 1..20: mol_type = other DNA
gttcctgggttggcaggaag

SEQ ID NO: 16639 - DNA, 20 bp, synthetic construct
  misc_feature 1..20: note = CRISPR gRNA sequence
  source 1..20: mol_type = other DNA
ttggcaggaagaagaccact

SEQ ID NO: 16640 - DNA, 20 bp, synthetic construct
  misc_feature 1..20: note = CRISPR gRNA sequence
  source 1..20: mol_type = other DNA
gcaggaagaagaccactaag

SEQ ID NO: 16641 - DNA, 20 bp, synthetic construct
  misc_feature 1..20: note = CRISPR gRNA sequence
  source 1..20: mol_type = other DNA
aggaagaagaccactaagaa

SEQ ID NO: 16642 - DNA, 20 bp, synthetic construct
  misc_feature 1..20: note = CRISPR gRNA sequence
  source 1..20: mol_type = other DNA
gaccactaagaagagttttg

SEQ ID NO: 16643 - DNA, 20 bp, synthetic construct
  misc_feature 1..20: note = CRISPR gRNA sequence
  source 1..20: mol_type = other DNA
accactaagaagagttttgc

SEQ ID NO: 16644 - DNA, 20 bp, synthetic construct
  misc_feature 1..20: note = CRISPR gRNA sequence
  source 1..20: mol_type = other DNA
tgcaggttgttcactgcaca

SEQ ID NO: 16645 - DNA, 20 bp, synthetic construct
  misc_feature 1..20: note = CRISPR gRNA sequence
  source 1..20: mol_type = other DNA
gcaggttgttcactgcacac

SEQ ID NO: 16646 - DNA, 20 bp, synthetic construct
  misc_feature 1..20: note = CRISPR gRNA sequence
  source 1..20: mol_type = other DNA
ttcactgcacacaggtgccc

SEQ ID NO: 16647 - DNA, 20 bp, synthetic construct
  misc_feature 1..20: note = CRISPR gRNA sequence
  source 1..20: mol_type = other DNA
acacaggtgcccaagccaac

SEQ ID NO: 16648 - DNA, 20 bp, synthetic construct
  misc_feature 1..20: note = CRISPR gRNA sequence
  source 1..20: mol_type = other DNA
cacaggtgcccaagccaaca

SEQ ID NO: 16649 - DNA, 20 bp, synthetic construct
  misc_feature 1..20: note = CRISPR gRNA sequence
  source 1..20: mol_type = other DNA
gcccaagccaacaaggaaaa

SEQ ID NO: 16650 - DNA, 20 bp, synthetic construct
  misc_feature 1..20: note = CRISPR gRNA sequence
  source 1..20: mol_type = other DNA
cccaagccaacaaggaaaat

SEQ ID NO: 16651 - DNA, 20 bp, synthetic construct
  misc_feature 1..20: note = CRISPR gRNA sequence
  source 1..20: mol_type = other DNA
ccaagccaacaaggaaaatg

SEQ ID NO: 16652 - DNA, 20 bp, synthetic construct
  misc_feature 1..20: note = CRISPR gRNA sequence
  source 1..20: mol_type = other DNA
caagccaacaaggaaaatgg

SEQ ID NO: 16653 - DNA, 20 bp, synthetic construct
  misc_feature 1..20: note = CRISPR gRNA sequence
  source 1..20: mol_type = other DNA
gccaacaaggaaaatggggg

SEQ ID NO: 16654 - DNA, 20 bp, synthetic construct
  misc_feature 1..20: note = CRISPR gRNA sequence
  source 1..20: mol_type = other DNA
ccaacaaggaaaatgggggc

SEQ ID NO: 16655 - DNA, 20 bp, synthetic construct
  misc_feature 1..20: note = CRISPR gRNA sequence
  source 1..20: mol_type = other DNA
ggaaaatgggggcaggactc

SEQ ID NO: 16656 - DNA, 20 bp, synthetic construct
  misc_feature 1..20: note = CRISPR gRNA sequence
  source 1..20: mol_type = other DNA
gactccggcttgcactttgc

SEQ ID NO: 16657 - DNA, 20 bp, synthetic construct
  misc_feature 1..20: note = CRISPR gRNA sequence
  source 1..20: mol_type = other DNA
cggcttgcactttgctagcc

SEQ ID NO: 16658 - DNA, 20 bp, synthetic construct
  misc_feature 1..20: note = CRISPR gRNA sequence
  source 1..20: mol_type = other DNA
cttgcactttgctagccaag

SEQ ID NO: 16659 - DNA, 20 bp, synthetic construct
  misc_feature 1..20: note = CRISPR gRNA sequence
  source 1..20: mol_type = other DNA
ctagccaagcagttacttcc

SEQ ID NO: 16660 - DNA, 20 bp, synthetic construct
  misc_feature 1..20: note = CRISPR gRNA sequence
  source 1..20: mol_type = other DNA
gccaagcagttacttcctgg

SEQ ID NO: 16661 - DNA, 20 bp, synthetic construct
  misc_feature 1..20: note = CRISPR gRNA sequence
  source 1..20: mol_type = other DNA
ccaagcagttacttcctggt

SEQ ID NO: 16662 - DNA, 20 bp, synthetic construct
  misc_feature 1..20: note = CRISPR gRNA sequence
  source 1..20: mol_type = other DNA
caagcagttacttcctggta

SEQ ID NO: 16663 - DNA, 20 bp, synthetic construct
  misc_feature 1..20: note = CRISPR gRNA sequence
  source 1..20: mol_type = other DNA
aagcagttacttcctggtag

SEQ ID NO: 16664 - DNA, 20 bp, synthetic construct
  misc_feature 1..20: note = CRISPR gRNA sequence
  source 1..20: mol_type = other DNA
ctggtaggggctgcatcctc

SEQ ID NO: 16665 - DNA, 20 bp, synthetic construct
  misc_feature 1..20: note = CRISPR gRNA sequence
  source 1..20: mol_type = other DNA
ggggctgcatcctccagaaa

SEQ ID NO: 16666 - DNA, 20 bp, synthetic construct
  misc_feature 1..20: note = CRISPR gRNA sequence
  source 1..20: mol_type = other DNA
gggctgcatcctccagaaaa

SEQ ID NO: 16667 - DNA, 20 bp, synthetic construct
  misc_feature 1..20: note = CRISPR gRNA sequence
  source 1..20: mol_type = other DNA
cacttttttctatttcaaca

SEQ ID NO: 16668 - DNA, 20 bp, synthetic construct
  misc_feature 1..20: note = CRISPR gRNA sequence
  source 1..20: mol_type = other DNA
acttttttctatttcaacat

SEQ ID NO: 16669 - DNA, 20 bp, synthetic construct
  misc_feature 1..20: note = CRISPR gRNA sequence
  source 1..20: mol_type = other DNA
tttcaacataggctctgtat

SEQ ID NO: 16670 - DNA, 20 bp, synthetic construct
  misc_feature 1..20: note = CRISPR gRNA sequence
  source 1..20: mol_type = other DNA
ttcaacataggctctgtatg

SEQ ID NO: 16671 - DNA, 20 bp, synthetic construct
  misc_feature 1..20: note = CRISPR gRNA sequence
  source 1..20: mol_type = other DNA
aacataggctctgtatgagg

SEQ ID NO: 16672 - DNA, 20 bp, synthetic construct
  misc_feature 1..20: note = CRISPR gRNA sequence
  source 1..20: mol_type = other DNA
ataggctctgtatgaggtgg

SEQ ID NO: 16673 - DNA, 20 bp, synthetic construct
  misc_feature 1..20: note = CRISPR gRNA sequence
  source 1..20: mol_type = other DNA
gtatgaggtggtggtgatgc

SEQ ID NO: 16674 - DNA, 20 bp, synthetic construct
  misc_feature 1..20: note = CRISPR gRNA sequence
  source 1..20: mol_type = other DNA
gaggtggtggtgatgctggt

SEQ ID NO: 16675 - DNA, 20 bp, synthetic construct
  misc_feature 1..20: note = CRISPR gRNA sequence
  source 1..20: mol_type = other DNA
gtggtggtgatgctggtgag

SEQ ID NO: 16676 - DNA, 20 bp, synthetic construct
  misc_feature 1..20: note = CRISPR gRNA sequence
  source 1..20: mol_type = other DNA
ggtggtgatgctggtgagaa

SEQ ID NO: 16677 - DNA, 20 bp, synthetic construct
  misc_feature 1..20: note = CRISPR gRNA sequence
  source 1..20: mol_type = other DNA
tcccccaaaaaacaaaccac

SEQ ID NO: 16678 - DNA, 20 bp, synthetic construct
  misc_feature 1..20: note = CRISPR gRNA sequence
  source 1..20: mol_type = other DNA
cccaaaaaacaaaccactag

SEQ ID NO: 16679 - DNA, 20 bp, synthetic construct
  misc_feature 1..20: note = CRISPR gRNA sequence
  source 1..20: mol_type = other DNA
caccaccaccacctctcccc

SEQ ID NO: 16680 - DNA, 20 bp, synthetic construct
  misc_feature 1..20: note = CRISPR gRNA sequence
  source 1..20: mol_type = other DNA
ccaccaccacctctccccaa

SEQ ID NO: 16681 - DNA, 20 bp, synthetic construct
  misc_feature 1..20: note = CRISPR gRNA sequence
  source 1..20: mol_type = other DNA
agagtcctgcccttgtctga

SEQ ID NO: 16682 - DNA, 20 bp, synthetic construct
  misc_feature 1..20: note = CRISPR gRNA sequence
  source 1..20: mol_type = other DNA
ctgcccttgtctgaaagctg

SEQ ID NO: 16683 - DNA, 20 bp, synthetic construct
  misc_feature 1..20: note = CRISPR gRNA sequence
  source 1..20: mol_type = other DNA
tgaaagctgtagctcttctt

SEQ ID NO: 16684 - DNA, 20 bp, synthetic construct
  misc_feature 1..20: note = CRISPR gRNA sequence
  source 1..20: mol_type = other DNA
gaaagctgtagctcttctta

SEQ ID NO: 16685 - DNA, 20 bp, synthetic construct
  misc_feature 1..20: note = CRISPR gRNA sequence
  source 1..20: mol_type = other DNA
ctcttcttaaggctacaaat

SEQ ID NO: 16686 - DNA, 20 bp, synthetic construct
  misc_feature 1..20: note = CRISPR gRNA sequence
  source 1..20: mol_type = other DNA
acaaattagcttctctgctt

SEQ ID NO: 16687 - DNA, 20 bp, synthetic construct
  misc_feature 1..20: note = CRISPR gRNA sequence
  source 1..20: mol_type = other DNA
tagcttctctgcttaagcct

SEQ ID NO: 16688 - DNA, 20 bp, synthetic construct
  misc_feature 1..20: note = CRISPR gRNA sequence
  source 1..20: mol_type = other DNA
cttagcaaatcttccaaccc

SEQ ID NO: 16689 - DNA, 20 bp, synthetic construct
  misc_feature 1..20: note = CRISPR gRNA sequence
  source 1..20: mol_type = other DNA
ccagacactttctttttttg

SEQ ID NO: 16690 - DNA, 20 bp, synthetic construct
  misc_feature 1..20: note = CRISPR gRNA sequence
  source 1..20: mol_type = other DNA
tctttttttgtggttaaaaa

SEQ ID NO: 16691 - DNA, 20 bp, synthetic construct
  misc_feature 1..20: note = CRISPR gRNA sequence
  source 1..20: mol_type = other DNA
tttttttgtggttaaaaatg

SEQ ID NO: 16692 - DNA, 20 bp, synthetic construct
  misc_feature 1..20: note = CRISPR gRNA sequence
  source 1..20: mol_type = other DNA
aaaaatggagactttgaaac

SEQ ID NO: 16693 - DNA, 20 bp, synthetic construct
  misc_feature 1..20: note = CRISPR gRNA sequence
  source 1..20: mol_type = other DNA
atggagactttgaaacgaga

SEQ ID NO: 16694 - DNA, 20 bp, synthetic construct
  misc_feature 1..20: note = CRISPR gRNA sequence
  source 1..20: mol_type = other DNA
actttgaaacgagaaagacc

SEQ ID NO: 16695 - DNA, 20 bp, synthetic construct
  misc_feature 1..20: note = CRISPR gRNA sequence
  source 1..20: mol_type = other DNA
ctttgaaacgagaaagacct

SEQ ID NO: 16696 - DNA, 20 bp, synthetic construct
  misc_feature 1..20: note = CRISPR gRNA sequence
  source 1..20: mol_type = other DNA
gaaacgagaaagacctaggt

SEQ ID NO: 16697 - DNA, 20 bp, synthetic construct
  misc_feature 1..20: note = CRISPR gRNA sequence
  source 1..20: mol_type = other DNA
aaagacctaggttagaattt

SEQ ID NO: 16698 - DNA, 20 bp, synthetic construct
  misc_feature 1..20: note = CRISPR gRNA sequence
  source 1..20: mol_type = other DNA
tactatctctaatgcaaact

SEQ ID NO: 16699 - DNA, 20 bp, synthetic construct
  misc_feature 1..20: note = CRISPR gRNA sequence
  source 1..20: mol_type = other DNA
actatctctaatgcaaactt

SEQ ID NO: 16700 - DNA, 20 bp, synthetic construct
  misc_feature 1..20: note = CRISPR gRNA sequence
  source 1..20: mol_type = other DNA
atctctaatgcaaacttggg

SEQ ID NO: 16701 - DNA, 20 bp, synthetic construct
  misc_feature 1..20: note = CRISPR gRNA sequence
  source 1..20: mol_type = other DNA
tctctaatgcaaacttgggt

SEQ ID NO: 16702 - DNA, 20 bp, synthetic construct
  misc_feature 1..20: note = CRISPR gRNA sequence
  source 1..20: mol_type = other DNA
ctcaatttcctcatttgtaa

SEQ ID NO: 16703 - DNA, 20 bp, synthetic construct
  misc_feature 1..20: note = CRISPR gRNA sequence
  source 1..20: mol_type = other DNA
atttcctcatttgtaaaaga

SEQ ID NO: 16704 - DNA, 20 bp, synthetic construct
  misc_feature 1..20: note = CRISPR gRNA sequence
  source 1..20: mol_type = other DNA
tgtatttcctttgttgttgt

SEQ ID NO: 16705 - DNA, 20 bp, synthetic construct
  misc_feature 1..20: note = CRISPR gRNA sequence
  source 1..20: mol_type = other DNA
gtatttcctttgttgttgta

SEQ ID NO: 16706 - DNA, 20 bp, synthetic construct
  misc_feature 1..20: note = CRISPR gRNA sequence
  source 1..20: mol_type = other DNA
ctttgttgttgtaaggattc

SEQ ID NO: 16707 - DNA, 20 bp, synthetic construct
  misc_feature 1..20: note = CRISPR gRNA sequence
  source 1..20: mol_type = other DNA
ggattccagatgataatgta

SEQ ID NO: 16708 - DNA, 20 bp, synthetic construct
  misc_feature 1..20: note = CRISPR gRNA sequence
  source 1..20: mol_type = other DNA
tccagatgataatgtatgga

SEQ ID NO: 16709 - DNA, 20 bp, synthetic construct
  misc_feature 1..20: note = CRISPR gRNA sequence
  source 1..20: mol_type = other DNA
gataatgtatggacagcaat

SEQ ID NO: 16710 - DNA, 20 bp, synthetic construct
  misc_feature 1..20: note = CRISPR gRNA sequence
  source 1..20: mol_type = other DNA
gacagcaatgagcatactat

SEQ ID NO: 16711 - DNA, 20 bp, synthetic construct
  misc_feature 1..20: note = CRISPR gRNA sequence
  source 1..20: mol_type = other DNA
atgagcatactatgagtatc

SEQ ID NO: 16712 - DNA, 20 bp, synthetic construct
  misc_feature 1..20: note = CRISPR gRNA sequence
  source 1..20: mol_type = other DNA
tatgagtatccagtaaatgc

SEQ ID NO: 16713 - DNA, 20 bp, synthetic construct
  misc_feature 1..20: note = CRISPR gRNA sequence
  source 1..20: mol_type = other DNA
atgctagttattacaaatac

SEQ ID NO: 16714 - DNA, 20 bp, synthetic construct
  misc_feature 1..20: note = CRISPR gRNA sequence
  source 1..20: mol_type = other DNA
gctagttattacaaatacta

SEQ ID NO: 16715 - DNA, 20 bp, synthetic construct
  misc_feature 1..20: note = CRISPR gRNA sequence
  source 1..20: mol_type = other DNA
agttattacaaatactagag

SEQ ID NO: 16716 - DNA, 20 bp, synthetic construct
  misc_feature 1..20: note = CRISPR gRNA sequence
  source 1..20: mol_type = other DNA
ttacaaatactagagtagct

SEQ ID NO: 16717 - DNA, 20 bp, synthetic construct
  misc_feature 1..20: note = CRISPR gRNA sequence
  source 1..20: mol_type = other DNA
aatactagagtagcttggct

SEQ ID NO: 16718 - DNA, 20 bp, synthetic construct
  misc_feature 1..20: note = CRISPR gRNA sequence
  source 1..20: mol_type = other DNA
atactagagtagcttggcta

SEQ ID NO: 16719 - DNA, 20 bp, synthetic construct
  misc_feature 1..20: note = CRISPR gRNA sequence
  source 1..20: mol_type = other DNA
actagagtagcttggctaag

SEQ ID NO: 16720 - DNA, 20 bp, synthetic construct
  misc_feature 1..20: note = CRISPR gRNA sequence
  source 1..20: mol_type = other DNA
gagtagcttggctaaggagc

SEQ ID NO: 16721 - DNA, 20 bp, synthetic construct
  misc_feature 1..20: note = CRISPR gRNA sequence
  source 1..20: mol_type = other DNA
agtagcttggctaaggagct

SEQ ID NO: 16722 - DNA, 20 bp, synthetic construct
  misc_feature 1..20: note = CRISPR gRNA sequence
  source 1..20: mol_type = other DNA
tagcttggctaaggagctgg

SEQ ID NO: 16723 - DNA, 20 bp, synthetic construct
  misc_feature 1..20: note = CRISPR gRNA sequence
  source 1..20: mol_type = other DNA
agcttggctaaggagctggg

SEQ ID NO: 16724 - DNA, 20 bp, synthetic construct
  misc_feature 1..20: note = CRISPR gRNA sequence
  source 1..20: mol_type = other DNA
ggctaaggagctgggaggaa

SEQ ID NO: 16725 - DNA, 20 bp, synthetic construct
  misc_feature 1..20: note = CRISPR gRNA sequence
  source 1..20: mol_type = other DNA
gctaaggagctgggaggaaa

SEQ ID NO: 16726 - DNA, 20 bp, synthetic construct
  misc_feature 1..20: note = CRISPR gRNA sequence
  source 1..20: mol_type = other DNA
ctaaggagctgggaggaaaa

SEQ ID NO: 16727 - DNA, 20 bp, synthetic construct
  misc_feature 1..20: note = CRISPR gRNA sequence
  source 1..20: mol_type = other DNA
ggagctgggaggaaaaggga

SEQ ID NO: 16728 - DNA, 20 bp, synthetic construct
  misc_feature 1..20: note = CRISPR gRNA sequence
  source 1..20: mol_type = other DNA
gagctgggaggaaaagggaa

SEQ ID NO: 16729 - DNA, 20 bp, synthetic construct
  misc_feature 1..20: note = CRISPR gRNA sequence
  source 1..20: mol_type = other DNA
agctgggaggaaaagggaaa

SEQ ID NO: 16730 - DNA, 20 bp, synthetic construct
  misc_feature 1..20: note = CRISPR gRNA sequence
  source 1..20: mol_type = other DNA
gctgggaggaaaagggaaag

SEQ ID NO: 16731 - DNA, 20 bp, synthetic construct
  misc_feature 1..20: note = CRISPR gRNA sequence
  source 1..20: mol_type = other DNA
ggaaaagggaaaggggtgta

SEQ ID NO: 16732 - DNA, 20 bp, synthetic construct
  misc_feature 1..20: note = CRISPR gRNA sequence
  source 1..20: mol_type = other DNA
agggaaaggggtgtatggta

SEQ ID NO: 16733 - DNA, 20 bp, synthetic construct
  misc_feature 1..20: note = CRISPR gRNA sequence
  source 1..20: mol_type = other DNA
gggaaaggggtgtatggtat

SEQ ID NO: 16734 - DNA, 20 bp, synthetic construct
  misc_feature 1..20: note = CRISPR gRNA sequence
  source 1..20: mol_type = other DNA
ggtgtatggtatgggctttg

SEQ ID NO: 16735 - DNA, 20 bp, synthetic construct
  misc_feature 1..20: note = CRISPR gRNA sequence
  source 1..20: mol_type = other DNA
tatggtatgggctttgtaga

SEQ ID NO: 16736 - DNA, 20 bp, synthetic construct
  misc_feature 1..20: note = CRISPR gRNA sequence
  source 1..20: mol_type = other DNA
atggtatgggctttgtagaa

SEQ ID NO: 16737 - DNA, 20 bp, synthetic construct
  misc_feature 1..20: note = CRISPR gRNA sequence
  source 1..20: mol_type = other DNA
tatgggctttgtagaaagga

SEQ ID NO: 16738 - DNA, 20 bp, synthetic construct
  misc_feature 1..20: note = CRISPR gRNA sequence
  source 1..20: mol_type = other DNA
ggctttgtagaaaggatgga

SEQ ID NO: 16739 - DNA, 20 bp, synthetic construct
  misc_feature 1..20: note = CRISPR gRNA sequence
  source 1..20: mol_type = other DNA
tttgtagaaaggatggacag

SEQ ID NO: 16740 - DNA, 20 bp, synthetic construct
  misc_feature 1..20: note = CRISPR gRNA sequence
  source 1..20: mol_type = other DNA
tgtagaaaggatggacagaa

SEQ ID NO: 16741 - DNA, 20 bp, synthetic construct
  misc_feature 1..20: note = CRISPR gRNA sequence
  source 1..20: mol_type = other DNA
gaaaggatggacagaagagc

SEQ ID NO: 16742 - DNA, 20 bp, synthetic construct
  misc_feature 1..20: note = CRISPR gRNA sequence
  source 1..20: mol_type = other DNA
aggatggacagaagagcaag

SEQ ID NO: 16743 - DNA, 20 bp, synthetic construct
  misc_feature 1..20: note = CRISPR gRNA sequence
  source 1..20: mol_type = other DNA
atggacagaagagcaagaag

SEQ ID NO: 16744 - DNA, 20 bp, synthetic construct
  misc_feature 1..20: note = CRISPR gRNA sequence
  source 1..20: mol_type = other DNA
gcaagaagcagaaatgcgta

SEQ ID NO: 16745 - DNA, 20 bp, synthetic construct
  misc_feature 1..20: note = CRISPR gRNA sequence
  source 1..20: mol_type = other DNA
agcagaaatgcgtatagaaa

SEQ ID NO: 16746 - DNA, 20 bp, synthetic construct
  misc_feature 1..20: note = CRISPR gRNA sequence
  source 1..20: mol_type = other DNA
cagaaatgcgtatagaaatg

SEQ ID NO: 16747 - DNA, 20 bp, synthetic construct
  misc_feature 1..20: note = CRISPR gRNA sequence
  source 1..20: mol_type = other DNA
agaaatgcgtatagaaatgg

SEQ ID NO: 16748 - DNA, 20 bp, synthetic construct
  misc_feature 1..20: note = CRISPR gRNA sequence
  source 1..20: mol_type = other DNA
aatgcgtatagaaatggagg

SEQ ID NO: 16749 - DNA, 20 bp, synthetic construct
  misc_feature 1..20: note = CRISPR gRNA sequence
  source 1..20: mol_type = other DNA
tgcgtatagaaatggaggtg

SEQ ID NO: 16750 - DNA, 20 bp, synthetic construct
  misc_feature 1..20: note = CRISPR gRNA sequence
  source 1..20: mol_type = other DNA
gcgtatagaaatggaggtgg

SEQ ID NO: 16751 - DNA, 20 bp, synthetic construct
  misc_feature 1..20: note = CRISPR gRNA sequence
  source 1..20: mol_type = other DNA
gaggtggaggatgtaaacat

SEQ ID NO: 16752 - DNA, 20 bp, synthetic construct
  misc_feature 1..20: note = CRISPR gRNA sequence
  source 1..20: mol_type = other DNA
aacatgagattttgttttct

SEQ ID NO: 16753 - DNA, 20 bp, synthetic construct
  misc_feature 1..20: note = CRISPR gRNA sequence
  source 1..20: mol_type = other DNA
atgagattttgttttcttgg

SEQ ID NO: 16754 - DNA, 20 bp, synthetic construct
  misc_feature 1..20: note = CRISPR gRNA sequence
  source 1..20: mol_type = other DNA
tttgttttcttggtggtcat

SEQ ID NO: 16755 - DNA, 20 bp, synthetic construct
  misc_feature 1..20: note = CRISPR gRNA sequence
  source 1..20: mol_type = other DNA
tttcttggtggtcattagtg

SEQ ID NO: 16756 - DNA, 20 bp, synthetic construct
  misc_feature 1..20: note = CRISPR gRNA sequence
  source 1..20: mol_type = other DNA
ttcttggtggtcattagtga

SEQ ID NO: 16757 - DNA, 20 bp, synthetic construct
  misc_feature 1..20: note = CRISPR gRNA sequence
  source 1..20: mol_type = other DNA
tcttggtggtcattagtgaa

SEQ ID NO: 16758 - DNA, 20 bp, synthetic construct
  misc_feature 1..20: note = CRISPR gRNA sequence
  source 1..20: mol_type = other DNA
cttggtggtcattagtgaag

SEQ ID NO: 16759 - DNA, 20 bp, synthetic construct
  misc_feature 1..20: note = CRISPR gRNA sequence
  source 1..20: mol_type = other DNA
aaggggcctatttcccccac

SEQ ID NO: 16760 - DNA, 20 bp, synthetic construct
  misc_feature 1..20: note = CRISPR gRNA sequence
  source 1..20: mol_type = other DNA
tccatctcccctctcttccc

SEQ ID NO: 16761 - DNA, 20 bp, synthetic construct
  misc_feature 1..20: note = CRISPR gRNA sequence
  source 1..20: mol_type = other DNA
catctcccctctcttccctg

SEQ ID NO: 16762 - DNA, 20 bp, synthetic construct
  misc_feature 1..20: note = CRISPR gRNA sequence
  source 1..20: mol_type = other DNA
ccctggagtctccgttcctc

SEQ ID NO: 16763 - DNA, 20 bp, synthetic construct
  misc_feature 1..20: note = CRISPR gRNA sequence
  source 1..20: mol_type = other DNA
cccccttgcaatgatttctg

SEQ ID NO: 16764 - DNA, 20 bp, synthetic construct
  misc_feature 1..20: note = CRISPR gRNA sequence
  source 1..20: mol_type = other DNA
ccccttgcaatgatttctgt

SEQ ID NO: 16765 - DNA, 20 bp, synthetic construct
  misc_feature 1..20: note = CRISPR gRNA sequence
  source 1..20: mol_type = other DNA
ccttgcaatgatttctgtgg

SEQ ID NO: 16766 - DNA, 20 bp, synthetic construct
  misc_feature 1..20: note = CRISPR gRNA sequence
  source 1..20: mol_type = other DNA
cttgcaatgatttctgtggg

SEQ ID NO: 16767 - DNA, 20 bp, synthetic construct
  misc_feature 1..20: note = CRISPR gRNA sequence
  source 1..20: mol_type = other DNA
ttgcaatgatttctgtggga

SEQ ID NO: 16768 - DNA, 20 bp, synthetic construct
  misc_feature 1..20: note = CRISPR gRNA sequence
  source 1..20: mol_type = other DNA
tgcaatgatttctgtgggag

SEQ ID NO: 16769 - DNA, 20 bp, synthetic construct
  misc_feature 1..20: note = CRISPR gRNA sequence
  source 1..20: mol_type = other DNA
tctgtgggaggggactgacg

SEQ ID NO: 16770 - DNA, 20 bp, synthetic construct
  misc_feature 1..20: note = CRISPR gRNA sequence
  source 1..20: mol_type = other DNA
ctgacgtggctcatgatgaa

SEQ ID NO: 16771 - DNA, 20 bp, synthetic construct
  misc_feature 1..20: note = CRISPR gRNA sequence
  source 1..20: mol_type = other DNA
tgacgtggctcatgatgaat

SEQ ID NO: 16772 - DNA, 20 bp, synthetic construct
  misc_feature 1..20: note = CRISPR gRNA sequence
  source 1..20: mol_type = other DNA
gatgaatgggtgatattgac

SEQ ID NO: 16773 - DNA, 20 bp, synthetic construct
  misc_feature 1..20: note = CRISPR gRNA sequence
  source 1..20: mol_type = other DNA
gaatgggtgatattgacaag

SEQ ID NO: 16774 - DNA, 20 bp, synthetic construct
  misc_feature 1..20: note = CRISPR gRNA sequence
  source 1..20: mol_type = other DNA
tgggtgatattgacaagtgg

SEQ ID NO: 16775 - DNA, 20 bp, synthetic construct
  misc_feature 1..20: note = CRISPR gRNA sequence
  source 1..20: mol_type = other DNA
gatattgacaagtggcagca

SEQ ID NO: 16776 - DNA, 20 bp, synthetic construct
  misc_feature 1..20: note = CRISPR gRNA sequence
  source 1..20: mol_type = other DNA
tgcccttgattgtccttttc

SEQ ID NO: 16777 - DNA, 20 bp, synthetic construct
  misc_feature 1..20: note = CRISPR gRNA sequence
  source 1..20: mol_type = other DNA
gcccttgattgtccttttct

SEQ ID NO: 16778 - DNA, 20 bp, synthetic construct
  misc_feature 1..20: note = CRISPR gRNA sequence
  source 1..20: mol_type = other DNA
tgattgtccttttctgggct

SEQ ID NO: 16779 - DNA, 20 bp, synthetic construct
  misc_feature 1..20: note = CRISPR gRNA sequence
  source 1..20: mol_type = other DNA
gattgtccttttctgggctc

SEQ ID NO: 16780 - DNA, 20 bp, synthetic construct
  misc_feature 1..20: note = CRISPR gRNA sequence
  source 1..20: mol_type = other DNA
aggtgcttcctcaccgatat

SEQ ID NO: 16781 - DNA, 20 bp, synthetic construct
  misc_feature 1..20: note = CRISPR gRNA sequence
  source 1..20: mol_type = other DNA
ttcctcaccgatattggcat

SEQ ID NO: 16782 - DNA, 20 bp, synthetic construct
  misc_feature 1..20: note = CRISPR gRNA sequence
  source 1..20: mol_type = other DNA
gatattggcataagcctccc

SEQ ID NO: 16783 - DNA, 20 bp, synthetic construct
  misc_feature 1..20: note = CRISPR gRNA sequence
  source 1..20: mol_type = other DNA
tcaccttccatgtcacacaa

SEQ ID NO: 16784 - DNA, 20 bp, synthetic construct
  misc_feature 1..20: note = CRISPR gRNA sequence
  source 1..20: mol_type = other DNA
cacacaacagcctgctgaac

SEQ ID NO: 16785 - DNA, 20 bp, synthetic construct
  misc_feature 1..20: note = CRISPR gRNA sequence
  source 1..20: mol_type = other DNA
acagcctgctgaactggtcg

SEQ ID NO: 16786 - DNA, 20 bp, synthetic construct
  misc_feature 1..20: note = CRISPR gRNA sequence
  source 1..20: mol_type = other DNA
gctgaactggtcgcagttga

SEQ ID NO: 16787 - DNA, 20 bp, synthetic construct
  misc_feature 1..20: note = CRISPR gRNA sequence
  source 1..20: mol_type = other DNA
gcagttgatggtgtctgtgt

SEQ ID NO: 16788 - DNA, 20 bp, synthetic construct
  misc_feature 1..20: note = CRISPR gRNA sequence
  source 1..20: mol_type = other DNA
cagttgatggtgtctgtgtc

SEQ ID NO: 16789 - DNA, 20 bp, synthetic construct
  misc_feature 1..20: note = CRISPR gRNA sequence
  source 1..20: mol_type = other DNA
atggtgtctgtgtcgggttc

SEQ ID NO: 16790 - DNA, 20 bp, synthetic construct
  misc_feature 1..20: note = CRISPR gRNA sequence
  source 1..20: mol_type = other DNA
tggtgtctgtgtcgggttct

SEQ ID NO: 16791 - DNA, 20 bp, synthetic construct
  misc_feature 1..20: note = CRISPR gRNA sequence
  source 1..20: mol_type = other DNA
gtgtctgtgtcgggttctgg

SEQ ID NO: 16792 - DNA, 20 bp, synthetic construct
  misc_feature 1..20: note = CRISPR gRNA sequence
  source 1..20: mol_type = other DNA
tgtctgtgtcgggttctggg

SEQ ID NO: 16793 - DNA, 20 bp, synthetic construct
  misc_feature 1..20: note = CRISPR gRNA sequence
  source 1..20: mol_type = other DNA
gtgtcgggttctgggaggaa

SEQ ID NO: 16794 - DNA, 20 bp, synthetic construct
  misc_feature 1..20: note = CRISPR gRNA sequence
  source 1..20: mol_type = other DNA
ttctgggaggaaaagtccct

SEQ ID NO: 16795 - DNA, 20 bp, synthetic construct
  misc_feature 1..20: note = CRISPR gRNA sequence
  source 1..20: mol_type = other DNA
gaggaaaagtcccttggatg

SEQ ID NO: 16796 - DNA, 20 bp, synthetic construct
  misc_feature 1..20: note = CRISPR gRNA sequence
  source 1..20: mol_type = other DNA
gaaaagtcccttggatgaag

SEQ ID NO: 16797 - DNA, 20 bp, synthetic construct
  misc_feature 1..20: note = CRISPR gRNA sequence
  source 1..20: mol_type = other DNA
aaaagtcccttggatgaaga

SEQ ID NO: 16798 - DNA, 20 bp, synthetic construct
  misc_feature 1..20: note = CRISPR gRNA sequence
  source 1..20: mol_type = other DNA
tggatgaagaaggaaatttc

SEQ ID NO: 16799 - DNA, 20 bp, synthetic construct
  misc_feature 1..20: note = CRISPR gRNA sequence
  source 1..20: mol_type = other DNA
tgaagaaggaaatttctgga

SEQ ID NO: 16800 - DNA, 20 bp, synthetic construct
  misc_feature 1..20: note = CRISPR gRNA sequence
  source 1..20: mol_type = other DNA
aagaaggaaatttctggaaa

SEQ ID NO: 16801 - DNA, 20 bp, synthetic construct
  misc_feature 1..20: note = CRISPR gRNA sequence
  source 1..20: mol_type = other DNA
agaaggaaatttctggaaag

SEQ ID NO: 16802 - DNA, 20 bp, synthetic construct
  misc_feature 1..20: note = CRISPR gRNA sequence
  source 1..20: mol_type = other DNA
gaaggaaatttctggaaaga

SEQ ID NO: 16803 - DNA, 20 bp, synthetic construct
  misc_feature 1..20: note = CRISPR gRNA sequence
  source 1..20: mol_type = other DNA
gaaatttctggaaagagggc

SEQ ID NO: 16804 - DNA, 20 bp, synthetic construct
  misc_feature 1..20: note = CRISPR gRNA sequence
  source 1..20: mol_type = other DNA
atttctggaaagagggctgg

SEQ ID NO: 16805 - DNA, 20 bp, synthetic construct
  misc_feature 1..20: note = CRISPR gRNA sequence
  source 1..20: mol_type = other DNA
tttctggaaagagggctggt

SEQ ID NO: 16806 - DNA, 20 bp, synthetic construct
  misc_feature 1..20: note = CRISPR gRNA sequence
  source 1..20: mol_type = other DNA
ttctggaaagagggctggtg

SEQ ID NO: 16807 - DNA, 20 bp, synthetic construct
  misc_feature 1..20: note = CRISPR gRNA sequence
  source 1..20: mol_type = other DNA
aaagagggctggtggggaac

SEQ ID NO: 16808 - DNA, 20 bp, synthetic construct
  misc_feature 1..20: note = CRISPR gRNA sequence
  source 1..20: mol_type = other DNA
aagagggctggtggggaacg

SEQ ID NO: 16809 - DNA, 20 bp, synthetic construct
  misc_feature 1..20: note = CRISPR gRNA sequence
  source 1..20: mol_type = other DNA
agagggctggtggggaacga

SEQ ID NO: 16810 - DNA, 20 bp, synthetic construct
  misc_feature 1..20: note = CRISPR gRNA sequence
  source 1..20: mol_type = other DNA
agggctggtggggaacgagg

SEQ ID NO: 16811 - DNA, 20 bp, synthetic construct
  misc_feature 1..20: note = CRISPR gRNA sequence
  source 1..20: mol_type = other DNA
ggctggtggggaacgaggga

SEQ ID NO: 16812 - DNA, 20 bp, synthetic construct
  misc_feature 1..20: note = CRISPR gRNA sequence
  source 1..20: mol_type = other DNA
gctggtggggaacgagggag

SEQ ID NO: 16813 - DNA, 20 bp, synthetic construct
  misc_feature 1..20: note = CRISPR gRNA sequence
  source 1..20: mol_type = other DNA
ggtggggaacgagggagagg

SEQ ID NO: 16814 - DNA, 20 bp, synthetic construct
  misc_feature 1..20: note = CRISPR gRNA sequence
  source 1..20: mol_type = other DNA
gtggggaacgagggagaggc

SEQ ID NO: 16815 - DNA, 20 bp, synthetic construct
  misc_feature 1..20: note = CRISPR gRNA sequence
  source 1..20: mol_type = other DNA
tggggaacgagggagaggcg

SEQ ID NO: 16816 - DNA, 20 bp, synthetic construct
  misc_feature 1..20: note = CRISPR gRNA sequence
  source 1..20: mol_type = other DNA
ggaacgagggagaggcgggg

SEQ ID NO: 16817 - DNA, 20 bp, synthetic construct
  misc_feature 1..20: note = CRISPR gRNA sequence
  source 1..20: mol_type = other DNA
gaacgagggagaggcggggc

SEQ ID NO: 16818 - DNA, 20 bp, synthetic construct
  misc_feature 1..20: note = CRISPR gRNA sequence
  source 1..20: mol_type = other DNA
aacgagggagaggcggggca

SEQ ID NO: 16819 - DNA, 20 bp, synthetic construct
  misc_feature 1..20: note = CRISPR gRNA sequence
  source 1..20: mol_type = other DNA
agggagaggcggggcagggc

SEQ ID NO: 16820 - DNA, 20 bp, synthetic construct
  misc_feature 1..20: note = CRISPR gRNA sequence
  source 1..20: mol_type = other DNA
gggagaggcggggcagggct

SEQ ID NO: 16821 - DNA, 20 bp, synthetic construct
  misc_feature 1..20: note = CRISPR gRNA sequence
  source 1..20: mol_type = other DNA
gagaggcggggcagggctgg

SEQ ID NO: 16822 - DNA, 20 bp, synthetic construct
  misc_feature 1..20: note = CRISPR gRNA sequence
  source 1..20: mol_type = other DNA
tgggagatcatccccatctg

SEQ ID NO: 16823 - DNA, 20 bp, synthetic construct
  misc_feature 1..20: note = CRISPR gRNA sequence
  source 1..20: mol_type = other DNA
ggagatcatccccatctgca

SEQ ID NO: 16824 - DNA, 20 bp, synthetic construct
  misc_feature 1..20: note = CRISPR gRNA sequence
  source 1..20: mol_type = other DNA
agatcatccccatctgcaga

SEQ ID NO: 16825 - DNA, 20 bp, synthetic construct
  misc_feature 1..20: note = CRISPR gRNA sequence
  source 1..20: mol_type = other DNA
catctgcagagagcgtccca

SEQ ID NO: 16826 - DNA, 20 bp, synthetic construct
  misc_feature 1..20: note = CRISPR gRNA sequence
  source 1..20: mol_type = other DNA
cagagagcgtcccacagacg

SEQ ID NO: 16827 - DNA, 20 bp, synthetic construct
  misc_feature 1..20: note = CRISPR gRNA sequence
  source 1..20: mol_type = other DNA
agagagcgtcccacagacgt

SEQ ID NO: 16828 - DNA, 20 bp, synthetic construct
  misc_feature 1..20: note = CRISPR gRNA sequence
  source 1..20: mol_type = other DNA
agagcgtcccacagacgtgg

SEQ ID NO: 16829 - DNA, 20 bp, synthetic construct
  misc_feature 1..20: note = CRISPR gRNA sequence
  source 1..20: mol_type = other DNA
acagacgtgggagctgtccg

SEQ ID NO: 16830 - DNA, 20 bp, synthetic construct
  misc_feature 1..20: note = CRISPR gRNA sequence
  source 1..20: mol_type = other DNA
ggagctgtccgtggtgctga

SEQ ID NO: 16831 - DNA, 20 bp, synthetic construct
  misc_feature 1..20: note = CRISPR gRNA sequence
  source 1..20: mol_type = other DNA
gagctgtccgtggtgctgac

SEQ ID NO: 16832 - DNA, 20 bp, synthetic construct
  misc_feature 1..20: note = CRISPR gRNA sequence
  source 1..20: mol_type = other DNA
gctgtccgtggtgctgacgg

SEQ ID NO: 16833 - DNA, 20 bp, synthetic construct
  misc_feature 1..20: note = CRISPR gRNA sequence
  source 1..20: mol_type = other DNA
ctgtccgtggtgctgacggg

SEQ ID NO: 16834 - DNA, 20 bp, synthetic construct
  misc_feature 1..20: note = CRISPR gRNA sequence
  source 1..20: mol_type = other DNA
tgtccgtggtgctgacggga

SEQ ID NO: 16835 - DNA, 20 bp, synthetic construct
  misc_feature 1..20: note = CRISPR gRNA sequence
  source 1..20: mol_type = other DNA
ccgtggtgctgacgggaggg

SEQ ID NO: 16836 - DNA, 20 bp, synthetic construct
  misc_feature 1..20: note = CRISPR gRNA sequence
  source 1..20: mol_type = other DNA
cgtggtgctgacgggagggc

SEQ ID NO: 16837 - DNA, 20 bp, synthetic construct
  misc_feature 1..20: note = CRISPR gRNA sequence
  source 1..20: mol_type = other DNA
gtggtgctgacgggagggca

SEQ ID NO: 16838 - DNA, 20 bp, synthetic construct
  misc_feature 1..20: note = CRISPR gRNA sequence
  source 1..20: mol_type = other DNA
gctgacgggagggcagggac

SEQ ID NO: 16839 - DNA, 20 bp, synthetic construct
  misc_feature 1..20: note = CRISPR gRNA sequence
  source 1..20: mol_type = other DNA
tcccctgattgccgtctcta

SEQ ID NO: 16840 - DNA, 20 bp, synthetic construct
  misc_feature 1..20: note = CRISPR gRNA sequence
  source 1..20: mol_type = other DNA
ctgattgccgtctctacagc

SEQ ID NO: 16841 - DNA, 20 bp, synthetic construct
  misc_feature 1..20: note = CRISPR gRNA sequence
  source 1..20: mol_type = other DNA
tgccgtctctacagcaagct

SEQ ID NO: 16842 - DNA, 20 bp, synthetic construct
  misc_feature 1..20: note = CRISPR gRNA sequence
  source 1..20: mol_type = other DNA
gccgtctctacagcaagctg

SEQ ID NO: 16843 - DNA, 20 bp, synthetic construct
  misc_feature 1..20: note = CRISPR gRNA sequence
  source 1..20: mol_type = other DNA
ccgtctctacagcaagctga

SEQ ID NO: 16844 - DNA, 20 bp, synthetic construct
  misc_feature 1..20: note = CRISPR gRNA sequence
  source 1..20: mol_type = other DNA
cgtctctacagcaagctgag

SEQ ID NO: 16845 - DNA, 20 bp, synthetic construct
  misc_feature 1..20: note = CRISPR gRNA sequence
  source 1..20: mol_type = other DNA
ctctacagcaagctgagggg

SEQ ID NO: 16846 - DNA, 20 bp, synthetic construct
  misc_feature 1..20: note = CRISPR gRNA sequence
  source 1..20: mol_type = other DNA
tctacagcaagctgaggggt

SEQ ID NO: 16847 - DNA, 20 bp, synthetic construct
  misc_feature 1..20: note = CRISPR gRNA sequence
  source 1..20: mol_type = other DNA
ctacagcaagctgaggggtg

SEQ ID NO: 16848 - DNA, 20 bp, synthetic construct
  misc_feature 1..20: note = CRISPR gRNA sequence
  source 1..20: mol_type = other DNA
tacagcaagctgaggggtgg

SEQ ID NO: 16849 - DNA, 20 bp, synthetic construct
  misc_feature 1..20: note = CRISPR gRNA sequence
  source 1..20: mol_type = other DNA
agctgaggggtgggggatac

SEQ ID NO: 16850 - DNA, 20 bp, synthetic construct
  misc_feature 1..20: note = CRISPR gRNA sequence
  source 1..20: mol_type = other DNA
tgaggggtgggggataccgg

SEQ ID NO: 16851 - DNA, 20 bp, synthetic construct
  misc_feature 1..20: note = CRISPR gRNA sequence
  source 1..20: mol_type = other DNA
aggggtgggggataccggaa

SEQ ID NO: 16852 - DNA, 20 bp, synthetic construct
  misc_feature 1..20: note = CRISPR gRNA sequence
  source 1..20: mol_type = other DNA
tgggggataccggaagagac

SEQ ID NO: 16853 - DNA, 20 bp, synthetic construct
  misc_feature 1..20: note = CRISPR gRNA sequence
  source 1..20: mol_type = other DNA
ggggataccggaagagacca

SEQ ID NO: 16854 - DNA, 20 bp, synthetic construct
  misc_feature 1..20: note = CRISPR gRNA sequence
  source 1..20: mol_type = other DNA
gggataccggaagagaccag

SEQ ID NO: 16855 - DNA, 20 bp, synthetic construct
  misc_feature 1..20: note = CRISPR gRNA sequence
  source 1..20: mol_type = other DNA
ggataccggaagagaccaga

SEQ ID NO: 16856 - DNA, 20 bp, synthetic construct
  misc_feature 1..20: note = CRISPR gRNA sequence
  source 1..20: mol_type = other DNA
ataccggaagagaccagagg

SEQ ID NO: 16857 - DNA, 20 bp, synthetic construct
  misc_feature 1..20: note = CRISPR gRNA sequence
  source 1..20: mol_type = other DNA
taccggaagagaccagaggg

SEQ ID NO: 16858 - DNA, 20 bp, synthetic construct
  misc_feature 1..20: note = CRISPR gRNA sequence
  source 1..20: mol_type = other DNA
ccggaagagaccagagggag

SEQ ID NO: 16859 - DNA, 20 bp, synthetic construct
  misc_feature 1..20: note = CRISPR gRNA sequence
  source 1..20: mol_type = other DNA
cggaagagaccagagggagg

SEQ ID NO: 16860 - DNA, 20 bp, synthetic construct
  misc_feature 1..20: note = CRISPR gRNA sequence
  source 1..20: mol_type = other DNA
ggaagagaccagagggagga

SEQ ID NO: 16861 - DNA, 20 bp, synthetic construct
  misc_feature 1..20: note = CRISPR gRNA sequence
  source 1..20: mol_type = other DNA
agagggaggagggcccacct

SEQ ID NO: 16862 - DNA, 20 bp, synthetic construct
  misc_feature 1..20: note = CRISPR gRNA sequence
  source 1..20: mol_type = other DNA
gggaggagggcccacctgag

SEQ ID NO: 16863 - DNA, 20 bp, synthetic construct
  misc_feature 1..20: note = CRISPR gRNA sequence
  source 1..20: mol_type = other DNA
gaggagggcccacctgagta

SEQ ID NO: 16864 - DNA, 20 bp, synthetic construct
  misc_feature 1..20: note = CRISPR gRNA sequence
  source 1..20: mol_type = other DNA
gagctcaatctcttcttctc

SEQ ID NO: 16865 - DNA, 20 bp, synthetic construct
  misc_feature 1..20: note = CRISPR gRNA sequence
  source 1..20: mol_type = other DNA
tcaatctcttcttctccagc

SEQ ID NO: 16866 - DNA, 20 bp, synthetic construct
  misc_feature 1..20: note = CRISPR gRNA sequence
  source 1..20: mol_type = other DNA
caatctcttcttctccagcc

SEQ ID NO: 16867 - DNA, 20 bp, synthetic construct
  misc_feature 1..20: note = CRISPR gRNA sequence
  source 1..20: mol_type = other DNA
cttctccagccaggtccatc

SEQ ID NO: 16868 - DNA, 20 bp, synthetic construct
  misc_feature 1..20: note = CRISPR gRNA sequence
  source 1..20: mol_type = other DNA
cagccaggtccatctggtca

SEQ ID NO: 16869 - DNA, 20 bp, synthetic construct
  misc_feature 1..20: note = CRISPR gRNA sequence
  source 1..20: mol_type = other DNA
ccaggtccatctggtcatag

SEQ ID NO: 16870 - DNA, 20 bp, synthetic construct
  misc_feature 1..20: note = CRISPR gRNA sequence
  source 1..20: mol_type = other DNA
ggtccatctggtcatagaag

SEQ ID NO: 16871 - DNA, 20 bp, synthetic construct
  misc_feature 1..20: note = CRISPR gRNA sequence
  source 1..20: mol_type = other DNA
ccatctggtcatagaagtgg

SEQ ID NO: 16872 - DNA, 20 bp, synthetic construct
  misc_feature 1..20: note = CRISPR gRNA sequence
  source 1..20: mol_type = other DNA
atctggtcatagaagtggta

SEQ ID NO: 16873 - DNA, 20 bp, synthetic construct
  misc_feature 1..20: note = CRISPR gRNA sequence
  source 1..20: mol_type = other DNA
tctggtcatagaagtggtag

SEQ ID NO: 16874 - DNA, 20 bp, synthetic construct
  misc_feature 1..20: note = CRISPR gRNA sequence
  source 1..20: mol_type = other DNA
tcatagaagtggtagaggca

SEQ ID NO: 16875 - DNA, 20 bp, synthetic construct
  misc_feature 1..20: note = CRISPR gRNA sequence
  source 1..20: mol_type = other DNA
catagaagtggtagaggcac

SEQ ID NO: 16876 - DNA, 20 bp, synthetic construct
  misc_feature 1..20: note = CRISPR gRNA sequence
  source 1..20: mol_type = other DNA
atagaagtggtagaggcaca

SEQ ID NO: 16877 - DNA, 20 bp, synthetic construct
  misc_feature 1..20: note = CRISPR gRNA sequence
  source 1..20: mol_type = other DNA
tagaagtggtagaggcacag

SEQ ID NO: 16878 - DNA, 20 bp, synthetic construct
  misc_feature 1..20: note = CRISPR gRNA sequence
  source 1..20: mol_type = other DNA
agaagtggtagaggcacagg

SEQ ID NO: 16879 - DNA, 20 bp, synthetic construct
  misc_feature 1..20: note = CRISPR gRNA sequence
  source 1..20: mol_type = other DNA
gtggtagaggcacagggggt

SEQ ID NO: 16880 - DNA, 20 bp, synthetic construct
  misc_feature 1..20: note = CRISPR gRNA sequence
  source 1..20: mol_type = other DNA
agggggtcagcatcgctgtt

SEQ ID NO: 16881 - DNA, 20 bp, synthetic construct
  misc_feature 1..20: note = CRISPR gRNA sequence
  source 1..20: mol_type = other DNA
gggtcagcatcgctgttaag

SEQ ID NO: 16882 - DNA, 20 bp, synthetic construct
  misc_feature 1..20: note = CRISPR gRNA sequence
  source 1..20: mol_type = other DNA
gcatcgctgttaagaagctc

SEQ ID NO: 16883 - DNA, 20 bp, synthetic construct
  misc_feature 1..20: note = CRISPR gRNA sequence
  source 1..20: mol_type = other DNA
catcgctgttaagaagctcc

SEQ ID NO: 16884 - DNA, 20 bp, synthetic construct
  misc_feature 1..20: note = CRISPR gRNA sequence
  source 1..20: mol_type = other DNA
cgctgttaagaagctccagg

SEQ ID NO: 16885 - DNA, 20 bp, synthetic construct
  misc_feature 1..20: note = CRISPR gRNA sequence
  source 1..20: mol_type = other DNA
agctccaggtagccaccttc

SEQ ID NO: 16886 - DNA, 20 bp, synthetic construct
  misc_feature 1..20: note = CRISPR gRNA sequence
  source 1..20: mol_type = other DNA
gctccaggtagccaccttct

SEQ ID NO: 16887 - DNA, 20 bp, synthetic construct
  misc_feature 1..20: note = CRISPR gRNA sequence
  source 1..20: mol_type = other DNA
ctccaggtagccaccttcta

SEQ ID NO: 16888 - DNA, 20 bp, synthetic construct
  misc_feature 1..20: note = CRISPR gRNA sequence
  source 1..20: mol_type = other DNA
tccaggtagccaccttctag

SEQ ID NO: 16889 - DNA, 20 bp, synthetic construct
  misc_feature 1..20: note = CRISPR gRNA sequence
  source 1..20: mol_type = other DNA
ttctaggggccccaactcca

SEQ ID NO: 16890 - DNA, 20 bp, synthetic construct
  misc_feature 1..20: note = CRISPR gRNA sequence
  source 1..20: mol_type = other DNA
taggggccccaactccatgg

SEQ ID NO: 16891 - DNA, 20 bp, synthetic construct
  misc_feature 1..20: note = CRISPR gRNA sequence
  source 1..20: mol_type = other DNA
actccatggtggcacactgt

SEQ ID NO: 16892 - DNA, 20 bp, synthetic construct
  misc_feature 1..20: note = CRISPR gRNA sequence
  source 1..20: mol_type = other DNA
gtggcacactgtgagctgcc

SEQ ID NO: 16893 - DNA, 20 bp, synthetic construct
  misc_feature 1..20: note = CRISPR gRNA sequence
  source 1..20: mol_type = other DNA
tggcacactgtgagctgcct

SEQ ID NO: 16894 - DNA, 20 bp, synthetic construct
  misc_feature 1..20: note = CRISPR gRNA sequence
  source 1..20: mol_type = other DNA
gcacactgtgagctgcctgg

SEQ ID NO: 16895 - DNA, 20 bp, synthetic construct
  misc_feature 1..20: note = CRISPR gRNA sequence
  source 1..20: mol_type = other DNA
cacactgtgagctgcctggg

SEQ ID NO: 16896 - DNA, 20 bp, synthetic construct
  misc_feature 1..20: note = CRISPR gRNA sequence
  source 1..20: mol_type = other DNA
acactgtgagctgcctggga

SEQ ID NO: 16897 - DNA, 20 bp, synthetic construct
  misc_feature 1..20: note = CRISPR gRNA sequence
  source 1..20: mol_type = other DNA
ctgtgagctgcctgggaggg

SEQ ID NO: 16898 - DNA, 20 bp, synthetic construct
  misc_feature 1..20: note = CRISPR gRNA sequence
  source 1..20: mol_type = other DNA
ctgggagggaagacaatgct

SEQ ID NO: 16899 - DNA, 20 bp, synthetic construct
  misc_feature 1..20: note = CRISPR gRNA sequence
  source 1..20: mol_type = other DNA
gacaatgctcagtcacctca

SEQ ID NO: 16900 - DNA, 20 bp, synthetic construct
  misc_feature 1..20: note = CRISPR gRNA sequence
  source 1..20: mol_type = other DNA
acaatgctcagtcacctcac

SEQ ID NO: 16901 - DNA, 20 bp, synthetic construct
  misc_feature 1..20: note = CRISPR gRNA sequence
  source 1..20: mol_type = other DNA
caatgctcagtcacctcaca

SEQ ID NO: 16902 - DNA, 20 bp, synthetic construct
  misc_feature 1..20: note = CRISPR gRNA sequence
  source 1..20: mol_type = other DNA
tcagtcacctcacagggtgt

SEQ ID NO: 16903 - DNA, 20 bp, synthetic construct
  misc_feature 1..20: note = CRISPR gRNA sequence
  source 1..20: mol_type = other DNA
tcacctcacagggtgttgga

SEQ ID NO: 16904 - DNA, 20 bp, synthetic construct
  misc_feature 1..20: note = CRISPR gRNA sequence
  source 1..20: mol_type = other DNA
acctcacagggtgttggaaa

SEQ ID NO: 16905 - DNA, 20 bp, synthetic construct
  misc_feature 1..20: note = CRISPR gRNA sequence
  source 1..20: mol_type = other DNA
cctcacagggtgttggaaag

SEQ ID NO: 16906 - DNA, 20 bp, synthetic construct
  misc_feature 1..20: note = CRISPR gRNA sequence
  source 1..20: mol_type = other DNA
cacagggtgttggaaagagg

SEQ ID NO: 16907 - DNA, 20 bp, synthetic construct
  misc_feature 1..20: note = CRISPR gRNA sequence
  source 1..20: mol_type = other DNA
ttgacacctacaacaactcc

SEQ ID NO: 16908 - DNA, 20 bp, synthetic construct
  misc_feature 1..20: note = CRISPR gRNA sequence
  source 1..20: mol_type = other DNA
cacctacaacaactcccagc

SEQ ID NO: 16909 - DNA, 20 bp, synthetic construct
  misc_feature 1..20: note = CRISPR gRNA sequence
  source 1..20: mol_type = other DNA
tacaacaactcccagctggt

SEQ ID NO: 16910 - DNA, 20 bp, synthetic construct
  misc_feature 1..20: note = CRISPR gRNA sequence
  source 1..20: mol_type = other DNA
acaacaactcccagctggtg

SEQ ID NO: 16911 - DNA, 20 bp, synthetic construct
  misc_feature 1..20: note = CRISPR gRNA sequence
  source 1..20: mol_type = other DNA
caacaactcccagctggtga

SEQ ID NO: 16912 - DNA, 20 bp, synthetic construct
  misc_feature 1..20: note = CRISPR gRNA sequence
  source 1..20: mol_type = other DNA
aactcccagctggtgagggc

SEQ ID NO: 16913 - DNA, 20 bp, synthetic construct
  misc_feature 1..20: note = CRISPR gRNA sequence
  source 1..20: mol_type = other DNA
actcccagctggtgagggct

SEQ ID NO: 16914 - DNA, 20 bp, synthetic construct
  misc_feature 1..20: note = CRISPR gRNA sequence
  source 1..20: mol_type = other DNA
ctcccagctggtgagggctg

SEQ ID NO: 16915 - DNA, 20 bp, synthetic construct
  misc_feature 1..20: note = CRISPR gRNA sequence
  source 1..20: mol_type = other DNA
agctggtgagggctggggat

SEQ ID NO: 16916 - DNA, 20 bp, synthetic construct
  misc_feature 1..20: note = CRISPR gRNA sequence
  source 1..20: mol_type = other DNA
ctggtgagggctggggatga

SEQ ID NO: 16917 - DNA, 20 bp, synthetic construct
  misc_feature 1..20: note = CRISPR gRNA sequence
  source 1..20: mol_type = other DNA
tggtgagggctggggatgag

SEQ ID NO: 16918 - DNA, 20 bp, synthetic construct
  misc_feature 1..20: note = CRISPR gRNA sequence
  source 1..20: mol_type = other DNA
gtgagggctggggatgagag

SEQ ID NO: 16919 - DNA, 20 bp, synthetic construct
  misc_feature 1..20: note = CRISPR gRNA sequence
  source 1..20: mol_type = other DNA
gggatgagaggagtgaataa

SEQ ID NO: 16920 - DNA, 20 bp, synthetic construct
  misc_feature 1..20: note = CRISPR gRNA sequence
  source 1..20: mol_type = other DNA
agtgaataaaagcgctcatt

SEQ ID NO: 16921 - DNA, 20 bp, synthetic construct
  misc_feature 1..20: note = CRISPR gRNA sequence
  source 1..20: mol_type = other DNA
ttcagcacctcttatatgct

SEQ ID NO: 16922 - DNA, 20 bp, synthetic construct
  misc_feature 1..20: note = CRISPR gRNA sequence
  source 1..20: mol_type = other DNA
cacctcttatatgctcagcg

SEQ ID NO: 16923 - DNA, 20 bp, synthetic construct
  misc_feature 1..20: note = CRISPR gRNA sequence
  source 1..20: mol_type = other DNA
ctcttatatgctcagcgtgg

SEQ ID NO: 16924 - DNA, 20 bp, synthetic construct
  misc_feature 1..20: note = CRISPR gRNA sequence
  source 1..20: mol_type = other DNA
cttatatgctcagcgtggtg

SEQ ID NO: 16925 - DNA, 20 bp, synthetic construct
  misc_feature 1..20: note = CRISPR gRNA sequence
  source 1..20: mol_type = other DNA
tatatgctcagcgtggtgga

SEQ ID NO: 16926 - DNA, 20 bp, synthetic construct
  misc_feature 1..20: note = CRISPR gRNA sequence
  source 1..20: mol_type = other DNA
tatgctcagcgtggtggaga

SEQ ID NO: 16927 - DNA, 20 bp, synthetic construct
  misc_feature 1..20: note = CRISPR gRNA sequence
  source 1..20: mol_type = other DNA
ctcagcgtggtggagagagc

SEQ ID NO: 16928 - DNA, 20 bp, synthetic construct
  misc_feature 1..20: note = CRISPR gRNA sequence
  source 1..20: mol_type = other DNA
aagccacattcccttcctcc

SEQ ID NO: 16929 - DNA, 20 bp, synthetic construct
  misc_feature 1..20: note = CRISPR gRNA sequence
  source 1..20: mol_type = other DNA
agccacattcccttcctcca

SEQ ID NO: 16930 - DNA, 20 bp, synthetic construct
  misc_feature 1..20: note = CRISPR gRNA sequence
  source 1..20: mol_type = other DNA
caaggaacttacaaccatat

SEQ ID NO: 16931 - DNA, 20 bp, synthetic construct
  misc_feature 1..20: note = CRISPR gRNA sequence
  source 1..20: mol_type = other DNA
ggaacttacaaccatatgag

SEQ ID NO: 16932 - DNA, 20 bp, synthetic construct
  misc_feature 1..20: note = CRISPR gRNA sequence
  source 1..20: mol_type = other DNA
caaccatatgagaagatacc

SEQ ID NO: 16933 - DNA, 20 bp, synthetic construct
  misc_feature 1..20: note = CRISPR gRNA sequence
  source 1..20: mol_type = other DNA
aaccatatgagaagataccc

SEQ ID NO: 16934 - DNA, 20 bp, synthetic construct
  misc_feature 1..20: note = CRISPR gRNA sequence
  source 1..20: mol_type = other DNA
ccatatgagaagatacccag

SEQ ID NO: 16935 - DNA, 20 bp, synthetic construct
  misc_feature 1..20: note = CRISPR gRNA sequence
  source 1..20: mol_type = other DNA
catatgagaagatacccagg

SEQ ID NO: 16936 - DNA, 20 bp, synthetic construct
  misc_feature 1..20: note = CRISPR gRNA sequence
  source 1..20: mol_type = other DNA
atgagaagatacccaggagg

SEQ ID NO: 16937 - DNA, 20 bp, synthetic construct
  misc_feature 1..20: note = CRISPR gRNA sequence
  source 1..20: mol_type = other DNA
aagatacccaggaggtagaa

SEQ ID NO: 16938 - DNA, 20 bp, synthetic construct
  misc_feature 1..20: note = CRISPR gRNA sequence
  source 1..20: mol_type = other DNA
agatacccaggaggtagaaa

SEQ ID NO: 16939 - DNA, 20 bp, synthetic construct
  misc_feature 1..20: note = CRISPR gRNA sequence
  source 1..20: mol_type = other DNA
gatacccaggaggtagaaaa

SEQ ID NO: 16940 - DNA, 20 bp, synthetic construct
  misc_feature 1..20: note = CRISPR gRNA sequence
  source 1..20: mol_type = other DNA
caggaggtagaaaagggaac

SEQ ID NO: 16941 - DNA, 20 bp, synthetic construct
  misc_feature 1..20: note = CRISPR gRNA sequence
  source 1..20: mol_type = other DNA
aggtagaaaagggaactgga

SEQ ID NO: 16942 - DNA, 20 bp, synthetic construct
  misc_feature 1..20: note = CRISPR gRNA sequence
  source 1..20: mol_type = other DNA
gaaaagggaactggaaagtg

SEQ ID NO: 16943 - DNA, 20 bp, synthetic construct
  misc_feature 1..20: note = CRISPR gRNA sequence
  source 1..20: mol_type = other DNA
ggattccatcaatctcacac

SEQ ID NO: 16944 - DNA, 20 bp, synthetic construct
  misc_feature 1..20: note = CRISPR gRNA sequence
  source 1..20: mol_type = other DNA
attccatcaatctcacacca

SEQ ID NO: 16945 - DNA, 20 bp, synthetic construct
  misc_feature 1..20: note = CRISPR gRNA sequence
  source 1..20: mol_type = other DNA
tccatcaatctcacaccaga

SEQ ID NO: 16946 - DNA, 20 bp, synthetic construct
  misc_feature 1..20: note = CRISPR gRNA sequence
  source 1..20: mol_type = other DNA
tcaatctcacaccagagagt

SEQ ID NO: 16947 - DNA, 20 bp, synthetic construct
  misc_feature 1..20: note = CRISPR gRNA sequence
  source 1..20: mol_type = other DNA
caatctcacaccagagagtc

SEQ ID NO: 16948 - DNA, 20 bp, synthetic construct
  misc_feature 1..20: note = CRISPR gRNA sequence
  source 1..20: mol_type = other DNA
atctcacaccagagagtcag

SEQ ID NO: 16949 - DNA, 20 bp, synthetic construct
  misc_feature 1..20: note = CRISPR gRNA sequence
  source 1..20: mol_type = other DNA
caggagacccgtcccacatt

SEQ ID NO: 16950 - DNA, 20 bp, synthetic construct
  misc_feature 1..20: note = CRISPR gRNA sequence
  source 1..20: mol_type = other DNA
cccacatttggcaatgccat

SEQ ID NO: 16951 - DNA, 20 bp, synthetic construct
  misc_feature 1..20: note = CRISPR gRNA sequence
  source 1..20: mol_type = other DNA
acatttggcaatgccatgag

SEQ ID NO: 16952 - DNA, 20 bp, synthetic construct
  misc_feature 1..20: note = CRISPR gRNA sequence
  source 1..20: mol_type = other DNA
ggcaatgccatgagtggtaa

SEQ ID NO: 16953 - DNA, 20 bp, synthetic construct
  misc_feature 1..20: note = CRISPR gRNA sequence
  source 1..20: mol_type = other DNA
tgccatgagtggtaacagct

SEQ ID NO: 16954 - DNA, 20 bp, synthetic construct
  misc_feature 1..20: note = CRISPR gRNA sequence
  source 1..20: mol_type = other DNA
gccatgagtggtaacagcta

SEQ ID NO: 16955 - DNA, 20 bp, synthetic construct
  misc_feature 1..20: note = CRISPR gRNA sequence
  source 1..20: mol_type = other DNA
ggtaacagctaaggtttata

SEQ ID NO: 16956 - DNA, 20 bp, synthetic construct
  misc_feature 1..20: note = CRISPR gRNA sequence
  source 1..20: mol_type = other DNA
ataaagcacctcctatacgc

SEQ ID NO: 16957 - DNA, 20 bp, synthetic construct
  misc_feature 1..20: note = CRISPR gRNA sequence
  source 1..20: mol_type = other DNA
taaagcacctcctatacgcc

SEQ ID NO: 16958 - DNA, 20 bp, synthetic construct
  misc_feature 1..20: note = CRISPR gRNA sequence
  source 1..20: mol_type = other DNA
ctcctatacgccaggcacat

SEQ ID NO: 16959 - DNA, 20 bp, synthetic construct
  misc_feature 1..20: note = CRISPR gRNA sequence
  source 1..20: mol_type = other DNA
tatacgccaggcacatgagc

SEQ ID NO: 16960 - DNA, 20 bp, synthetic construct
  misc_feature 1..20: note = CRISPR gRNA sequence
  source 1..20: mol_type = other DNA
ggcacatttaatactcatat

SEQ ID NO: 16961 - DNA, 20 bp, synthetic construct
  misc_feature 1..20: note = CRISPR gRNA sequence
  source 1..20: mol_type = other DNA
actcatatcagtaaccatgt

SEQ ID NO: 16962 - DNA, 20 bp, synthetic construct
  misc_feature 1..20: note = CRISPR gRNA sequence
  source 1..20: mol_type = other DNA
ctcatatcagtaaccatgta

SEQ ID NO: 16963 - DNA, 20 bp, synthetic construct
  misc_feature 1..20: note = CRISPR gRNA sequence
  source 1..20: mol_type = other DNA
atatcagtaaccatgtaagg

SEQ ID NO: 16964 - DNA, 20 bp, synthetic construct
  misc_feature 1..20: note = CRISPR gRNA sequence
  source 1..20: mol_type = other DNA
tatcagtaaccatgtaagga

SEQ ID NO: 16965 - DNA, 20 bp, synthetic construct
  misc_feature 1..20: note = CRISPR gRNA sequence
  source 1..20: mol_type = other DNA
attatcctcactttgcatat

SEQ ID NO: 16966 - DNA, 20 bp, synthetic construct
  misc_feature 1..20: note = CRISPR gRNA sequence
  source 1..20: mol_type = other DNA
actttgcatatgagaaaact

SEQ ID NO: 16967 - DNA, 20 bp, synthetic construct
  misc_feature 1..20: note = CRISPR gRNA sequence
  source 1..20: mol_type = other DNA
ctttgcatatgagaaaactg

SEQ ID NO: 16968 - DNA, 20 bp, synthetic construct
  misc_feature 1..20: note = CRISPR gRNA sequence
  source 1..20: mol_type = other DNA
catatgagaaaactgaggct

SEQ ID NO: 16969 - DNA, 20 bp, synthetic construct
  misc_feature 1..20: note = CRISPR gRNA sequence
  source 1..20: mol_type = other DNA
tatgagaaaactgaggctca

SEQ ID NO: 16970 - DNA, 20 bp, synthetic construct
  misc_feature 1..20: note = CRISPR gRNA sequence
  source 1..20: mol_type = other DNA
tgagaaaactgaggctcaga

SEQ ID NO: 16971 - DNA, 20 bp, synthetic construct
  misc_feature 1..20: note = CRISPR gRNA sequence
  source 1..20: mol_type = other DNA
gagaaaactgaggctcagag

SEQ ID NO: 16972 - DNA, 20 bp, synthetic construct
  misc_feature 1..20: note = CRISPR gRNA sequence
  source 1..20: mol_type = other DNA
aactgaggctcagagaggtg

SEQ ID NO: 16973 - DNA, 20 bp, synthetic construct
  misc_feature 1..20: note = CRISPR gRNA sequence
  source 1..20: mol_type = other DNA
agaggtgaagtgatttatgt

SEQ ID NO: 16974 - DNA, 20 bp, synthetic construct
  misc_feature 1..20: note = CRISPR gRNA sequence
  source 1..20: mol_type = other DNA
gaggtgaagtgatttatgta

SEQ ID NO: 16975 - DNA, 20 bp, synthetic construct
  misc_feature 1..20: note = CRISPR gRNA sequence
  source 1..20: mol_type = other DNA
atgtaaggaaacccatgtcc

SEQ ID NO: 16976 - DNA, 20 bp, synthetic construct
  misc_feature 1..20: note = CRISPR gRNA sequence
  source 1..20: mol_type = other DNA
taaggaaacccatgtccaag

SEQ ID NO: 16977 - DNA, 20 bp, synthetic construct
  misc_feature 1..20: note = CRISPR gRNA sequence
  source 1..20: mol_type = other DNA
aacccatgtccaagtggaac

SEQ ID NO: 16978 - DNA, 20 bp, synthetic construct
  misc_feature 1..20: note = CRISPR gRNA sequence
  source 1..20: mol_type = other DNA
acccatgtccaagtggaacc

SEQ ID NO: 16979 - DNA, 20 bp, synthetic construct
  misc_feature 1..20: note = CRISPR gRNA sequence
  source 1..20: mol_type = other DNA
gtggaaccaggatttgaacc

SEQ ID NO: 16980 - DNA, 20 bp, synthetic construct
  misc_feature 1..20: note = CRISPR gRNA sequence
  source 1..20: mol_type = other DNA
aaccaggatttgaacccaga

SEQ ID NO: 16981 - DNA, 20 bp, synthetic construct
  misc_feature 1..20: note = CRISPR gRNA sequence
  source 1..20: mol_type = other DNA
gaacccagacagtctgactg

SEQ ID NO: 16982 - DNA, 20 bp, synthetic construct
  misc_feature 1..20: note = CRISPR gRNA sequence
  source 1..20: mol_type = other DNA
accacaatgctctactgctt

SEQ ID NO: 16983 - DNA, 20 bp, synthetic construct
  misc_feature 1..20: note = CRISPR gRNA sequence
  source 1..20: mol_type = other DNA
ccacaatgctctactgcttt

SEQ ID NO: 16984 - DNA, 20 bp, synthetic construct
  misc_feature 1..20: note = CRISPR gRNA sequence
  source 1..20: mol_type = other DNA
caatgctctactgctttggg

SEQ ID NO: 16985 - DNA, 20 bp, synthetic construct
  misc_feature 1..20: note = CRISPR gRNA sequence
  source 1..20: mol_type = other DNA
ctactgctttgggtggactt

SEQ ID NO: 16986 - DNA, 20 bp, synthetic construct
  misc_feature 1..20: note = CRISPR gRNA sequence
  source 1..20: mol_type = other DNA
tgctttgggtggacttgagc

SEQ ID NO: 16987 - DNA, 20 bp, synthetic construct
  misc_feature 1..20: note = CRISPR gRNA sequence
  source 1..20: mol_type = other DNA
ctctgctcctttctgtgcct

SEQ ID NO: 16988 - DNA, 20 bp, synthetic construct
  misc_feature 1..20: note = CRISPR gRNA sequence
  source 1..20: mol_type = other DNA
gtttcctaatatgtaaactg

SEQ ID NO: 16989 - DNA, 20 bp, synthetic construct
  misc_feature 1..20: note = CRISPR gRNA sequence
  source 1..20: mol_type = other DNA
tttcctaatatgtaaactga

SEQ ID NO: 16990 - DNA, 20 bp, synthetic construct
  misc_feature 1..20: note = CRISPR gRNA sequence
  source 1..20: mol_type = other DNA
tcctaatatgtaaactgaag

SEQ ID NO: 16991 - DNA, 20 bp, synthetic construct
  misc_feature 1..20: note = CRISPR gRNA sequence
  source 1..20: mol_type = other DNA
tatgtaaactgaaggagtct

SEQ ID NO: 16992 - DNA, 20 bp, synthetic construct
  misc_feature 1..20: note = CRISPR gRNA sequence
  source 1..20: mol_type = other DNA
gtaaactgaaggagtctgag

SEQ ID NO: 16993 - DNA, 20 bp, synthetic construct
  misc_feature 1..20: note = CRISPR gRNA sequence
  source 1..20: mol_type = other DNA
aaggagtctgagcagattct

SEQ ID NO: 16994 - DNA, 20 bp, synthetic construct
  misc_feature 1..20: note = CRISPR gRNA sequence
  source 1..20: mol_type = other DNA
gatttcctcatcatttgttg

SEQ ID NO: 16995 - DNA, 20 bp, synthetic construct
  misc_feature 1..20: note = CRISPR gRNA sequence
  source 1..20: mol_type = other DNA
atttcctcatcatttgttga

SEQ ID NO: 16996 - DNA, 20 bp, synthetic construct
  misc_feature 1..20: note = CRISPR gRNA sequence
  source 1..20: mol_type = other DNA
tttcctcatcatttgttgaa

SEQ ID NO: 16997 - DNA, 20 bp, synthetic construct
  misc_feature 1..20: note = CRISPR gRNA sequence
  source 1..20: mol_type = other DNA
tctttaaacaatcccaaatg

SEQ ID NO: 16998 - DNA, 20 bp, synthetic construct
  misc_feature 1..20: note = CRISPR gRNA sequence
  source 1..20: mol_type = other DNA
attatgtattaataaaacaa

SEQ ID NO: 16999 - DNA, 20 bp, synthetic construct
  misc_feature 1..20: note = CRISPR gRNA sequence
  source 1..20: mol_type = other DNA
ttaataaaacaaaagaaaac

SEQ ID NO: 17000 - DNA, 20 bp, synthetic construct
  misc_feature 1..20: note = CRISPR gRNA sequence
  source 1..20: mol_type = other DNA
caaaagaaaacaagaaaaac

SEQ ID NO: 17001 - DNA, 20 bp, synthetic construct
  misc_feature 1..20: note = CRISPR gRNA sequence
  source 1..20: mol_type = other DNA
aacctatacacgaatgttca

SEQ ID NO: 17002 - DNA, 20 bp, synthetic construct
  misc_feature 1..20: note = CRISPR gRNA sequence
  source 1..20: mol_type = other DNA
ctatacacgaatgttcacag

SEQ ID NO: 17003 - DNA, 20 bp, synthetic construct
  misc_feature 1..20: note = CRISPR gRNA sequence
  source 1..20: mol_type = other DNA
tatacacgaatgttcacaga

SEQ ID NO: 17004 - DNA, 20 bp, synthetic construct
  misc_feature 1..20: note = CRISPR gRNA sequence
  source 1..20: mol_type = other DNA
cacagaaggataattcaaaa

SEQ ID NO: 17005 - DNA, 20 bp, synthetic construct
  misc_feature 1..20: note = CRISPR gRNA sequence
  source 1..20: mol_type = other DNA
aaatagccaaaatataaaaa

SEQ ID NO: 17006 - DNA, 20 bp, synthetic construct
  misc_feature 1..20: note = CRISPR gRNA sequence
  source 1..20: mol_type = other DNA
aatatccaccaaaaaataaa

SEQ ID NO: 17007 - DNA, 20 bp, synthetic construct
  misc_feature 1..20: note = CRISPR gRNA sequence
  source 1..20: mol_type = other DNA
tgttgcttatctatacaata

SEQ ID NO: 17008 - DNA, 20 bp, synthetic construct
  misc_feature 1..20: note = CRISPR gRNA sequence
  source 1..20: mol_type = other DNA
aataaagtattccaccatta

SEQ ID NO: 17009 - DNA, 20 bp, synthetic construct
  misc_feature 1..20: note = CRISPR gRNA sequence
  source 1..20: mol_type = other DNA
ataaagtattccaccattaa

SEQ ID NO: 17010 - DNA, 20 bp, synthetic construct
  misc_feature 1..20: note = CRISPR gRNA sequence
  source 1..20: mol_type = other DNA
taaagtattccaccattaaa

SEQ ID NO: 17011 - DNA, 20 bp, synthetic construct
  misc_feature 1..20: note = CRISPR gRNA sequence
  source 1..20: mol_type = other DNA
aagtattccaccattaaagg

SEQ ID NO: 17012 - DNA, 20 bp, synthetic construct
  misc_feature 1..20: note = CRISPR gRNA sequence
  source 1..20: mol_type = other DNA
attccaccattaaagggaga

SEQ ID NO: 17013 - DNA, 20 bp, synthetic construct
  misc_feature 1..20: note = CRISPR gRNA sequence
  source 1..20: mol_type = other DNA
gagaaagcactgatacatgc

SEQ ID NO: 17014 - DNA, 20 bp, synthetic construct
  misc_feature 1..20: note = CRISPR gRNA sequence
  source 1..20: mol_type = other DNA
cactgatacatgctggaaca

SEQ ID NO: 17015 - DNA, 20 bp, synthetic construct
  misc_feature 1..20: note = CRISPR gRNA sequence
  source 1..20: mol_type = other DNA
tgaaccttaaaaaaaatgct

SEQ ID NO: 17016 - DNA, 20 bp, synthetic construct
  misc_feature 1..20: note = CRISPR gRNA sequence
  source 1..20: mol_type = other DNA
cttaaaaaaaatgctaagtg

SEQ ID NO: 17017 - DNA, 20 bp, synthetic construct
  misc_feature 1..20: note = CRISPR gRNA sequence
  source 1..20: mol_type = other DNA
aaaaaaaatgctaagtgaag

SEQ ID NO: 17018 - DNA, 20 bp, synthetic construct
  misc_feature 1..20: note = CRISPR gRNA sequence
  source 1..20: mol_type = other DNA
aaaatgctaagtgaagaagc

SEQ ID NO: 17019 - DNA, 20 bp, synthetic construct
  misc_feature 1..20: note = CRISPR gRNA sequence
  source 1..20: mol_type = other DNA
aagtgaagaagccggacaca

SEQ ID NO: 17020 - DNA, 20 bp, synthetic construct
  misc_feature 1..20: note = CRISPR gRNA sequence
  source 1..20: mol_type = other DNA
agtgaagaagccggacacaa

SEQ ID NO: 17021 - DNA, 20 bp, synthetic construct
  misc_feature 1..20: note = CRISPR gRNA sequence
  source 1..20: mol_type = other DNA
gtgaagaagccggacacaaa

SEQ ID NO: 17022 - DNA, 20 bp, synthetic construct
  misc_feature 1..20: note = CRISPR gRNA sequence
  source 1..20: mol_type = other DNA
tttatttgaaatgaccaaaa

SEQ ID NO: 17023 - DNA, 20 bp, synthetic construct
  misc_feature 1..20: note = CRISPR gRNA sequence
  source 1..20: mol_type = other DNA
ttatttgaaatgaccaaaac

SEQ ID NO: 17024 - DNA, 20 bp, synthetic construct
  misc_feature 1..20: note = CRISPR gRNA sequence
  source 1..20: mol_type = other DNA
gaccaaaacaggcaaatcca

SEQ ID NO: 17025 - DNA, 20 bp, synthetic construct
  misc_feature 1..20: note = CRISPR gRNA sequence
  source 1..20: mol_type = other DNA
ccaaaacaggcaaatccatg

SEQ ID NO: 17026 - DNA, 20 bp, synthetic construct
  misc_feature 1..20: note = CRISPR gRNA sequence
  source 1..20: mol_type = other DNA
ggcaaatccatggagacata

SEQ ID NO: 17027 - DNA, 20 bp, synthetic construct
  misc_feature 1..20: note = CRISPR gRNA sequence
  source 1..20: mol_type = other DNA
aaatccatggagacataaag

SEQ ID NO: 17028 - DNA, 20 bp, synthetic construct
  misc_feature 1..20: note = CRISPR gRNA sequence
  source 1..20: mol_type = other DNA
aatccatggagacataaagt

SEQ ID NO: 17029 - DNA, 20 bp, synthetic construct
  misc_feature 1..20: note = CRISPR gRNA sequence
  source 1..20: mol_type = other DNA
tccatggagacataaagtag

SEQ ID NO: 17030 - DNA, 20 bp, synthetic construct
  misc_feature 1..20: note = CRISPR gRNA sequence
  source 1..20: mol_type = other DNA
ccatggagacataaagtagg

SEQ ID NO: 17031 - DNA, 20 bp, synthetic construct
  misc_feature 1..20: note = CRISPR gRNA sequence
  source 1..20: mol_type = other DNA
catggagacataaagtagga

SEQ ID NO: 17032 - DNA, 20 bp, synthetic construct
  misc_feature 1..20: note = CRISPR gRNA sequence
  source 1..20: mol_type = other DNA
atggagacataaagtaggag

SEQ ID NO: 17033 - DNA, 20 bp, synthetic construct
  misc_feature 1..20: note = CRISPR gRNA sequence
  source 1..20: mol_type = other DNA
gagacataaagtaggagggg

SEQ ID NO: 17034 - DNA, 20 bp, synthetic construct
  misc_feature 1..20: note = CRISPR gRNA sequence
  source 1..20: mol_type = other DNA
agacataaagtaggaggggt

SEQ ID NO: 17035 - DNA, 20 bp, synthetic construct
  misc_feature 1..20: note = CRISPR gRNA sequence
  source 1..20: mol_type = other DNA
gacataaagtaggaggggtg

SEQ ID NO: 17036 - DNA, 20 bp, synthetic construct
  misc_feature 1..20: note = CRISPR gRNA sequence
  source 1..20: mol_type = other DNA
aaagtaggaggggtggggcg

SEQ ID NO: 17037 - DNA, 20 bp, synthetic construct
  misc_feature 1..20: note = CRISPR gRNA sequence
  source 1..20: mol_type = other DNA
gtaggaggggtggggcgtgg

SEQ ID NO: 17038 - DNA, 20 bp, synthetic construct
  misc_feature 1..20: note = CRISPR gRNA sequence
  source 1..20: mol_type = other DNA
gtggctcatgcctgaaatcc

SEQ ID NO: 17039 - DNA, 20 bp, synthetic construct
  misc_feature 1..20: note = CRISPR gRNA sequence
  source 1..20: mol_type = other DNA
tgcctgaaatcccagcactt

SEQ ID NO: 17040 - DNA, 20 bp, synthetic construct
  misc_feature 1..20: note = CRISPR gRNA sequence
  source 1..20: mol_type = other DNA
gcctgaaatcccagcacttt

SEQ ID NO: 17041 - DNA, 20 bp, synthetic construct
  misc_feature 1..20: note = CRISPR gRNA sequence
  source 1..20: mol_type = other DNA
ctgaaatcccagcactttgg

SEQ ID NO: 17042 - DNA, 20 bp, synthetic construct
  misc_feature 1..20: note = CRISPR gRNA sequence
  source 1..20: mol_type = other DNA
tgaaatcccagcactttggg

SEQ ID NO: 17043 - DNA, 20 bp, synthetic construct
  misc_feature 1..20: note = CRISPR gRNA sequence
  source 1..20: mol_type = other DNA
tcccagcactttgggaggct

SEQ ID NO: 17044 - DNA, 20 bp, synthetic construct
  misc_feature 1..20: note = CRISPR gRNA sequence
  source 1..20: mol_type = other DNA
agcactttgggaggctgaga

SEQ ID NO: 17045 - DNA, 20 bp, synthetic construct
  misc_feature 1..20: note = CRISPR gRNA sequence
  source 1..20: mol_type = other DNA
gcactttgggaggctgagac

SEQ ID NO: 17046 - DNA, 20 bp, synthetic construct
  misc_feature 1..20: note = CRISPR gRNA sequence
  source 1..20: mol_type = other DNA
actttgggaggctgagacag

SEQ ID NO: 17047 - DNA, 20 bp, synthetic construct
  misc_feature 1..20: note = CRISPR gRNA sequence
  source 1..20: mol_type = other DNA
ctgagacaggagaatcgctt

SEQ ID NO: 17048 - DNA, 20 bp, synthetic construct
  misc_feature 1..20: note = CRISPR gRNA sequence
  source 1..20: mol_type = other DNA
acaggagaatcgcttgagcc

SEQ ID NO: 17049 - DNA, 20 bp, synthetic construct
  misc_feature 1..20: note = CRISPR gRNA sequence
  source 1..20: mol_type = other DNA
caggagaatcgcttgagccc

SEQ ID NO: 17050 - DNA, 20 bp, synthetic construct
  misc_feature 1..20: note = CRISPR gRNA sequence
  source 1..20: mol_type = other DNA
tcgcttgagcccaggtgttc

SEQ ID NO: 17051 - DNA, 20 bp, synthetic construct
  misc_feature 1..20: note = CRISPR gRNA sequence
  source 1..20: mol_type = other DNA
tgagcccaggtgttcaagac

SEQ ID NO: 17052 - DNA, 20 bp, synthetic construct
  misc_feature 1..20: note = CRISPR gRNA sequence
  source 1..20: mol_type = other DNA
ccaggtgttcaagaccagcc

SEQ ID NO: 17053 - DNA, 20 bp, synthetic construct
  misc_feature 1..20: note = CRISPR gRNA sequence
  source 1..20: mol_type = other DNA
caggtgttcaagaccagcct

SEQ ID NO: 17054 - DNA, 20 bp, synthetic construct
  misc_feature 1..20: note = CRISPR gRNA sequence
  source 1..20: mol_type = other DNA
caagaccagcctgggcaaca

SEQ ID NO: 17055 - DNA, 20 bp, synthetic construct
  misc_feature 1..20: note = CRISPR gRNA sequence
  source 1..20: mol_type = other DNA
cagcctgggcaacatagcaa

SEQ ID NO: 17056 - DNA, 20 bp, synthetic construct
  misc_feature 1..20: note = CRISPR gRNA sequence
  source 1..20: mol_type = other DNA
atctctattaattttttttt

SEQ ID NO: 17057 - DNA, 20 bp, synthetic construct
  misc_feature 1..20: note = CRISPR gRNA sequence
  source 1..20: mol_type = other DNA
ctattaatttttttttaaga

SEQ ID NO: 17058 - DNA, 20 bp, synthetic construct
  misc_feature 1..20: note = CRISPR gRNA sequence
  source 1..20: mol_type = other DNA
taatttttttttaagaaaga

SEQ ID NO: 17059 - DNA, 20 bp, synthetic construct
  misc_feature 1..20: note = CRISPR gRNA sequence
  source 1..20: mol_type = other DNA
ttttaagaaagaaagcatat

SEQ ID NO: 17060 - DNA, 20 bp, synthetic construct
  misc_feature 1..20: note = CRISPR gRNA sequence
  source 1..20: mol_type = other DNA
taagaaagaaagcatattag

SEQ ID NO: 17061 - DNA, 20 bp, synthetic construct
  misc_feature 1..20: note = CRISPR gRNA sequence
  source 1..20: mol_type = other DNA
aaagcatattagtggttgcc

SEQ ID NO: 17062 - DNA, 20 bp, synthetic construct
  misc_feature 1..20: note = CRISPR gRNA sequence
  source 1..20: mol_type = other DNA
aagcatattagtggttgcct

SEQ ID NO: 17063 - DNA, 20 bp, synthetic construct
  misc_feature 1..20: note = CRISPR gRNA sequence
  source 1..20: mol_type = other DNA
agcatattagtggttgccta

SEQ ID NO: 17064 - DNA, 20 bp, synthetic construct
  misc_feature 1..20: note = CRISPR gRNA sequence
  source 1..20: mol_type = other DNA
attagtggttgcctagggct

SEQ ID NO: 17065 - DNA, 20 bp, synthetic construct
  misc_feature 1..20: note = CRISPR gRNA sequence
  source 1..20: mol_type = other DNA
agtggttgcctagggcttgg

SEQ ID NO: 17066 - DNA, 20 bp, synthetic construct
  misc_feature 1..20: note = CRISPR gRNA sequence
  source 1..20: mol_type = other DNA
tggttgcctagggcttggca

SEQ ID NO: 17067 - DNA, 20 bp, synthetic construct
  misc_feature 1..20: note = CRISPR gRNA sequence
  source 1..20: mol_type = other DNA
gttgcctagggcttggcaga

SEQ ID NO: 17068 - DNA, 20 bp, synthetic construct
  misc_feature 1..20: note = CRISPR gRNA sequence
  source 1..20: mol_type = other DNA
ttgcctagggcttggcagag

SEQ ID NO: 17069 - DNA, 20 bp, synthetic construct
  misc_feature 1..20: note = CRISPR gRNA sequence
  source 1..20: mol_type = other DNA
tgcctagggcttggcagaga

SEQ ID NO: 17070 - DNA, 20 bp, synthetic construct
  misc_feature 1..20: note = CRISPR gRNA sequence
  source 1..20: mol_type = other DNA
ggcttggcagagagggattt

SEQ ID NO: 17071 - DNA, 20 bp, synthetic construct
  misc_feature 1..20: note = CRISPR gRNA sequence
  source 1..20: mol_type = other DNA
ttggcagagagggattttgg

SEQ ID NO: 17072 - DNA, 20 bp, synthetic construct
  misc_feature 1..20: note = CRISPR gRNA sequence
  source 1..20: mol_type = other DNA
tggcagagagggattttgga

SEQ ID NO: 17073 - DNA, 20 bp, synthetic construct
  misc_feature 1..20: note = CRISPR gRNA sequence
  source 1..20: mol_type = other DNA
agagggattttggaaggaaa

SEQ ID NO: 17074 - DNA, 20 bp, synthetic construct
  misc_feature 1..20: note = CRISPR gRNA sequence
  source 1..20: mol_type = other DNA
gagggattttggaaggaaat

SEQ ID NO: 17075 - DNA, 20 bp, synthetic construct
  misc_feature 1..20: note = CRISPR gRNA sequence
  source 1..20: mol_type = other DNA
agggattttggaaggaaatg

SEQ ID NO: 17076 - DNA, 20 bp, synthetic construct
  misc_feature 1..20: note = CRISPR gRNA sequence
  source 1..20: mol_type = other DNA
aaatggggaacaactgctga

SEQ ID NO: 17077 - DNA, 20 bp, synthetic construct
  misc_feature 1..20: note = CRISPR gRNA sequence
  source 1..20: mol_type = other DNA
aatggggaacaactgctgat

SEQ ID NO: 17078 - DNA, 20 bp, synthetic construct
  misc_feature 1..20: note = CRISPR gRNA sequence
  source 1..20: mol_type = other DNA
ggaacaactgctgatgggtc

SEQ ID NO: 17079 - DNA, 20 bp, synthetic construct
  misc_feature 1..20: note = CRISPR gRNA sequence
  source 1..20: mol_type = other DNA
aacaactgctgatgggtctg

SEQ ID NO: 17080 - DNA, 20 bp, synthetic construct
  misc_feature 1..20: note = CRISPR gRNA sequence
  source 1..20: mol_type = other DNA
tgatgggtctggagtttctt

SEQ ID NO: 17081 - DNA, 20 bp, synthetic construct
  misc_feature 1..20: note = CRISPR gRNA sequence
  source 1..20: mol_type = other DNA
gatgggtctggagtttcttt

SEQ ID NO: 17082 - DNA, 20 bp, synthetic construct
  misc_feature 1..20: note = CRISPR gRNA sequence
  source 1..20: mol_type = other DNA
atgggtctggagtttcttta

SEQ ID NO: 17083 - DNA, 20 bp, synthetic construct
  misc_feature 1..20: note = CRISPR gRNA sequence
  source 1..20: mol_type = other DNA
tgggtctggagtttctttag

SEQ ID NO: 17084 - DNA, 20 bp, synthetic construct
  misc_feature 1..20: note = CRISPR gRNA sequence
  source 1..20: mol_type = other DNA
gggtctggagtttctttagg

SEQ ID NO: 17085 - DNA, 20 bp, synthetic construct
  misc_feature 1..20: note = CRISPR gRNA sequence
  source 1..20: mol_type = other DNA
aaatgtgctaaaattgactg

SEQ ID NO: 17086 - DNA, 20 bp, synthetic construct
  misc_feature 1..20: note = CRISPR gRNA sequence
  source 1..20: mol_type = other DNA
aatgtgctaaaattgactgt

SEQ ID NO: 17087 - DNA, 20 bp, synthetic construct
  misc_feature 1..20: note = CRISPR gRNA sequence
  source 1..20: mol_type = other DNA
atgtgctaaaattgactgtg

SEQ ID NO: 17088 - DNA, 20 bp, synthetic construct
  misc_feature 1..20: note = CRISPR gRNA sequence
  source 1..20: mol_type = other DNA
gctaaaattgactgtgggga

SEQ ID NO: 17089 - DNA, 20 bp, synthetic construct
  misc_feature 1..20: note = CRISPR gRNA sequence
  source 1..20: mol_type = other DNA
ctaaaattgactgtggggat

SEQ ID NO: 17090 - DNA, 20 bp, synthetic construct
  misc_feature 1..20: note = CRISPR gRNA sequence
  source 1..20: mol_type = other DNA
aaaattgactgtggggatgg

SEQ ID NO: 17091 - DNA, 20 bp, synthetic construct
  misc_feature 1..20: note = CRISPR gRNA sequence
  source 1..20: mol_type = other DNA
ttgactgtggggatgggaga

SEQ ID NO: 17092 - DNA, 20 bp, synthetic construct
  misc_feature 1..20: note = CRISPR gRNA sequence
  source 1..20: mol_type = other DNA
agatggtcacacaactctct

SEQ ID NO: 17093 - DNA, 20 bp, synthetic construct
  misc_feature 1..20: note = CRISPR gRNA sequence
  source 1..20: mol_type = other DNA
aactctctgagtattcccaa

SEQ ID NO: 17094 - DNA, 20 bp, synthetic construct
  misc_feature 1..20: note = CRISPR gRNA sequence
  source 1..20: mol_type = other DNA
tttttttttttttttttttt

SEQ ID NO: 17095 - DNA, 20 bp, synthetic construct
  misc_feature 1..20: note = CRISPR gRNA sequence
  source 1..20: mol_type = other DNA
ttttttttttttttttaaga

SEQ ID NO: 17096 - DNA, 20 bp, synthetic construct
  misc_feature 1..20: note = CRISPR gRNA sequence
  source 1..20: mol_type = other DNA
ttttttttttttttaagacg

SEQ ID NO: 17097 - DNA, 20 bp, synthetic construct
  misc_feature 1..20: note = CRISPR gRNA sequence
  source 1..20: mol_type = other DNA
aagacggagtctctgtcacc

SEQ ID NO: 17098 - DNA, 20 bp, synthetic construct
  misc_feature 1..20: note = CRISPR gRNA sequence
  source 1..20: mol_type = other DNA
agacggagtctctgtcaccc

SEQ ID NO: 17099 - DNA, 20 bp, synthetic construct
  misc_feature 1..20: note = CRISPR gRNA sequence
  source 1..20: mol_type = other DNA
ggagtctctgtcacccaggc

SEQ ID NO: 17100 - DNA, 20 bp, synthetic construct
  misc_feature 1..20: note = CRISPR gRNA sequence
  source 1..20: mol_type = other DNA
agtctctgtcacccaggctg

SEQ ID NO: 17101 - DNA, 20 bp, synthetic construct
  misc_feature 1..20: note = CRISPR gRNA sequence
  source 1..20: mol_type = other DNA
ctgtcacccaggctggagtg

SEQ ID NO: 17102 - DNA, 20 bp, synthetic construct
  misc_feature 1..20: note = CRISPR gRNA sequence
  source 1..20: mol_type = other DNA
tgtcacccaggctggagtgc

SEQ ID NO: 17103 - DNA, 20 bp, synthetic construct
  misc_feature 1..20: note = CRISPR gRNA sequence
  source 1..20: mol_type = other DNA
gtcacccaggctggagtgca

SEQ ID NO: 17104 - DNA, 20 bp, synthetic construct
  misc_feature 1..20: note = CRISPR gRNA sequence
  source 1..20: mol_type = other DNA
tcacccaggctggagtgcag

SEQ ID NO: 17105 - DNA, 20 bp, synthetic construct
  misc_feature 1..20: note = CRISPR gRNA sequence
  source 1..20: mol_type = other DNA
ggagtgcaggggtgcaatct

SEQ ID NO: 17106 - DNA, 20 bp, synthetic construct
  misc_feature 1..20: note = CRISPR gRNA sequence
  source 1..20: mol_type = other DNA
tcactgcaacgtctgcctcc

SEQ ID NO: 17107 - DNA, 20 bp, synthetic construct
  misc_feature 1..20: note = CRISPR gRNA sequence
  source 1..20: mol_type = other DNA
cactgcaacgtctgcctccc

SEQ ID NO: 17108 - DNA, 20 bp, synthetic construct
  misc_feature 1..20: note = CRISPR gRNA sequence
  source 1..20: mol_type = other DNA
aacgtctgcctcccaggttc

SEQ ID NO: 17109 - DNA, 20 bp, synthetic construct
  misc_feature 1..20: note = CRISPR gRNA sequence
  source 1..20: mol_type = other DNA
ttcaagccattcttctgcct

SEQ ID NO: 17110 - DNA, 20 bp, synthetic construct
  misc_feature 1..20: note = CRISPR gRNA sequence
  source 1..20: mol_type = other DNA
ttcttctgcctcagcctcct

SEQ ID NO: 17111 - DNA, 20 bp, synthetic construct
  misc_feature 1..20: note = CRISPR gRNA sequence
  source 1..20: mol_type = other DNA
ttctgcctcagcctcctgag

SEQ ID NO: 17112 - DNA, 20 bp, synthetic construct
  misc_feature 1..20: note = CRISPR gRNA sequence
  source 1..20: mol_type = other DNA
gcctcagcctcctgagcagc

SEQ ID NO: 17113 - DNA, 20 bp, synthetic construct
  misc_feature 1..20: note = CRISPR gRNA sequence
  source 1..20: mol_type = other DNA
cctcagcctcctgagcagct

SEQ ID NO: 17114 - DNA, 20 bp, synthetic construct
  misc_feature 1..20: note = CRISPR gRNA sequence
  source 1..20: mol_type = other DNA
ctcctgagcagctgggatta

SEQ ID NO: 17115 - DNA, 20 bp, synthetic construct
  misc_feature 1..20: note = CRISPR gRNA sequence
  source 1..20: mol_type = other DNA
tcctgagcagctgggattac

SEQ ID NO: 17116 - DNA, 20 bp, synthetic construct
  misc_feature 1..20: note = CRISPR gRNA sequence
  source 1..20: mol_type = other DNA
caggcacccaccaccacacc

SEQ ID NO: 17117 - DNA, 20 bp, synthetic construct
  misc_feature 1..20: note = CRISPR gRNA sequence
  source 1..20: mol_type = other DNA
ccggctaatttttgcatttt

SEQ ID NO: 17118 - DNA, 20 bp, synthetic construct
  misc_feature 1..20: note = CRISPR gRNA sequence
  source 1..20: mol_type = other DNA
gctaatttttgcatttttag

SEQ ID NO: 17119 - DNA, 20 bp, synthetic construct
  misc_feature 1..20: note = CRISPR gRNA sequence
  source 1..20: mol_type = other DNA
taatttttgcatttttagta

SEQ ID NO: 17120 - DNA, 20 bp, synthetic construct
  misc_feature 1..20: note = CRISPR gRNA sequence
  source 1..20: mol_type = other DNA
ttttgcatttttagtagaga

SEQ ID NO: 17121 - DNA, 20 bp, synthetic construct
  misc_feature 1..20: note = CRISPR gRNA sequence
  source 1..20: mol_type = other DNA
gagacagtgtttcaccattt

SEQ ID NO: 17122 - DNA, 20 bp, synthetic construct
  misc_feature 1..20: note = CRISPR gRNA sequence
  source 1..20: mol_type = other DNA
cagtgtttcaccattttggc

SEQ ID NO: 17123 - DNA, 20 bp, synthetic construct
  misc_feature 1..20: note = CRISPR gRNA sequence
  source 1..20: mol_type = other DNA
agtgtttcaccattttggcc

SEQ ID NO: 17124 - DNA, 20 bp, synthetic construct
  misc_feature 1..20: note = CRISPR gRNA sequence
  source 1..20: mol_type = other DNA
gttctcaaactcctgacctc

SEQ ID NO: 17125 - DNA, 20 bp, synthetic construct
  misc_feature 1..20: note = CRISPR gRNA sequence
  source 1..20: mol_type = other DNA
aagtgatccgcctgtctcct

SEQ ID NO: 17126 - DNA, 20 bp, synthetic construct
  misc_feature 1..20: note = CRISPR gRNA sequence
  source 1..20: mol_type = other DNA
cctgtctcctcggcctccca

SEQ ID NO: 17127 - DNA, 20 bp, synthetic construct
  misc_feature 1..20: note = CRISPR gRNA sequence
  source 1..20: mol_type = other DNA
tcctcggcctcccaaagtgt

SEQ ID NO: 17128 - DNA, 20 bp, synthetic construct
  misc_feature 1..20: note = CRISPR gRNA sequence
  source 1..20: mol_type = other DNA
cctcggcctcccaaagtgtt

SEQ ID NO: 17129 - DNA, 20 bp, synthetic construct
  misc_feature 1..20: note = CRISPR gRNA sequence
  source 1..20: mol_type = other DNA
ctcccaaagtgttgggatta

SEQ ID NO: 17130 - DNA, 20 bp, synthetic construct
  misc_feature 1..20: note = CRISPR gRNA sequence
  source 1..20: mol_type = other DNA
tcccaaagtgttgggattac

SEQ ID NO: 17131 - DNA, 20 bp, synthetic construct
  misc_feature 1..20: note = CRISPR gRNA sequence
  source 1..20: mol_type = other DNA
aggcatgaactgtacttttt

SEQ ID NO: 17132 - DNA, 20 bp, synthetic construct
  misc_feature 1..20: note = CRISPR gRNA sequence
  source 1..20: mol_type = other DNA
catgaactgtactttttaag

SEQ ID NO: 17133 - DNA, 20 bp, synthetic construct
  misc_feature 1..20: note = CRISPR gRNA sequence
  source 1..20: mol_type = other DNA
atgaactgtactttttaagt

SEQ ID NO: 17134 - DNA, 20 bp, synthetic construct
  misc_feature 1..20: note = CRISPR gRNA sequence
  source 1..20: mol_type = other DNA
atgtgaattacatctcaata

SEQ ID NO: 17135 - DNA, 20 bp, synthetic construct
  misc_feature 1..20: note = CRISPR gRNA sequence
  source 1..20: mol_type = other DNA
tcaataaagctgttaaaacc

SEQ ID NO: 17136 - DNA, 20 bp, synthetic construct
  misc_feature 1..20: note = CRISPR gRNA sequence
  source 1..20: mol_type = other DNA
caataaagctgttaaaacct

SEQ ID NO: 17137 - DNA, 20 bp, synthetic construct
  misc_feature 1..20: note = CRISPR gRNA sequence
  source 1..20: mol_type = other DNA
taaagctgttaaaacctagg

SEQ ID NO: 17138 - DNA, 20 bp, synthetic construct
  misc_feature 1..20: note = CRISPR gRNA sequence
  source 1..20: mol_type = other DNA
gctgttaaaacctaggaagt

SEQ ID NO: 17139 - DNA, 20 bp, synthetic construct
  misc_feature 1..20: note = CRISPR gRNA sequence
  source 1..20: mol_type = other DNA
gtaagcattattgtctccat

SEQ ID NO: 17140 - DNA, 20 bp, synthetic construct
  misc_feature 1..20: note = CRISPR gRNA sequence
  source 1..20: mol_type = other DNA
agcattattgtctccattgg

SEQ ID NO: 17141 - DNA, 20 bp, synthetic construct
  misc_feature 1..20: note = CRISPR gRNA sequence
  source 1..20: mol_type = other DNA
attgtctccattggcagatg

SEQ ID NO: 17142 - DNA, 20 bp, synthetic construct
  misc_feature 1..20: note = CRISPR gRNA sequence
  source 1..20: mol_type = other DNA
cattggcagatgaagaactt

SEQ ID NO: 17143 - DNA, 20 bp, synthetic construct
  misc_feature 1..20: note = CRISPR gRNA sequence
  source 1..20: mol_type = other DNA
cagatgaagaacttgagacc

SEQ ID NO: 17144 - DNA, 20 bp, synthetic construct
  misc_feature 1..20: note = CRISPR gRNA sequence
  source 1..20: mol_type = other DNA
gatgaagaacttgagaccca

SEQ ID NO: 17145 - DNA, 20 bp, synthetic construct
  misc_feature 1..20: note = CRISPR gRNA sequence
  source 1..20: mol_type = other DNA
gaagaacttgagacccagag

SEQ ID NO: 17146 - DNA, 20 bp, synthetic construct
  misc_feature 1..20: note = CRISPR gRNA sequence
  source 1..20: mol_type = other DNA
acttgagacccagagaagac

SEQ ID NO: 17147 - DNA, 20 bp, synthetic construct
  misc_feature 1..20: note = CRISPR gRNA sequence
  source 1..20: mol_type = other DNA
tgagacccagagaagacaag

SEQ ID NO: 17148 - DNA, 20 bp, synthetic construct
  misc_feature 1..20: note = CRISPR gRNA sequence
  source 1..20: mol_type = other DNA
agaagacaagcagcttcctc

SEQ ID NO: 17149 - DNA, 20 bp, synthetic construct
  misc_feature 1..20: note = CRISPR gRNA sequence
  source 1..20: mol_type = other DNA
gcagcttcctcaagatcatg

SEQ ID NO: 17150 - DNA, 20 bp, synthetic construct
  misc_feature 1..20: note = CRISPR gRNA sequence
  source 1..20: mol_type = other DNA
caagatcatgtagctcttgc

SEQ ID NO: 17151 - DNA, 20 bp, synthetic construct
  misc_feature 1..20: note = CRISPR gRNA sequence
  source 1..20: mol_type = other DNA
aagatcatgtagctcttgct

SEQ ID NO: 17152 - DNA, 20 bp, synthetic construct
  misc_feature 1..20: note = CRISPR gRNA sequence
  source 1..20: mol_type = other DNA
agatcatgtagctcttgctg

SEQ ID NO: 17153 - DNA, 20 bp, synthetic construct
  misc_feature 1..20: note = CRISPR gRNA sequence
  source 1..20: mol_type = other DNA
catgtagctcttgctgggga

SEQ ID NO: 17154 - DNA, 20 bp, synthetic construct
  misc_feature 1..20: note = CRISPR gRNA sequence
  source 1..20: mol_type = other DNA
agctcttgctggggaaagcc

SEQ ID NO: 17155 - DNA, 20 bp, synthetic construct
  misc_feature 1..20: note = CRISPR gRNA sequence
  source 1..20: mol_type = other DNA
tgctggggaaagccaagctg

SEQ ID NO: 17156 - DNA, 20 bp, synthetic construct
  misc_feature 1..20: note = CRISPR gRNA sequence
  source 1..20: mol_type = other DNA
gctggggaaagccaagctga

SEQ ID NO: 17157 - DNA, 20 bp, synthetic construct
  misc_feature 1..20: note = CRISPR gRNA sequence
  source 1..20: mol_type = other DNA
aagctgaaggctcatctgtg

SEQ ID NO: 17158 - DNA, 20 bp, synthetic construct
  misc_feature 1..20: note = CRISPR gRNA sequence
  source 1..20: mol_type = other DNA
aggctcatctgtgtggctct

SEQ ID NO: 17159 - DNA, 20 bp, synthetic construct
  misc_feature 1..20: note = CRISPR gRNA sequence
  source 1..20: mol_type = other DNA
ggctcatctgtgtggctcta

SEQ ID NO: 17160 - DNA, 20 bp, synthetic construct
  misc_feature 1..20: note = CRISPR gRNA sequence
  source 1..20: mol_type = other DNA
tgtggctctaaggctcctgc

SEQ ID NO: 17161 - DNA, 20 bp, synthetic construct
  misc_feature 1..20: note = CRISPR gRNA sequence
  source 1..20: mol_type = other DNA
gtggctctaaggctcctgcc

SEQ ID NO: 17162 - DNA, 20 bp, synthetic construct
  misc_feature 1..20: note = CRISPR gRNA sequence
  source 1..20: mol_type = other DNA
aaggctcctgccaggatccg

SEQ ID NO: 17163 - DNA, 20 bp, synthetic construct
  misc_feature 1..20: note = CRISPR gRNA sequence
  source 1..20: mol_type = other DNA
tcctgccaggatccgtggtt

SEQ ID NO: 17164 - DNA, 20 bp, synthetic construct
  misc_feature 1..20: note = CRISPR gRNA sequence
  source 1..20: mol_type = other DNA
cctgccaggatccgtggttc

SEQ ID NO: 17165 - DNA, 20 bp, synthetic construct
  misc_feature 1..20: note = CRISPR gRNA sequence
  source 1..20: mol_type = other DNA
ggttcaggtccatgtttcca

SEQ ID NO: 17166 - DNA, 20 bp, synthetic construct
  misc_feature 1..20: note = CRISPR gRNA sequence
  source 1..20: mol_type = other DNA
tccatggtatattcatttcc

SEQ ID NO: 17167 - DNA, 20 bp, synthetic construct
  misc_feature 1..20: note = CRISPR gRNA sequence
  source 1..20: mol_type = other DNA
ccatggtatattcatttccc

SEQ ID NO: 17168 - DNA, 20 bp, synthetic construct
  misc_feature 1..20: note = CRISPR gRNA sequence
  source 1..20: mol_type = other DNA
catggtatattcatttccca

SEQ ID NO: 17169 - DNA, 20 bp, synthetic construct
  misc_feature 1..20: note = CRISPR gRNA sequence
  source 1..20: mol_type = other DNA
tttcccagggctgctgaaac

SEQ ID NO: 17170 - DNA, 20 bp, synthetic construct
  misc_feature 1..20: note = CRISPR gRNA sequence
  source 1..20: mol_type = other DNA
ttcccagggctgctgaaaca

SEQ ID NO: 17171 - DNA, 20 bp, synthetic construct
  misc_feature 1..20: note = CRISPR gRNA sequence
  source 1..20: mol_type = other DNA
gggctgctgaaacaaggtac

SEQ ID NO: 17172 - DNA, 20 bp, synthetic construct
  misc_feature 1..20: note = CRISPR gRNA sequence
  source 1..20: mol_type = other DNA
tgaaacaaggtaccagcatc

SEQ ID NO: 17173 - DNA, 20 bp, synthetic construct
  misc_feature 1..20: note = CRISPR gRNA sequence
  source 1..20: mol_type = other DNA
gaaacaaggtaccagcatcc

SEQ ID NO: 17174 - DNA, 20 bp, synthetic construct
  misc_feature 1..20: note = CRISPR gRNA sequence
  source 1..20: mol_type = other DNA
acaaggtaccagcatccagg

SEQ ID NO: 17175 - DNA, 20 bp, synthetic construct
  misc_feature 1..20: note = CRISPR gRNA sequence
  source 1..20: mol_type = other DNA
gtaccagcatccaggtagct

SEQ ID NO: 17176 - DNA, 20 bp, synthetic construct
  misc_feature 1..20: note = CRISPR gRNA sequence
  source 1..20: mol_type = other DNA
atccaggtagctcagaacaa

SEQ ID NO: 17177 - DNA, 20 bp, synthetic construct
  misc_feature 1..20: note = CRISPR gRNA sequence
  source 1..20: mol_type = other DNA
aacagcactttattctctca

SEQ ID NO: 17178 - DNA, 20 bp, synthetic construct
  misc_feature 1..20: note = CRISPR gRNA sequence
  source 1..20: mol_type = other DNA
actttattctctcatggttc

SEQ ID NO: 17179 - DNA, 20 bp, synthetic construct
  misc_feature 1..20: note = CRISPR gRNA sequence
  source 1..20: mol_type = other DNA
tttattctctcatggttctg

SEQ ID NO: 17180 - DNA, 20 bp, synthetic construct
  misc_feature 1..20: note = CRISPR gRNA sequence
  source 1..20: mol_type = other DNA
ttattctctcatggttctgg

SEQ ID NO: 17181 - DNA, 20 bp, synthetic construct
  misc_feature 1..20: note = CRISPR gRNA sequence
  source 1..20: mol_type = other DNA
tctctcatggttctggaggc

SEQ ID NO: 17182 - DNA, 20 bp, synthetic construct
  misc_feature 1..20: note = CRISPR gRNA sequence
  source 1..20: mol_type = other DNA
ctcatggttctggaggccag

SEQ ID NO: 17183 - DNA, 20 bp, synthetic construct
  misc_feature 1..20: note = CRISPR gRNA sequence
  source 1..20: mol_type = other DNA
gttctggaggccagaagttg

SEQ ID NO: 17184 - DNA, 20 bp, synthetic construct
  misc_feature 1..20: note = CRISPR gRNA sequence
  source 1..20: mol_type = other DNA
ggaggccagaagttgaagcc

SEQ ID NO: 17185 - DNA, 20 bp, synthetic construct
  misc_feature 1..20: note = CRISPR gRNA sequence
  source 1..20: mol_type = other DNA
gaggccagaagttgaagcca

SEQ ID NO: 17186 - DNA, 20 bp, synthetic construct
  misc_feature 1..20: note = CRISPR gRNA sequence
  source 1..20: mol_type = other DNA
agaagttgaagccaaggtgt

SEQ ID NO: 17187 - DNA, 20 bp, synthetic construct
  misc_feature 1..20: note = CRISPR gRNA sequence
  source 1..20: mol_type = other DNA
agttgaagccaaggtgtcag

SEQ ID NO: 17188 - DNA, 20 bp, synthetic construct
  misc_feature 1..20: note = CRISPR gRNA sequence
  source 1..20: mol_type = other DNA
gttgaagccaaggtgtcagc

SEQ ID NO: 17189 - DNA, 20 bp, synthetic construct
  misc_feature 1..20: note = CRISPR gRNA sequence
  source 1..20: mol_type = other DNA
ttgaagccaaggtgtcagca

SEQ ID NO: 17190 - DNA, 20 bp, synthetic construct
  misc_feature 1..20: note = CRISPR gRNA sequence
  source 1..20: mol_type = other DNA
cagcagggccacgctgcctc

SEQ ID NO: 17191 - DNA, 20 bp, synthetic construct
  misc_feature 1..20: note = CRISPR gRNA sequence
  source 1..20: mol_type = other DNA
gcagggccacgctgcctctg

SEQ ID NO: 17192 - DNA, 20 bp, synthetic construct
  misc_feature 1..20: note = CRISPR gRNA sequence
  source 1..20: mol_type = other DNA
cagggccacgctgcctctgg

SEQ ID NO: 17193 - DNA, 20 bp, synthetic construct
  misc_feature 1..20: note = CRISPR gRNA sequence
  source 1..20: mol_type = other DNA
cacgctgcctctggaggctc

SEQ ID NO: 17194 - DNA, 20 bp, synthetic construct
  misc_feature 1..20: note = CRISPR gRNA sequence
  source 1..20: mol_type = other DNA
acgctgcctctggaggctcg

SEQ ID NO: 17195 - DNA, 20 bp, synthetic construct
  misc_feature 1..20: note = CRISPR gRNA sequence
  source 1..20: mol_type = other DNA
cgctgcctctggaggctcga

SEQ ID NO: 17196 - DNA, 20 bp, synthetic construct
  misc_feature 1..20: note = CRISPR gRNA sequence
  source 1..20: mol_type = other DNA
gctgcctctggaggctcgag

SEQ ID NO: 17197 - DNA, 20 bp, synthetic construct
  misc_feature 1..20: note = CRISPR gRNA sequence
  source 1..20: mol_type = other DNA
tgcctctggaggctcgaggg

SEQ ID NO: 17198 - DNA, 20 bp, synthetic construct
  misc_feature 1..20: note = CRISPR gRNA sequence
  source 1..20: mol_type = other DNA
gaatgcttccttgcctcctc

SEQ ID NO: 17199 - DNA, 20 bp, synthetic construct
  misc_feature 1..20: note = CRISPR gRNA sequence
  source 1..20: mol_type = other DNA
tccttgcctcctctagctgc

SEQ ID NO: 17200 - DNA, 20 bp, synthetic construct
  misc_feature 1..20: note = CRISPR gRNA sequence
  source 1..20: mol_type = other DNA
ccttgcctcctctagctgct

SEQ ID NO: 17201 - DNA, 20 bp, synthetic construct
  misc_feature 1..20: note = CRISPR gRNA sequence
  source 1..20: mol_type = other DNA
ctctagctgctgggaactac

SEQ ID NO: 17202 - DNA, 20 bp, synthetic construct
  misc_feature 1..20: note = CRISPR gRNA sequence
  source 1..20: mol_type = other DNA
tactggtgatccttgacttg

SEQ ID NO: 17203 - DNA, 20 bp, synthetic construct
  misc_feature 1..20: note = CRISPR gRNA sequence
  source 1..20: mol_type = other DNA
atccttgacttgtggtcttg

SEQ ID NO: 17204 - DNA, 20 bp, synthetic construct
  misc_feature 1..20: note = CRISPR gRNA sequence
  source 1..20: mol_type = other DNA
tggctgcatcactctaaact

SEQ ID NO: 17205 - DNA, 20 bp, synthetic construct
  misc_feature 1..20: note = CRISPR gRNA sequence
  source 1..20: mol_type = other DNA
catcactctaaactcagctt

SEQ ID NO: 17206 - DNA, 20 bp, synthetic construct
  misc_feature 1..20: note = CRISPR gRNA sequence
  source 1..20: mol_type = other DNA
cactctaaactcagctttag

SEQ ID NO: 17207 - DNA, 20 bp, synthetic construct
  misc_feature 1..20: note = CRISPR gRNA sequence
  source 1..20: mol_type = other DNA
cacatcacctactcctcatg

SEQ ID NO: 17208 - DNA, 20 bp, synthetic construct
  misc_feature 1..20: note = CRISPR gRNA sequence
  source 1..20: mol_type = other DNA
tcacctactcctcatgtagc

SEQ ID NO: 17209 - DNA, 20 bp, synthetic construct
  misc_feature 1..20: note = CRISPR gRNA sequence
  source 1..20: mol_type = other DNA
gcaagtctctttctcttata

SEQ ID NO: 17210 - DNA, 20 bp, synthetic construct
  misc_feature 1..20: note = CRISPR gRNA sequence
  source 1..20: mol_type = other DNA
cttataaagacacttgtcat

SEQ ID NO: 17211 - DNA, 20 bp, synthetic construct
  misc_feature 1..20: note = CRISPR gRNA sequence
  source 1..20: mol_type = other DNA
aagacacttgtcattggatt

SEQ ID NO: 17212 - DNA, 20 bp, synthetic construct
  misc_feature 1..20: note = CRISPR gRNA sequence
  source 1..20: mol_type = other DNA
agacacttgtcattggattt

SEQ ID NO: 17213 - DNA, 20 bp, synthetic construct
  misc_feature 1..20: note = CRISPR gRNA sequence
  source 1..20: mol_type = other DNA
cattggatttaggacccacc

SEQ ID NO: 17214 - DNA, 20 bp, synthetic construct
  misc_feature 1..20: note = CRISPR gRNA sequence
  source 1..20: mol_type = other DNA
taggacccacctagataatc

SEQ ID NO: 17215 - DNA, 20 bp, synthetic construct
  misc_feature 1..20: note = CRISPR gRNA sequence
  source 1..20: mol_type = other DNA
aggacccacctagataatcc

SEQ ID NO: 17216 - DNA, 20 bp, synthetic construct
  misc_feature 1..20: note = CRISPR gRNA sequence
  source 1..20: mol_type = other DNA
atccaggatgatgtcatttc

SEQ ID NO: 17217 - DNA, 20 bp, synthetic construct
  misc_feature 1..20: note = CRISPR gRNA sequence
  source 1..20: mol_type = other DNA
ttctttttttgccttctttt

SEQ ID NO: 17218 - DNA, 20 bp, synthetic construct
  misc_feature 1..20: note = CRISPR gRNA sequence
  source 1..20: mol_type = other DNA
ttttttgccttcttttgaga

SEQ ID NO: 17219 - DNA, 20 bp, synthetic construct
  misc_feature 1..20: note = CRISPR gRNA sequence
  source 1..20: mol_type = other DNA
ttttgccttcttttgagaca

SEQ ID NO: 17220 - DNA, 20 bp, synthetic construct
  misc_feature 1..20: note = CRISPR gRNA sequence
  source 1..20: mol_type = other DNA
tttgccttcttttgagacag

SEQ ID NO: 17221 - DNA, 20 bp, synthetic construct
  misc_feature 1..20: note = CRISPR gRNA sequence
  source 1..20: mol_type = other DNA
cagaggcttgctctgttgcc

SEQ ID NO: 17222 - DNA, 20 bp, synthetic construct
  misc_feature 1..20: note = CRISPR gRNA sequence
  source 1..20: mol_type = other DNA
agaggcttgctctgttgccc

SEQ ID NO: 17223 - DNA, 20 bp, synthetic construct
  misc_feature 1..20: note = CRISPR gRNA sequence
  source 1..20: mol_type = other DNA
gcttgctctgttgcccaggc

SEQ ID NO: 17224 - DNA, 20 bp, synthetic construct
  misc_feature 1..20: note = CRISPR gRNA sequence
  source 1..20: mol_type = other DNA
ctgttgcccaggctggaatg

SEQ ID NO: 17225 - DNA, 20 bp, synthetic construct
  misc_feature 1..20: note = CRISPR gRNA sequence
  source 1..20: mol_type = other DNA
ttgcccaggctggaatgcag

SEQ ID NO: 17226 - DNA, 20 bp, synthetic construct
  misc_feature 1..20: note = CRISPR gRNA sequence
  source 1..20: mol_type = other DNA
ggaatgcagtggcgctgtat

SEQ ID NO: 17227 - DNA, 20 bp, synthetic construct
  misc_feature 1..20: note = CRISPR gRNA sequence
  source 1..20: mol_type = other DNA
tcactgcaacctccacctcc

SEQ ID NO: 17228 - DNA, 20 bp, synthetic construct
  misc_feature 1..20: note = CRISPR gRNA sequence
  source 1..20: mol_type = other DNA
caacctccacctcccagttc

SEQ ID NO: 17229 - DNA, 20 bp, synthetic construct
  misc_feature 1..20: note = CRISPR gRNA sequence
  source 1..20: mol_type = other DNA
ttcaagcgattctcctgccc

SEQ ID NO: 17230 - DNA, 20 bp, synthetic construct
  misc_feature 1..20: note = CRISPR gRNA sequence
  source 1..20: mol_type = other DNA
ttctcctgccccagtctcct

SEQ ID NO: 17231 - DNA, 20 bp, synthetic construct
  misc_feature 1..20: note = CRISPR gRNA sequence
  source 1..20: mol_type = other DNA
tcctgccccagtctcctgag

SEQ ID NO: 17232 - DNA, 20 bp, synthetic construct
  misc_feature 1..20: note = CRISPR gRNA sequence
  source 1..20: mol_type = other DNA
gccccagtctcctgagtagc

SEQ ID NO: 17233 - DNA, 20 bp, synthetic construct
  misc_feature 1..20: note = CRISPR gRNA sequence
  source 1..20: mol_type = other DNA
ccccagtctcctgagtagct

SEQ ID NO: 17234 - DNA, 20 bp, synthetic construct
  misc_feature 1..20: note = CRISPR gRNA sequence
  source 1..20: mol_type = other DNA
ctcctgagtagctgggatta

SEQ ID NO: 17235 - DNA, 20 bp, synthetic construct
  misc_feature 1..20: note = CRISPR gRNA sequence
  source 1..20: mol_type = other DNA
tcctgagtagctgggattac

SEQ ID NO: 17236 - DNA, 20 bp, synthetic construct
  misc_feature 1..20: note = CRISPR gRNA sequence
  source 1..20: mol_type = other DNA
caggtgctcaccaccatgac

SEQ ID NO: 17237 - DNA, 20 bp, synthetic construct
  misc_feature 1..20: note = CRISPR gRNA sequence
  source 1..20: mol_type = other DNA
ccagctaatttttgtatttt

SEQ ID NO: 17238 - DNA, 20 bp, synthetic construct
  misc_feature 1..20: note = CRISPR gRNA sequence
  source 1..20: mol_type = other DNA
gctaatttttgtatttttag

SEQ ID NO: 17239 - DNA, 20 bp, synthetic construct
  misc_feature 1..20: note = CRISPR gRNA sequence
  source 1..20: mol_type = other DNA
ttttgtatttttagtagaaa

SEQ ID NO: 17240 - DNA, 20 bp, synthetic construct
  misc_feature 1..20: note = CRISPR gRNA sequence
  source 1..20: mol_type = other DNA
tttgtatttttagtagaaat

SEQ ID NO: 17241 - DNA, 20 bp, synthetic construct
  misc_feature 1..20: note = CRISPR gRNA sequence
  source 1..20: mol_type = other DNA
ttgtatttttagtagaaatg

SEQ ID NO: 17242 - DNA, 20 bp, synthetic construct
  misc_feature 1..20: note = CRISPR gRNA sequence
  source 1..20: mol_type = other DNA
gaaatggggttttgccatgt

SEQ ID NO: 17243 - DNA, 20 bp, synthetic construct
  misc_feature 1..20: note = CRISPR gRNA sequence
  source 1..20: mol_type = other DNA
ttttgccatgttggccacgc

SEQ ID NO: 17244 - DNA, 20 bp, synthetic construct
  misc_feature 1..20: note = CRISPR gRNA sequence
  source 1..20: mol_type = other DNA
tggtcttgaactcctgacct

SEQ ID NO: 17245 - DNA, 20 bp, synthetic construct
  misc_feature 1..20: note = CRISPR gRNA sequence
  source 1..20: mol_type = other DNA
ggtcttgaactcctgacctc

SEQ ID NO: 17246 - DNA, 20 bp, synthetic construct
  misc_feature 1..20: note = CRISPR gRNA sequence
  source 1..20: mol_type = other DNA
ctcaggtgatcctccaatct

SEQ ID NO: 17247 - DNA, 20 bp, synthetic construct
  misc_feature 1..20: note = CRISPR gRNA sequence
  source 1..20: mol_type = other DNA
cctccaatctcagcttccca

SEQ ID NO: 17248 - DNA, 20 bp, synthetic construct
  misc_feature 1..20: note = CRISPR gRNA sequence
  source 1..20: mol_type = other DNA
atctcagcttcccaaagtgc

SEQ ID NO: 17249 - DNA, 20 bp, synthetic construct
  misc_feature 1..20: note = CRISPR gRNA sequence
  source 1..20: mol_type = other DNA
tctcagcttcccaaagtgct

SEQ ID NO: 17250 - DNA, 20 bp, synthetic construct
  misc_feature 1..20: note = CRISPR gRNA sequence
  source 1..20: mol_type = other DNA
ttcccaaagtgctgggatta

SEQ ID NO: 17251 - DNA, 20 bp, synthetic construct
  misc_feature 1..20: note = CRISPR gRNA sequence
  source 1..20: mol_type = other DNA
tcccaaagtgctgggattac

SEQ ID NO: 17252 - DNA, 20 bp, synthetic construct
  misc_feature 1..20: note = CRISPR gRNA sequence
  source 1..20: mol_type = other DNA
agtgctgggattacaggcat

SEQ ID NO: 17253 - DNA, 20 bp, synthetic construct
  misc_feature 1..20: note = CRISPR gRNA sequence
  source 1..20: mol_type = other DNA
caggcatgagccactgcacc

SEQ ID NO: 17254 - DNA, 20 bp, synthetic construct
  misc_feature 1..20: note = CRISPR gRNA sequence
  source 1..20: mol_type = other DNA
ttaacttaattctatctgca

SEQ ID NO: 17255 - DNA, 20 bp, synthetic construct
  misc_feature 1..20: note = CRISPR gRNA sequence
  source 1..20: mol_type = other DNA
aaagacccttttcccaaata

SEQ ID NO: 17256 - DNA, 20 bp, synthetic construct
  misc_feature 1..20: note = CRISPR gRNA sequence
  source 1..20: mol_type = other DNA
cccaaataaagtcacactga

SEQ ID NO: 17257 - DNA, 20 bp, synthetic construct
  misc_feature 1..20: note = CRISPR gRNA sequence
  source 1..20: mol_type = other DNA
ccaaataaagtcacactgac

SEQ ID NO: 17258 - DNA, 20 bp, synthetic construct
  misc_feature 1..20: note = CRISPR gRNA sequence
  source 1..20: mol_type = other DNA
aaagtcacactgacaggttc

SEQ ID NO: 17259 - DNA, 20 bp, synthetic construct
  misc_feature 1..20: note = CRISPR gRNA sequence
  source 1..20: mol_type = other DNA
aagtcacactgacaggttcc

SEQ ID NO: 17260 - DNA, 20 bp, synthetic construct
  misc_feature 1..20: note = CRISPR gRNA sequence
  source 1..20: mol_type = other DNA
agtcacactgacaggttcca

SEQ ID NO: 17261 - DNA, 20 bp, synthetic construct
  misc_feature 1..20: note = CRISPR gRNA sequence
  source 1..20: mol_type = other DNA
caggttccagggatttgaca

SEQ ID NO: 17262 - DNA, 20 bp, synthetic construct
  misc_feature 1..20: note = CRISPR gRNA sequence
  source 1..20: mol_type = other DNA
tttgacatggacatatcttt

SEQ ID NO: 17263 - DNA, 20 bp, synthetic construct
  misc_feature 1..20: note = CRISPR gRNA sequence
  source 1..20: mol_type = other DNA
ttgacatggacatatctttt

SEQ ID NO: 17264 - DNA, 20 bp, synthetic construct
  misc_feature 1..20: note = CRISPR gRNA sequence
  source 1..20: mol_type = other DNA
tgacatggacatatcttttg

SEQ ID NO: 17265 - DNA, 20 bp, synthetic construct
  misc_feature 1..20: note = CRISPR gRNA sequence
  source 1..20: mol_type = other DNA
gacatggacatatcttttgg

SEQ ID NO: 17266 - DNA, 20 bp, synthetic construct
  misc_feature 1..20: note = CRISPR gRNA sequence
  source 1..20: mol_type = other DNA
acatggacatatcttttggg

SEQ ID NO: 17267 - DNA, 20 bp, synthetic construct
  misc_feature 1..20: note = CRISPR gRNA sequence
  source 1..20: mol_type = other DNA
aacccaccacacatgacatg

SEQ ID NO: 17268 - DNA, 20 bp, synthetic construct
  misc_feature 1..20: note = CRISPR gRNA sequence
  source 1..20: mol_type = other DNA
ccacacatgacatgcagatg

SEQ ID NO: 17269 - DNA, 20 bp, synthetic construct
  misc_feature 1..20: note = CRISPR gRNA sequence
  source 1..20: mol_type = other DNA
cacacatgacatgcagatga

SEQ ID NO: 17270 - DNA, 20 bp, synthetic construct
  misc_feature 1..20: note = CRISPR gRNA sequence
  source 1..20: mol_type = other DNA
catgacatgcagatgaaggc

SEQ ID NO: 17271 - DNA, 20 bp, synthetic construct
  misc_feature 1..20: note = CRISPR gRNA sequence
  source 1..20: mol_type = other DNA
acatgcagatgaaggctgga

SEQ ID NO: 17272 - DNA, 20 bp, synthetic construct
  misc_feature 1..20: note = CRISPR gRNA sequence
  source 1..20: mol_type = other DNA
agatgaaggctggaaagaaa

SEQ ID NO: 17273 - DNA, 20 bp, synthetic construct
  misc_feature 1..20: note = CRISPR gRNA sequence
  source 1..20: mol_type = other DNA
atgaaggctggaaagaaaca

SEQ ID NO: 17274 - DNA, 20 bp, synthetic construct
  misc_feature 1..20: note = CRISPR gRNA sequence
  source 1..20: mol_type = other DNA
tgaaggctggaaagaaacag

SEQ ID NO: 17275 - DNA, 20 bp, synthetic construct
  misc_feature 1..20: note = CRISPR gRNA sequence
  source 1..20: mol_type = other DNA
gaaggctggaaagaaacaga

SEQ ID NO: 17276 - DNA, 20 bp, synthetic construct
  misc_feature 1..20: note = CRISPR gRNA sequence
  source 1..20: mol_type = other DNA
aggctggaaagaaacagagg

SEQ ID NO: 17277 - DNA, 20 bp, synthetic construct
  misc_feature 1..20: note = CRISPR gRNA sequence
  source 1..20: mol_type = other DNA
aagaaacagagggagcttcc

SEQ ID NO: 17278 - DNA, 20 bp, synthetic construct
  misc_feature 1..20: note = CRISPR gRNA sequence
  source 1..20: mol_type = other DNA
gaaacagagggagcttcctg

SEQ ID NO: 17279 - DNA, 20 bp, synthetic construct
  misc_feature 1..20: note = CRISPR gRNA sequence
  source 1..20: mol_type = other DNA
aaacagagggagcttcctgg

SEQ ID NO: 17280 - DNA, 20 bp, synthetic construct
  misc_feature 1..20: note = CRISPR gRNA sequence
  source 1..20: mol_type = other DNA
acagagggagcttcctggag

SEQ ID NO: 17281 - DNA, 20 bp, synthetic construct
  misc_feature 1..20: note = CRISPR gRNA sequence
  source 1..20: mol_type = other DNA
cagagggagcttcctggagg

SEQ ID NO: 17282 - DNA, 20 bp, synthetic construct
  misc_feature 1..20: note = CRISPR gRNA sequence
  source 1..20: mol_type = other DNA
gggagcttcctggaggaggt

SEQ ID NO: 17283 - DNA, 20 bp, synthetic construct
  misc_feature 1..20: note = CRISPR gRNA sequence
  source 1..20: mol_type = other DNA
gagcttcctggaggaggtaa

SEQ ID NO: 17284 - DNA, 20 bp, synthetic construct
  misc_feature 1..20: note = CRISPR gRNA sequence
  source 1..20: mol_type = other DNA
agcttcctggaggaggtaag

SEQ ID NO: 17285 - DNA, 20 bp, synthetic construct
  misc_feature 1..20: note = CRISPR gRNA sequence
  source 1..20: mol_type = other DNA
cttcctggaggaggtaagag

SEQ ID NO: 17286 - DNA, 20 bp, synthetic construct
  misc_feature 1..20: note = CRISPR gRNA sequence
  source 1..20: mol_type = other DNA
tcctggaggaggtaagagga

SEQ ID NO: 17287 - DNA, 20 bp, synthetic construct
  misc_feature 1..20: note = CRISPR gRNA sequence
  source 1..20: mol_type = other DNA
ggaggaggtaagaggagagc

SEQ ID NO: 17288 - DNA, 20 bp, synthetic construct
  misc_feature 1..20: note = CRISPR gRNA sequence
  source 1..20: mol_type = other DNA
taagaggagagctggccctg

SEQ ID NO: 17289 - DNA, 20 bp, synthetic construct
  misc_feature 1..20: note = CRISPR gRNA sequence
  source 1..20: mol_type = other DNA
aggagagctggccctgaagc

SEQ ID NO: 17290 - DNA, 20 bp, synthetic construct
  misc_feature 1..20: note = CRISPR gRNA sequence
  source 1..20: mol_type = other DNA
agagctggccctgaagctgg

SEQ ID NO: 17291 - DNA, 20 bp, synthetic construct
  misc_feature 1..20: note = CRISPR gRNA sequence
  source 1..20: mol_type = other DNA
tggccctgaagctggaagac

SEQ ID NO: 17292 - DNA, 20 bp, synthetic construct
  misc_feature 1..20: note = CRISPR gRNA sequence
  source 1..20: mol_type = other DNA
gccctgaagctggaagacca

SEQ ID NO: 17293 - DNA, 20 bp, synthetic construct
  misc_feature 1..20: note = CRISPR gRNA sequence
  source 1..20: mol_type = other DNA
ccctgaagctggaagaccag

SEQ ID NO: 17294 - DNA, 20 bp, synthetic construct
  misc_feature 1..20: note = CRISPR gRNA sequence
  source 1..20: mol_type = other DNA
cctgaagctggaagaccaga

SEQ ID NO: 17295 - DNA, 20 bp, synthetic construct
  misc_feature 1..20: note = CRISPR gRNA sequence
  source 1..20: mol_type = other DNA
tgaagctggaagaccagagg

SEQ ID NO: 17296 - DNA, 20 bp, synthetic construct
  misc_feature 1..20: note = CRISPR gRNA sequence
  source 1..20: mol_type = other DNA
gaagctggaagaccagaggg

SEQ ID NO: 17297 - DNA, 20 bp, synthetic construct
  misc_feature 1..20: note = CRISPR gRNA sequence
  source 1..20: mol_type = other DNA
aggctcctactgccctgttc

SEQ ID NO: 17298 - DNA, 20 bp, synthetic construct
  misc_feature 1..20: note = CRISPR gRNA sequence
  source 1..20: mol_type = other DNA
ggctcctactgccctgttct

SEQ ID NO: 17299 - DNA, 20 bp, synthetic construct
  misc_feature 1..20: note = CRISPR gRNA sequence
  source 1..20: mol_type = other DNA
ctactgccctgttctgggcc

SEQ ID NO: 17300 - DNA, 20 bp, synthetic construct
  misc_feature 1..20: note = CRISPR gRNA sequence
  source 1..20: mol_type = other DNA
ctgccctgttctgggcccag

SEQ ID NO: 17301 - DNA, 20 bp, synthetic construct
  misc_feature 1..20: note = CRISPR gRNA sequence
  source 1..20: mol_type = other DNA
gccctgttctgggcccagaa

SEQ ID NO: 17302 - DNA, 20 bp, synthetic construct
  misc_feature 1..20: note = CRISPR gRNA sequence
  source 1..20: mol_type = other DNA
gcccagaagagaatacattg

SEQ ID NO: 17303 - DNA, 20 bp, synthetic construct
  misc_feature 1..20: note = CRISPR gRNA sequence
  source 1..20: mol_type = other DNA
ccagaagagaatacattgaa

SEQ ID NO: 17304 - DNA, 20 bp, synthetic construct
  misc_feature 1..20: note = CRISPR gRNA sequence
  source 1..20: mol_type = other DNA
aagagaatacattgaagagt

SEQ ID NO: 17305 - DNA, 20 bp, synthetic construct
  misc_feature 1..20: note = CRISPR gRNA sequence
  source 1..20: mol_type = other DNA
acattgaagagtaagctcat

SEQ ID NO: 17306 - DNA, 20 bp, synthetic construct
  misc_feature 1..20: note = CRISPR gRNA sequence
  source 1..20: mol_type = other DNA
caacttgccaccccattcct

SEQ ID NO: 17307 - DNA, 20 bp, synthetic construct
  misc_feature 1..20: note = CRISPR gRNA sequence
  source 1..20: mol_type = other DNA
ttctttttcttttttttttt

SEQ ID NO: 17308 - DNA, 20 bp, synthetic construct
  misc_feature 1..20: note = CRISPR gRNA sequence
  source 1..20: mol_type = other DNA
ttttctttttttttttgaga

SEQ ID NO: 17309 - DNA, 20 bp, synthetic construct
  misc_feature 1..20: note = CRISPR gRNA sequence
  source 1..20: mol_type = other DNA
ttctttttttttttgagaca

SEQ ID NO: 17310 - DNA, 20 bp, synthetic construct
  misc_feature 1..20: note = CRISPR gRNA sequence
  source 1..20: mol_type = other DNA
cagagtctcactctgtcgcc

SEQ ID NO: 17311 - DNA, 20 bp, synthetic construct
  misc_feature 1..20: note = CRISPR gRNA sequence
  source 1..20: mol_type = other DNA
agagtctcactctgtcgccc

SEQ ID NO: 17312 - DNA, 20 bp, synthetic construct
  misc_feature 1..20: note = CRISPR gRNA sequence
  source 1..20: mol_type = other DNA
tctcactctgtcgcccaggc

SEQ ID NO: 17313 - DNA, 20 bp, synthetic construct
  misc_feature 1..20: note = CRISPR gRNA sequence
  source 1..20: mol_type = other DNA
tcactctgtcgcccaggctg

SEQ ID NO: 17314 - DNA, 20 bp, synthetic construct
  misc_feature 1..20: note = CRISPR gRNA sequence
  source 1..20: mol_type = other DNA
ctgtcgcccaggctggagtg

SEQ ID NO: 17315 - DNA, 20 bp, synthetic construct
  misc_feature 1..20: note = CRISPR gRNA sequence
  source 1..20: mol_type = other DNA
tcgcccaggctggagtgcag

SEQ ID NO: 17316 - DNA, 20 bp, synthetic construct
  misc_feature 1..20: note = CRISPR gRNA sequence
  source 1..20: mol_type = other DNA
ggagtgcagtggtgcaatct

SEQ ID NO: 17317 - DNA, 20 bp, synthetic construct
  misc_feature 1..20: note = CRISPR gRNA sequence
  source 1..20: mol_type = other DNA
tcactgcaacctctgcctcc

SEQ ID NO: 17318 - DNA, 20 bp, synthetic construct
  misc_feature 1..20: note = CRISPR gRNA sequence
  source 1..20: mol_type = other DNA
aacctctgcctcccggattc

SEQ ID NO: 17319 - DNA, 20 bp, synthetic construct
  misc_feature 1..20: note = CRISPR gRNA sequence
  source 1..20: mol_type = other DNA
ttctcctgcttcaacctccc

SEQ ID NO: 17320 - DNA, 20 bp, synthetic construct
  misc_feature 1..20: note = CRISPR gRNA sequence
  source 1..20: mol_type = other DNA
tcctgcttcaacctcccaag

SEQ ID NO: 17321 - DNA, 20 bp, synthetic construct
  misc_feature 1..20: note = CRISPR gRNA sequence
  source 1..20: mol_type = other DNA
gcttcaacctcccaagtagc

SEQ ID NO: 17322 - DNA, 20 bp, synthetic construct
  misc_feature 1..20: note = CRISPR gRNA sequence
  source 1..20: mol_type = other DNA
ctcccaagtagctggcatta

SEQ ID NO: 17323 - DNA, 20 bp, synthetic construct
  misc_feature 1..20: note = CRISPR gRNA sequence
  source 1..20: mol_type = other DNA
tcccaagtagctggcattac

SEQ ID NO: 17324 - DNA, 20 bp, synthetic construct
  misc_feature 1..20: note = CRISPR gRNA sequence
  source 1..20: mol_type = other DNA
caggcacccgccaccatgcc

SEQ ID NO: 17325 - DNA, 20 bp, synthetic construct
  misc_feature 1..20: note = CRISPR gRNA sequence
  source 1..20: mol_type = other DNA
ctggctaatttttttatttt

SEQ ID NO: 17326 - DNA, 20 bp, synthetic construct
  misc_feature 1..20: note = CRISPR gRNA sequence
  source 1..20: mol_type = other DNA
taatttttttatttttagta

SEQ ID NO: 17327 - DNA, 20 bp, synthetic construct
  misc_feature 1..20: note = CRISPR gRNA sequence
  source 1..20: mol_type = other DNA
ttttttatttttagtaaaga

SEQ ID NO: 17328 - DNA, 20 bp, synthetic construct
  misc_feature 1..20: note = CRISPR gRNA sequence
  source 1..20: mol_type = other DNA
tttttatttttagtaaagat

SEQ ID NO: 17329 - DNA, 20 bp, synthetic construct
  misc_feature 1..20: note = CRISPR gRNA sequence
  source 1..20: mol_type = other DNA
ttttatttttagtaaagatg

SEQ ID NO: 17330 - DNA, 20 bp, synthetic construct
  misc_feature 1..20: note = CRISPR gRNA sequence
  source 1..20: mol_type = other DNA
aagatggggtttcaccatgt

SEQ ID NO: 17331 - DNA, 20 bp, synthetic construct
  misc_feature 1..20: note = CRISPR gRNA sequence
  source 1..20: mol_type = other DNA
tggggtttcaccatgttggt

SEQ ID NO: 17332 - DNA, 20 bp, synthetic construct
  misc_feature 1..20: note = CRISPR gRNA sequence
  source 1..20: mol_type = other DNA
ggggtttcaccatgttggtc

SEQ ID NO: 17333 - DNA, 20 bp, synthetic construct
  misc_feature 1..20: note = CRISPR gRNA sequence
  source 1..20: mol_type = other DNA
tttcaccatgttggtcaggc

SEQ ID NO: 17334 - DNA, 20 bp, synthetic construct
  misc_feature 1..20: note = CRISPR gRNA sequence
  source 1..20: mol_type = other DNA
tggtttcgaactcccgacct

SEQ ID NO: 17335 - DNA, 20 bp, synthetic construct
  misc_feature 1..20: note = CRISPR gRNA sequence
  source 1..20: mol_type = other DNA
ggtttcgaactcccgacctc

SEQ ID NO: 17336 - DNA, 20 bp, synthetic construct
  misc_feature 1..20: note = CRISPR gRNA sequence
  source 1..20: mol_type = other DNA
ctcaggtgatccacccgcct

SEQ ID NO: 17337 - DNA, 20 bp, synthetic construct
  misc_feature 1..20: note = CRISPR gRNA sequence
  source 1..20: mol_type = other DNA
ccacccgccttggcctccca

SEQ ID NO: 17338 - DNA, 20 bp, synthetic construct
  misc_feature 1..20: note = CRISPR gRNA sequence
  source 1..20: mol_type = other DNA
gccttggcctcccaaagtgc

SEQ ID NO: 17339 - DNA, 20 bp, synthetic construct
  misc_feature 1..20: note = CRISPR gRNA sequence
  source 1..20: mol_type = other DNA
ccttggcctcccaaagtgct

SEQ ID NO: 17340 - DNA, 20 bp, synthetic construct
  misc_feature 1..20: note = CRISPR gRNA sequence
  source 1..20: mol_type = other DNA
ctcccaaagtgctgggatta

SEQ ID NO: 17341 - DNA, 20 bp, synthetic construct
  misc_feature 1..20: note = CRISPR gRNA sequence
  source 1..20: mol_type = other DNA
tcccaaagtgctgggattac

SEQ ID NO: 17342 - DNA, 20 bp, synthetic construct
  misc_feature 1..20: note = CRISPR gRNA sequence
  source 1..20: mol_type = other DNA
agtgctgggattacaggtgt

SEQ ID NO: 17343 - DNA, 20 bp, synthetic construct
  misc_feature 1..20: note = CRISPR gRNA sequence
  source 1..20: mol_type = other DNA
caggtgtgagccaccacacc

SEQ ID NO: 17344 - DNA, 20 bp, synthetic construct
  misc_feature 1..20: note = CRISPR gRNA sequence
  source 1..20: mol_type = other DNA
gtgagccaccacacccggcc

SEQ ID NO: 17345 - DNA, 20 bp, synthetic construct
  misc_feature 1..20: note = CRISPR gRNA sequence
  source 1..20: mol_type = other DNA
gagccaccacacccggccca

SEQ ID NO: 17346 - DNA, 20 bp, synthetic construct
  misc_feature 1..20: note = CRISPR gRNA sequence
  source 1..20: mol_type = other DNA
cattttctttcacgcatcca

SEQ ID NO: 17347 - DNA, 20 bp, synthetic construct
  misc_feature 1..20: note = CRISPR gRNA sequence
  source 1..20: mol_type = other DNA
catccacagctttcactgcc

SEQ ID NO: 17348 - DNA, 20 bp, synthetic construct
  misc_feature 1..20: note = CRISPR gRNA sequence
  source 1..20: mol_type = other DNA
atccacagctttcactgcct

SEQ ID NO: 17349 - DNA, 20 bp, synthetic construct
  misc_feature 1..20: note = CRISPR gRNA sequence
  source 1..20: mol_type = other DNA
tccacagctttcactgcctg

SEQ ID NO: 17350 - DNA, 20 bp, synthetic construct
  misc_feature 1..20: note = CRISPR gRNA sequence
  source 1..20: mol_type = other DNA
cacagctttcactgcctggg

SEQ ID NO: 17351 - DNA, 20 bp, synthetic construct
  misc_feature 1..20: note = CRISPR gRNA sequence
  source 1..20: mol_type = other DNA
cagctttcactgcctgggga

SEQ ID NO: 17352 - DNA, 20 bp, synthetic construct
  misc_feature 1..20: note = CRISPR gRNA sequence
  source 1..20: mol_type = other DNA
agctttcactgcctggggag

SEQ ID NO: 17353 - DNA, 20 bp, synthetic construct
  misc_feature 1..20: note = CRISPR gRNA sequence
  source 1..20: mol_type = other DNA
tcactgcctggggagaggct

SEQ ID NO: 17354 - DNA, 20 bp, synthetic construct
  misc_feature 1..20: note = CRISPR gRNA sequence
  source 1..20: mol_type = other DNA
gcctggggagaggctcagca

SEQ ID NO: 17355 - DNA, 20 bp, synthetic construct
  misc_feature 1..20: note = CRISPR gRNA sequence
  source 1..20: mol_type = other DNA
agaggctcagcacagacccc

SEQ ID NO: 17356 - DNA, 20 bp, synthetic construct
  misc_feature 1..20: note = CRISPR gRNA sequence
  source 1..20: mol_type = other DNA
gcacagacccccggatgtca

SEQ ID NO: 17357 - DNA, 20 bp, synthetic construct
  misc_feature 1..20: note = CRISPR gRNA sequence
  source 1..20: mol_type = other DNA
acagacccccggatgtcaca

SEQ ID NO: 17358 - DNA, 20 bp, synthetic construct
  misc_feature 1..20: note = CRISPR gRNA sequence
  source 1..20: mol_type = other DNA
gtcacagagaatgatctttc

SEQ ID NO: 17359 - DNA, 20 bp, synthetic construct
  misc_feature 1..20: note = CRISPR gRNA sequence
  source 1..20: mol_type = other DNA
gagaatgatctttccagtcc

SEQ ID NO: 17360 - DNA, 20 bp, synthetic construct
  misc_feature 1..20: note = CRISPR gRNA sequence
  source 1..20: mol_type = other DNA
atgatctttccagtccaagc

SEQ ID NO: 17361 - DNA, 20 bp, synthetic construct
  misc_feature 1..20: note = CRISPR gRNA sequence
  source 1..20: mol_type = other DNA
tgatctttccagtccaagct

SEQ ID NO: 17362 - DNA, 20 bp, synthetic construct
  misc_feature 1..20: note = CRISPR gRNA sequence
  source 1..20: mol_type = other DNA
gatctttccagtccaagctg

SEQ ID NO: 17363 - DNA, 20 bp, synthetic construct
  misc_feature 1..20: note = CRISPR gRNA sequence
  source 1..20: mol_type = other DNA
tccagtccaagctggggcac

SEQ ID NO: 17364 - DNA, 20 bp, synthetic construct
  misc_feature 1..20: note = CRISPR gRNA sequence
  source 1..20: mol_type = other DNA
gtccaagctggggcactggc

SEQ ID NO: 17365 - DNA, 20 bp, synthetic construct
  misc_feature 1..20: note = CRISPR gRNA sequence
  source 1..20: mol_type = other DNA
tccaagctggggcactggct

SEQ ID NO: 17366 - DNA, 20 bp, synthetic construct
  misc_feature 1..20: note = CRISPR gRNA sequence
  source 1..20: mol_type = other DNA
ctgggcccacttgttcatga

SEQ ID NO: 17367 - DNA, 20 bp, synthetic construct
  misc_feature 1..20: note = CRISPR gRNA sequence
  source 1..20: mol_type = other DNA
cccacttgttcatgacggtt

SEQ ID NO: 17368 - DNA, 20 bp, synthetic construct
  misc_feature 1..20: note = CRISPR gRNA sequence
  source 1..20: mol_type = other DNA
acttgttcatgacggttgag

SEQ ID NO: 17369 - DNA, 20 bp, synthetic construct
  misc_feature 1..20: note = CRISPR gRNA sequence
  source 1..20: mol_type = other DNA
cttgttcatgacggttgagc

SEQ ID NO: 17370 - DNA, 20 bp, synthetic construct
  misc_feature 1..20: note = CRISPR gRNA sequence
  source 1..20: mol_type = other DNA
ttgttcatgacggttgagcg

SEQ ID NO: 17371 - DNA, 20 bp, synthetic construct
  misc_feature 1..20: note = CRISPR gRNA sequence
  source 1..20: mol_type = other DNA
tgttcatgacggttgagcgg

SEQ ID NO: 17372 - DNA, 20 bp, synthetic construct
  misc_feature 1..20: note = CRISPR gRNA sequence
  source 1..20: mol_type = other DNA
tgacggttgagcgggggctg

SEQ ID NO: 17373 - DNA, 20 bp, synthetic construct
  misc_feature 1..20: note = CRISPR gRNA sequence
  source 1..20: mol_type = other DNA
gacggttgagcgggggctgc

SEQ ID NO: 17374 - DNA, 20 bp, synthetic construct
  misc_feature 1..20: note = CRISPR gRNA sequence
  source 1..20: mol_type = other DNA
tgcaggaacccaaacataac

SEQ ID NO: 17375 - DNA, 20 bp, synthetic construct
  misc_feature 1..20: note = CRISPR gRNA sequence
  source 1..20: mol_type = other DNA
acccaaacataaccggcttg

SEQ ID NO: 17376 - DNA, 20 bp, synthetic construct
  misc_feature 1..20: note = CRISPR gRNA sequence
  source 1..20: mol_type = other DNA
aaacataaccggcttgcagc

SEQ ID NO: 17377 - DNA, 20 bp, synthetic construct
  misc_feature 1..20: note = CRISPR gRNA sequence
  source 1..20: mol_type = other DNA
accggcttgcagcgagatcc

SEQ ID NO: 17378 - DNA, 20 bp, synthetic construct
  misc_feature 1..20: note = CRISPR gRNA sequence
  source 1..20: mol_type = other DNA
agatcccagccaaccatgac

SEQ ID NO: 17379 - DNA, 20 bp, synthetic construct
  misc_feature 1..20: note = CRISPR gRNA sequence
  source 1..20: mol_type = other DNA
atcccagccaaccatgacta

SEQ ID NO: 17380 - DNA, 20 bp, synthetic construct
  misc_feature 1..20: note = CRISPR gRNA sequence
  source 1..20: mol_type = other DNA
tcccagccaaccatgactag

SEQ ID NO: 17381 - DNA, 20 bp, synthetic construct
  misc_feature 1..20: note = CRISPR gRNA sequence
  source 1..20: mol_type = other DNA
cagccaaccatgactagagg

SEQ ID NO: 17382 - DNA, 20 bp, synthetic construct
  misc_feature 1..20: note = CRISPR gRNA sequence
  source 1..20: mol_type = other DNA
ccaaccatgactagaggaag

SEQ ID NO: 17383 - DNA, 20 bp, synthetic construct
  misc_feature 1..20: note = CRISPR gRNA sequence
  source 1..20: mol_type = other DNA
actagaggaagcagaactga

SEQ ID NO: 17384 - DNA, 20 bp, synthetic construct
  misc_feature 1..20: note = CRISPR gRNA sequence
  source 1..20: mol_type = other DNA
gaggaagcagaactgaaaga

SEQ ID NO: 17385 - DNA, 20 bp, synthetic construct
  misc_feature 1..20: note = CRISPR gRNA sequence
  source 1..20: mol_type = other DNA
aggaagcagaactgaaagat

SEQ ID NO: 17386 - DNA, 20 bp, synthetic construct
  misc_feature 1..20: note = CRISPR gRNA sequence
  source 1..20: mol_type = other DNA
ggaagcagaactgaaagatg

SEQ ID NO: 17387 - DNA, 20 bp, synthetic construct
  misc_feature 1..20: note = CRISPR gRNA sequence
  source 1..20: mol_type = other DNA
tggggccaccgcccttttcc

SEQ ID NO: 17388 - DNA, 20 bp, synthetic construct
  misc_feature 1..20: note = CRISPR gRNA sequence
  source 1..20: mol_type = other DNA
gggccaccgcccttttcctg

SEQ ID NO: 17389 - DNA, 20 bp, synthetic construct
  misc_feature 1..20: note = CRISPR gRNA sequence
  source 1..20: mol_type = other DNA
ccaccgcccttttcctggag

SEQ ID NO: 17390 - DNA, 20 bp, synthetic construct
  misc_feature 1..20: note = CRISPR gRNA sequence
  source 1..20: mol_type = other DNA
caccgcccttttcctggagc

SEQ ID NO: 17391 - DNA, 20 bp, synthetic construct
  misc_feature 1..20: note = CRISPR gRNA sequence
  source 1..20: mol_type = other DNA
accgcccttttcctggagca

SEQ ID NO: 17392 - DNA, 20 bp, synthetic construct
  misc_feature 1..20: note = CRISPR gRNA sequence
  source 1..20: mol_type = other DNA
cttttcctggagcagggcca

SEQ ID NO: 17393 - DNA, 20 bp, synthetic construct
  misc_feature 1..20: note = CRISPR gRNA sequence
  source 1..20: mol_type = other DNA
tcctggagcagggccaaagc

SEQ ID NO: 17394 - DNA, 20 bp, synthetic construct
  misc_feature 1..20: note = CRISPR gRNA sequence
  source 1..20: mol_type = other DNA
cctggagcagggccaaagct

SEQ ID NO: 17395 - DNA, 20 bp, synthetic construct
  misc_feature 1..20: note = CRISPR gRNA sequence
  source 1..20: mol_type = other DNA
tggagcagggccaaagctgg

SEQ ID NO: 17396 - DNA, 20 bp, synthetic construct
  misc_feature 1..20: note = CRISPR gRNA sequence
  source 1..20: mol_type = other DNA
gcagggccaaagctgggaga

SEQ ID NO: 17397 - DNA, 20 bp, synthetic construct
  misc_feature 1..20: note = CRISPR gRNA sequence
  source 1..20: mol_type = other DNA
ggccaaagctgggagatggt

SEQ ID NO: 17398 - DNA, 20 bp, synthetic construct
  misc_feature 1..20: note = CRISPR gRNA sequence
  source 1..20: mol_type = other DNA
gccaaagctgggagatggtt

SEQ ID NO: 17399 - DNA, 20 bp, synthetic construct
  misc_feature 1..20: note = CRISPR gRNA sequence
  source 1..20: mol_type = other DNA
ccaaagctgggagatggttg

SEQ ID NO: 17400 - DNA, 20 bp, synthetic construct
  misc_feature 1..20: note = CRISPR gRNA sequence
  source 1..20: mol_type = other DNA
caaagctgggagatggttgg

SEQ ID NO: 17401 - DNA, 20 bp, synthetic construct
  misc_feature 1..20: note = CRISPR gRNA sequence
  source 1..20: mol_type = other DNA
gctgggagatggttgggggt

SEQ ID NO: 17402 - DNA, 20 bp, synthetic construct
  misc_feature 1..20: note = CRISPR gRNA sequence
  source 1..20: mol_type = other DNA
gtgagatgctccacctctcc

SEQ ID NO: 17403 - DNA, 20 bp, synthetic construct
  misc_feature 1..20: note = CRISPR gRNA sequence
  source 1..20: mol_type = other DNA
ctccacctctcccagcccct

SEQ ID NO: 17404 - DNA, 20 bp, synthetic construct
  misc_feature 1..20: note = CRISPR gRNA sequence
  source 1..20: mol_type = other DNA
acctctcccagccccttggt

SEQ ID NO: 17405 - DNA, 20 bp, synthetic construct
  misc_feature 1..20: note = CRISPR gRNA sequence
  source 1..20: mol_type = other DNA
cctctcccagccccttggtc

SEQ ID NO: 17406 - DNA, 20 bp, synthetic construct
  misc_feature 1..20: note = CRISPR gRNA sequence
  source 1..20: mol_type = other DNA
ctctcccagccccttggtca

SEQ ID NO: 17407 - DNA, 20 bp, synthetic construct
  misc_feature 1..20: note = CRISPR gRNA sequence
  source 1..20: mol_type = other DNA
cagccccttggtcagggaca

SEQ ID NO: 17408 - DNA, 20 bp, synthetic construct
  misc_feature 1..20: note = CRISPR gRNA sequence
  source 1..20: mol_type = other DNA
agccccttggtcagggacac

SEQ ID NO: 17409 - DNA, 20 bp, synthetic construct
  misc_feature 1..20: note = CRISPR gRNA sequence
  source 1..20: mol_type = other DNA
aggcacaaaatctgttctct

SEQ ID NO: 17410 - DNA, 20 bp, synthetic construct
  misc_feature 1..20: note = CRISPR gRNA sequence
  source 1..20: mol_type = other DNA
gcacaaaatctgttctctca

SEQ ID NO: 17411 - DNA, 20 bp, synthetic construct
  misc_feature 1..20: note = CRISPR gRNA sequence
  source 1..20: mol_type = other DNA
caaaatctgttctctcagag

SEQ ID NO: 17412 - DNA, 20 bp, synthetic construct
  misc_feature 1..20: note = CRISPR gRNA sequence
  source 1..20: mol_type = other DNA
atctgttctctcagagcagt

SEQ ID NO: 17413 - DNA, 20 bp, synthetic construct
  misc_feature 1..20: note = CRISPR gRNA sequence
  source 1..20: mol_type = other DNA
ttctctcagagcagtgagaa

SEQ ID NO: 17414 - DNA, 20 bp, synthetic construct
  misc_feature 1..20: note = CRISPR gRNA sequence
  source 1..20: mol_type = other DNA
gagaaaagacacctttgccc

SEQ ID NO: 17415 - DNA, 20 bp, synthetic construct
  misc_feature 1..20: note = CRISPR gRNA sequence
  source 1..20: mol_type = other DNA
ttccacccatgctctttatt

SEQ ID NO: 17416 - DNA, 20 bp, synthetic construct
  misc_feature 1..20: note = CRISPR gRNA sequence
  source 1..20: mol_type = other DNA
tttattaagaacctacattg

SEQ ID NO: 17417 - DNA, 20 bp, synthetic construct
  misc_feature 1..20: note = CRISPR gRNA sequence
  source 1..20: mol_type = other DNA
cagcaatctgcctcctcttt

SEQ ID NO: 17418 - DNA, 20 bp, synthetic construct
  misc_feature 1..20: note = CRISPR gRNA sequence
  source 1..20: mol_type = other DNA
agcaatctgcctcctctttg

SEQ ID NO: 17419 - DNA, 20 bp, synthetic construct
  misc_feature 1..20: note = CRISPR gRNA sequence
  source 1..20: mol_type = other DNA
aatctgcctcctctttgagg

SEQ ID NO: 17420 - DNA, 20 bp, synthetic construct
  misc_feature 1..20: note = CRISPR gRNA sequence
  source 1..20: mol_type = other DNA
aggcagtgtgatctcgtgac

SEQ ID NO: 17421 - DNA, 20 bp, synthetic construct
  misc_feature 1..20: note = CRISPR gRNA sequence
  source 1..20: mol_type = other DNA
gcagtgtgatctcgtgacaa

SEQ ID NO: 17422 - DNA, 20 bp, synthetic construct
  misc_feature 1..20: note = CRISPR gRNA sequence
  source 1..20: mol_type = other DNA
tgatctcgtgacaagagctc

SEQ ID NO: 17423 - DNA, 20 bp, synthetic construct
  misc_feature 1..20: note = CRISPR gRNA sequence
  source 1..20: mol_type = other DNA
caagagctccagactgatcc

SEQ ID NO: 17424 - DNA, 20 bp, synthetic construct
  misc_feature 1..20: note = CRISPR gRNA sequence
  source 1..20: mol_type = other DNA
atcctagcaactccgtgaat

SEQ ID NO: 17425 - DNA, 20 bp, synthetic construct
  misc_feature 1..20: note = CRISPR gRNA sequence
  source 1..20: mol_type = other DNA
gtgaatgagttgtgtgactt

SEQ ID NO: 17426 - DNA, 20 bp, synthetic construct
  misc_feature 1..20: note = CRISPR gRNA sequence
  source 1..20: mol_type = other DNA
agttgtgtgactttggactt

SEQ ID NO: 17427 - DNA, 20 bp, synthetic construct
  misc_feature 1..20: note = CRISPR gRNA sequence
  source 1..20: mol_type = other DNA
gttgtgtgactttggacttt

SEQ ID NO: 17428 - DNA, 20 bp, synthetic construct
  misc_feature 1..20: note = CRISPR gRNA sequence
  source 1..20: mol_type = other DNA
catatctataacatttctat

SEQ ID NO: 17429 - DNA, 20 bp, synthetic construct
  misc_feature 1..20: note = CRISPR gRNA sequence
  source 1..20: mol_type = other DNA
ttccatatctataaaataat

SEQ ID NO: 17430 - DNA, 20 bp, synthetic construct
  misc_feature 1..20: note = CRISPR gRNA sequence
  source 1..20: mol_type = other DNA
aataataagttacccaaact

SEQ ID NO: 17431 - DNA, 20 bp, synthetic construct
  misc_feature 1..20: note = CRISPR gRNA sequence
  source 1..20: mol_type = other DNA
acccaaactcagttttctca

SEQ ID NO: 17432 - DNA, 20 bp, synthetic construct
  misc_feature 1..20: note = CRISPR gRNA sequence
  source 1..20: mol_type = other DNA
cccaaactcagttttctcac

SEQ ID NO: 17433 - DNA, 20 bp, synthetic construct
  misc_feature 1..20: note = CRISPR gRNA sequence
  source 1..20: mol_type = other DNA
ccaaactcagttttctcaca

SEQ ID NO: 17434 - DNA, 20 bp, synthetic construct
  misc_feature 1..20: note = CRISPR gRNA sequence
  source 1..20: mol_type = other DNA
tcagttttctcacagggcat

SEQ ID NO: 17435 - DNA, 20 bp, synthetic construct
  misc_feature 1..20: note = CRISPR gRNA sequence
  source 1..20: mol_type = other DNA
cagttttctcacagggcatt

SEQ ID NO: 17436 - DNA, 20 bp, synthetic construct
  misc_feature 1..20: note = CRISPR gRNA sequence
  source 1..20: mol_type = other DNA
tcacagggcattgggtctgc

SEQ ID NO: 17437 - DNA, 20 bp, synthetic construct
  misc_feature 1..20: note = CRISPR gRNA sequence
  source 1..20: mol_type = other DNA
cacagggcattgggtctgcc

SEQ ID NO: 17438 - DNA, 20 bp, synthetic construct
  misc_feature 1..20: note = CRISPR gRNA sequence
  source 1..20: mol_type = other DNA
acagggcattgggtctgcca

SEQ ID NO: 17439 - DNA, 20 bp, synthetic construct
  misc_feature 1..20: note = CRISPR gRNA sequence
  source 1..20: mol_type = other DNA
tgggtctgccagggaccttc

SEQ ID NO: 17440 - DNA, 20 bp, synthetic construct
  misc_feature 1..20: note = CRISPR gRNA sequence
  source 1..20: mol_type = other DNA
gacctctttccttcactctg

SEQ ID NO: 17441 - DNA, 20 bp, synthetic construct
  misc_feature 1..20: note = CRISPR gRNA sequence
  source 1..20: mol_type = other DNA
tccttcactctgcagatgac

SEQ ID NO: 17442 - DNA, 20 bp, synthetic construct
  misc_feature 1..20: note = CRISPR gRNA sequence
  source 1..20: mol_type = other DNA
actctgcagatgacaagact

SEQ ID NO: 17443 - DNA, 20 bp, synthetic construct
  misc_feature 1..20: note = CRISPR gRNA sequence
  source 1..20: mol_type = other DNA
agatgacaagactgagaccc

SEQ ID NO: 17444 - DNA, 20 bp, synthetic construct
  misc_feature 1..20: note = CRISPR gRNA sequence
  source 1..20: mol_type = other DNA
gatgacaagactgagacccc

SEQ ID NO: 17445 - DNA, 20 bp, synthetic construct
  misc_feature 1..20: note = CRISPR gRNA sequence
  source 1..20: mol_type = other DNA
gacaagactgagaccccggg

SEQ ID NO: 17446 - DNA, 20 bp, synthetic construct
  misc_feature 1..20: note = CRISPR gRNA sequence
  source 1..20: mol_type = other DNA
acaagactgagaccccggga

SEQ ID NO: 17447 - DNA, 20 bp, synthetic construct
  misc_feature 1..20: note = CRISPR gRNA sequence
  source 1..20: mol_type = other DNA
gggaaggacgtgacttgcac

SEQ ID NO: 17448 - DNA, 20 bp, synthetic construct
  misc_feature 1..20: note = CRISPR gRNA sequence
  source 1..20: mol_type = other DNA
gtgacttgcacaagacctca

SEQ ID NO: 17449 - DNA, 20 bp, synthetic construct
  misc_feature 1..20: note = CRISPR gRNA sequence
  source 1..20: mol_type = other DNA
cacaagacctcatagcctgt

SEQ ID NO: 17450 - DNA, 20 bp, synthetic construct
  misc_feature 1..20: note = CRISPR gRNA sequence
  source 1..20: mol_type = other DNA
aagacctcatagcctgtcgg

SEQ ID NO: 17451 - DNA, 20 bp, synthetic construct
  misc_feature 1..20: note = CRISPR gRNA sequence
  source 1..20: mol_type = other DNA
tctcccccactccccctgcc

SEQ ID NO: 17452 - DNA, 20 bp, synthetic construct
  misc_feature 1..20: note = CRISPR gRNA sequence
  source 1..20: mol_type = other DNA
actccccctgccaagactcc

SEQ ID NO: 17453 - DNA, 20 bp, synthetic construct
  misc_feature 1..20: note = CRISPR gRNA sequence
  source 1..20: mol_type = other DNA
ctccccctgccaagactccc

SEQ ID NO: 17454 - DNA, 20 bp, synthetic construct
  misc_feature 1..20: note = CRISPR gRNA sequence
  source 1..20: mol_type = other DNA
ccctgccaagactcccaggc

SEQ ID NO: 17455 - DNA, 20 bp, synthetic construct
  misc_feature 1..20: note = CRISPR gRNA sequence
  source 1..20: mol_type = other DNA
aggctggtgctctttccccc

SEQ ID NO: 17456 - DNA, 20 bp, synthetic construct
  misc_feature 1..20: note = CRISPR gRNA sequence
  source 1..20: mol_type = other DNA
atgatcacccttgtcctgtc

SEQ ID NO: 17457 - DNA, 20 bp, synthetic construct
  misc_feature 1..20: note = CRISPR gRNA sequence
  source 1..20: mol_type = other DNA
tgatcacccttgtcctgtct

SEQ ID NO: 17458 - DNA, 20 bp, synthetic construct
  misc_feature 1..20: note = CRISPR gRNA sequence
  source 1..20: mol_type = other DNA
cccttgtcctgtctgggctc

SEQ ID NO: 17459 - DNA, 20 bp, synthetic construct
  misc_feature 1..20: note = CRISPR gRNA sequence
  source 1..20: mol_type = other DNA
gtcctgtctgggctcaagca

SEQ ID NO: 17460 - DNA, 20 bp, synthetic construct
  misc_feature 1..20: note = CRISPR gRNA sequence
  source 1..20: mol_type = other DNA
cctgtctgggctcaagcata

SEQ ID NO: 17461 - DNA, 20 bp, synthetic construct
  misc_feature 1..20: note = CRISPR gRNA sequence
  source 1..20: mol_type = other DNA
tgggctcaagcatagagaca

SEQ ID NO: 17462 - DNA, 20 bp, synthetic construct
  misc_feature 1..20: note = CRISPR gRNA sequence
  source 1..20: mol_type = other DNA
gggctcaagcatagagacac

SEQ ID NO: 17463 - DNA, 20 bp, synthetic construct
  misc_feature 1..20: note = CRISPR gRNA sequence
  source 1..20: mol_type = other DNA
ctcaagcatagagacacagg

SEQ ID NO: 17464 - DNA, 20 bp, synthetic construct
  misc_feature 1..20: note = CRISPR gRNA sequence
  source 1..20: mol_type = other DNA
tagagacacaggtggtatca

SEQ ID NO: 17465 - DNA, 20 bp, synthetic construct
  misc_feature 1..20: note = CRISPR gRNA sequence
  source 1..20: mol_type = other DNA
gacacaggtggtatcacaga

SEQ ID NO: 17466 - DNA, 20 bp, synthetic construct
  misc_feature 1..20: note = CRISPR gRNA sequence
  source 1..20: mol_type = other DNA
acacaggtggtatcacagat

SEQ ID NO: 17467 - DNA, 20 bp, synthetic construct
  misc_feature 1..20: note = CRISPR gRNA sequence
  source 1..20: mol_type = other DNA
cacaggtggtatcacagatg

SEQ ID NO: 17468 - DNA, 20 bp, synthetic construct
  misc_feature 1..20: note = CRISPR gRNA sequence
  source 1..20: mol_type = other DNA
acaggtggtatcacagatgg

SEQ ID NO: 17469 - DNA, 20 bp, synthetic construct
  misc_feature 1..20: note = CRISPR gRNA sequence
  source 1..20: mol_type = other DNA
gtggtatcacagatggggga

SEQ ID NO: 17470 - DNA, 20 bp, synthetic construct
  misc_feature 1..20: note = CRISPR gRNA sequence
  source 1..20: mol_type = other DNA
gtatcacagatgggggatgg

SEQ ID NO: 17471 - DNA, 20 bp, synthetic construct
  misc_feature 1..20: note = CRISPR gRNA sequence
  source 1..20: mol_type = other DNA
tatcacagatgggggatggt

SEQ ID NO: 17472 - DNA, 20 bp, synthetic construct
  misc_feature 1..20: note = CRISPR gRNA sequence
  source 1..20: mol_type = other DNA
tcacagatgggggatggtgg

SEQ ID NO: 17473 - DNA, 20 bp, synthetic construct
  misc_feature 1..20: note = CRISPR gRNA sequence
  source 1..20: mol_type = other DNA
cacagatgggggatggtggg

SEQ ID NO: 17474 - DNA, 20 bp, synthetic construct
  misc_feature 1..20: note = CRISPR gRNA sequence
  source 1..20: mol_type = other DNA
acagatgggggatggtggga

SEQ ID NO: 17475 - DNA, 20 bp, synthetic construct
  misc_feature 1..20: note = CRISPR gRNA sequence
  source 1..20: mol_type = other DNA
ggggatggtgggagggaccg

SEQ ID NO: 17476 - DNA, 20 bp, synthetic construct
  misc_feature 1..20: note = CRISPR gRNA sequence
  source 1..20: mol_type = other DNA
gggatggtgggagggaccgc

SEQ ID NO: 17477 - DNA, 20 bp, synthetic construct
  misc_feature 1..20: note = CRISPR gRNA sequence
  source 1..20: mol_type = other DNA
ggatggtgggagggaccgca

SEQ ID NO: 17478 - DNA, 20 bp, synthetic construct
  misc_feature 1..20: note = CRISPR gRNA sequence
  source 1..20: mol_type = other DNA
atggtgggagggaccgcagg

SEQ ID NO: 17479 - DNA, 20 bp, synthetic construct
  misc_feature 1..20: note = CRISPR gRNA sequence
  source 1..20: mol_type = other DNA
tggtgggagggaccgcaggg

SEQ ID NO: 17480 - DNA, 20 bp, synthetic construct
  misc_feature 1..20: note = CRISPR gRNA sequence
  source 1..20: mol_type = other DNA
gtgggagggaccgcagggag

SEQ ID NO: 17481 - DNA, 20 bp, synthetic construct
  misc_feature 1..20: note = CRISPR gRNA sequence
  source 1..20: mol_type = other DNA
agggaccgcagggaggagcc

SEQ ID NO: 17482 - DNA, 20 bp, synthetic construct
  misc_feature 1..20: note = CRISPR gRNA sequence
  source 1..20: mol_type = other DNA
ggaccgcagggaggagcctg

SEQ ID NO: 17483 - DNA, 20 bp, synthetic construct
  misc_feature 1..20: note = CRISPR gRNA sequence
  source 1..20: mol_type = other DNA
gggaggagcctggagacatt

SEQ ID NO: 17484 - DNA, 20 bp, synthetic construct
  misc_feature 1..20: note = CRISPR gRNA sequence
  source 1..20: mol_type = other DNA
gcccacccccacttattgat

SEQ ID NO: 17485 - DNA, 20 bp, synthetic construct
  misc_feature 1..20: note = CRISPR gRNA sequence
  source 1..20: mol_type = other DNA
atgagctctgcttcaaactc

SEQ ID NO: 17486 - DNA, 20 bp, synthetic construct
  misc_feature 1..20: note = CRISPR gRNA sequence
  source 1..20: mol_type = other DNA
ctctggatgacactgctgtg

SEQ ID NO: 17487 - DNA, 20 bp, synthetic construct
  misc_feature 1..20: note = CRISPR gRNA sequence
  source 1..20: mol_type = other DNA
gatgacactgctgtgtggtt

SEQ ID NO: 17488 - DNA, 20 bp, synthetic construct
  misc_feature 1..20: note = CRISPR gRNA sequence
  source 1..20: mol_type = other DNA
ctgctgtgtggttaagcaca

SEQ ID NO: 17489 - DNA, 20 bp, synthetic construct
  misc_feature 1..20: note = CRISPR gRNA sequence
  source 1..20: mol_type = other DNA
tgtgtggttaagcacacagt

SEQ ID NO: 17490 - DNA, 20 bp, synthetic construct
  misc_feature 1..20: note = CRISPR gRNA sequence
  source 1..20: mol_type = other DNA
tgtggttaagcacacagtca

SEQ ID NO: 17491 - DNA, 20 bp, synthetic construct
  misc_feature 1..20: note = CRISPR gRNA sequence
  source 1..20: mol_type = other DNA
cacagtcagagaaataaatt

SEQ ID NO: 17492 - DNA, 20 bp, synthetic construct
  misc_feature 1..20: note = CRISPR gRNA sequence
  source 1..20: mol_type = other DNA
agtcagagaaataaattgag

SEQ ID NO: 17493 - DNA, 20 bp, synthetic construct
  misc_feature 1..20: note = CRISPR gRNA sequence
  source 1..20: mol_type = other DNA
gtcagagaaataaattgaga

SEQ ID NO: 17494 - DNA, 20 bp, synthetic construct
  misc_feature 1..20: note = CRISPR gRNA sequence
  source 1..20: mol_type = other DNA
tcagagaaataaattgagaa

SEQ ID NO: 17495 - DNA, 20 bp, synthetic construct
  misc_feature 1..20: note = CRISPR gRNA sequence
  source 1..20: mol_type = other DNA
agaaataaattgagaaggga

SEQ ID NO: 17496 - DNA, 20 bp, synthetic construct
  misc_feature 1..20: note = CRISPR gRNA sequence
  source 1..20: mol_type = other DNA
aataaattgagaagggaaag

SEQ ID NO: 17497 - DNA, 20 bp, synthetic construct
  misc_feature 1..20: note = CRISPR gRNA sequence
  source 1..20: mol_type = other DNA
ataaattgagaagggaaaga

SEQ ID NO: 17498 - DNA, 20 bp, synthetic construct
  misc_feature 1..20: note = CRISPR gRNA sequence
  source 1..20: mol_type = other DNA
attgagaagggaaagaaggc

SEQ ID NO: 17499 - DNA, 20 bp, synthetic construct
  misc_feature 1..20: note = CRISPR gRNA sequence
  source 1..20: mol_type = other DNA
ggaaagaaggcaagtatcgt

SEQ ID NO: 17500 - DNA, 20 bp, synthetic construct
  misc_feature 1..20: note = CRISPR gRNA sequence
  source 1..20: mol_type = other DNA
aaggcaagtatcgtgagctt

SEQ ID NO: 17501 - DNA, 20 bp, synthetic construct
  misc_feature 1..20: note = CRISPR gRNA sequence
  source 1..20: mol_type = other DNA
gcgtaaaatttaccaacttt

SEQ ID NO: 17502 - DNA, 20 bp, synthetic construct
  misc_feature 1..20: note = CRISPR gRNA sequence
  source 1..20: mol_type = other DNA
cctaccaacacactgtaacc

SEQ ID NO: 17503 - DNA, 20 bp, synthetic construct
  misc_feature 1..20: note = CRISPR gRNA sequence
  source 1..20: mol_type = other DNA
ctaccaacacactgtaacct

SEQ ID NO: 17504 - DNA, 20 bp, synthetic construct
  misc_feature 1..20: note = CRISPR gRNA sequence
  source 1..20: mol_type = other DNA
caacacactgtaacctgggc

SEQ ID NO: 17505 - DNA, 20 bp, synthetic construct
  misc_feature 1..20: note = CRISPR gRNA sequence
  source 1..20: mol_type = other DNA
agttcattttttaaaccact

SEQ ID NO: 17506 - DNA, 20 bp, synthetic construct
  misc_feature 1..20: note = CRISPR gRNA sequence
  source 1..20: mol_type = other DNA
ttcattttttaaaccacttg

SEQ ID NO: 17507 - DNA, 20 bp, synthetic construct
  misc_feature 1..20: note = CRISPR gRNA sequence
  source 1..20: mol_type = other DNA
ttttaaaccacttggagcct

SEQ ID NO: 17508 - DNA, 20 bp, synthetic construct
  misc_feature 1..20: note = CRISPR gRNA sequence
  source 1..20: mol_type = other DNA
tataaaatgcgaataataat

SEQ ID NO: 17509 - DNA, 20 bp, synthetic construct
  misc_feature 1..20: note = CRISPR gRNA sequence
  source 1..20: mol_type = other DNA
aataataattggcaactcac

SEQ ID NO: 17510 - DNA, 20 bp, synthetic construct
  misc_feature 1..20: note = CRISPR gRNA sequence
  source 1..20: mol_type = other DNA
ataataattggcaactcaca

SEQ ID NO: 17511 - DNA, 20 bp, synthetic construct
  misc_feature 1..20: note = CRISPR gRNA sequence
  source 1..20: mol_type = other DNA
aattggcaactcacaaggat

SEQ ID NO: 17512 - DNA, 20 bp, synthetic construct
  misc_feature 1..20: note = CRISPR gRNA sequence
  source 1..20: mol_type = other DNA
attggcaactcacaaggatt

SEQ ID NO: 17513 - DNA, 20 bp, synthetic construct
  misc_feature 1..20: note = CRISPR gRNA sequence
  source 1..20: mol_type = other DNA
ttggcaactcacaaggatta

SEQ ID NO: 17514 - DNA, 20 bp, synthetic construct
  misc_feature 1..20: note = CRISPR gRNA sequence
  source 1..20: mol_type = other DNA
tggcaactcacaaggattag

SEQ ID NO: 17515 - DNA, 20 bp, synthetic construct
  misc_feature 1..20: note = CRISPR gRNA sequence
  source 1..20: mol_type = other DNA
gcaactcacaaggattaggg

SEQ ID NO: 17516 - DNA, 20 bp, synthetic construct
  misc_feature 1..20: note = CRISPR gRNA sequence
  source 1..20: mol_type = other DNA
tcacaaggattaggggagtt

SEQ ID NO: 17517 - DNA, 20 bp, synthetic construct
  misc_feature 1..20: note = CRISPR gRNA sequence
  source 1..20: mol_type = other DNA
attaggggagttaagtcacg

SEQ ID NO: 17518 - DNA, 20 bp, synthetic construct
  misc_feature 1..20: note = CRISPR gRNA sequence
  source 1..20: mol_type = other DNA
taggggagttaagtcacgcg

SEQ ID NO: 17519 - DNA, 20 bp, synthetic construct
  misc_feature 1..20: note = CRISPR gRNA sequence
  source 1..20: mol_type = other DNA
gttaagtcacgcggagccct

SEQ ID NO: 17520 - DNA, 20 bp, synthetic construct
  misc_feature 1..20: note = CRISPR gRNA sequence
  source 1..20: mol_type = other DNA
tcacgcggagcccttagcaa

SEQ ID NO: 17521 - DNA, 20 bp, synthetic construct
  misc_feature 1..20: note = CRISPR gRNA sequence
  source 1..20: mol_type = other DNA
cacgcggagcccttagcaat

SEQ ID NO: 17522 - DNA, 20 bp, synthetic construct
  misc_feature 1..20: note = CRISPR gRNA sequence
  source 1..20: mol_type = other DNA
ggagcccttagcaatgggac

SEQ ID NO: 17523 - DNA, 20 bp, synthetic construct
  misc_feature 1..20: note = CRISPR gRNA sequence
  source 1..20: mol_type = other DNA
ttagcaatgggactggcaat

SEQ ID NO: 17524 - DNA, 20 bp, synthetic construct
  misc_feature 1..20: note = CRISPR gRNA sequence
  source 1..20: mol_type = other DNA
caatgggactggcaatcagt

SEQ ID NO: 17525 - DNA, 20 bp, synthetic construct
  misc_feature 1..20: note = CRISPR gRNA sequence
  source 1..20: mol_type = other DNA
atcagtaagtgctgaatgaa

SEQ ID NO: 17526 - DNA, 20 bp, synthetic construct
  misc_feature 1..20: note = CRISPR gRNA sequence
  source 1..20: mol_type = other DNA
agtaagtgctgaatgaacag

SEQ ID NO: 17527 - DNA, 20 bp, synthetic construct
  misc_feature 1..20: note = CRISPR gRNA sequence
  source 1..20: mol_type = other DNA
tgctgaatgaacagaagttt

SEQ ID NO: 17528 - DNA, 20 bp, synthetic construct
  misc_feature 1..20: note = CRISPR gRNA sequence
  source 1..20: mol_type = other DNA
gctgaatgaacagaagttta

SEQ ID NO: 17529 - DNA, 20 bp, synthetic construct
  misc_feature 1..20: note = CRISPR gRNA sequence
  source 1..20: mol_type = other DNA
gaatgaacagaagtttaagg

SEQ ID NO: 17530 - DNA, 20 bp, synthetic construct
  misc_feature 1..20: note = CRISPR gRNA sequence
  source 1..20: mol_type = other DNA
aacagaagtttaaggcagca

SEQ ID NO: 17531 - DNA, 20 bp, synthetic construct
  misc_feature 1..20: note = CRISPR gRNA sequence
  source 1..20: mol_type = other DNA
aaggcagcacagcttctaca

SEQ ID NO: 17532 - DNA, 20 bp, synthetic construct
  misc_feature 1..20: note = CRISPR gRNA sequence
  source 1..20: mol_type = other DNA
cagcacagcttctacatggt

SEQ ID NO: 17533 - DNA, 20 bp, synthetic construct
  misc_feature 1..20: note = CRISPR gRNA sequence
  source 1..20: mol_type = other DNA
ggtgagtataatatgtgtga

SEQ ID NO: 17534 - DNA, 20 bp, synthetic construct
  misc_feature 1..20: note = CRISPR gRNA sequence
  source 1..20: mol_type = other DNA
tgtgtgatggccatcattat

SEQ ID NO: 17535 - DNA, 20 bp, synthetic construct
  misc_feature 1..20: note = CRISPR gRNA sequence
  source 1..20: mol_type = other DNA
agtttgcttcttacgtttgt

SEQ ID NO: 17536 - DNA, 20 bp, synthetic construct
  misc_feature 1..20: note = CRISPR gRNA sequence
  source 1..20: mol_type = other DNA
tttgcttcttacgtttgtga

SEQ ID NO: 17537 - DNA, 20 bp, synthetic construct
  misc_feature 1..20: note = CRISPR gRNA sequence
  source 1..20: mol_type = other DNA
ttacgtttgtgagagtgaca

SEQ ID NO: 17538 - DNA, 20 bp, synthetic construct
  misc_feature 1..20: note = CRISPR gRNA sequence
  source 1..20: mol_type = other DNA
tacgtttgtgagagtgacaa

SEQ ID NO: 17539 - DNA, 20 bp, synthetic construct
  misc_feature 1..20: note = CRISPR gRNA sequence
  source 1..20: mol_type = other DNA
acgtttgtgagagtgacaaa

SEQ ID NO: 17540 - DNA, 20 bp, synthetic construct
  misc_feature 1..20: note = CRISPR gRNA sequence
  source 1..20: mol_type = other DNA
ctttcccttccatttcttcc

SEQ ID NO: 17541 - DNA, 20 bp, synthetic construct
  misc_feature 1..20: note = CRISPR gRNA sequence
  source 1..20: mol_type = other DNA
tttcccttccatttcttccg

SEQ ID NO: 17542 - DNA, 20 bp, synthetic construct
  misc_feature 1..20: note = CRISPR gRNA sequence
  source 1..20: mol_type = other DNA
ttccgaggtcaaactttgtg

SEQ ID NO: 17543 - DNA, 20 bp, synthetic construct
  misc_feature 1..20: note = CRISPR gRNA sequence
  source 1..20: mol_type = other DNA
aggtcaaactttgtgaagcc

SEQ ID NO: 17544 - DNA, 20 bp, synthetic construct
  misc_feature 1..20: note = CRISPR gRNA sequence
  source 1..20: mol_type = other DNA
agctttctgttcttttgcat

SEQ ID NO: 17545 - DNA, 20 bp, synthetic construct
  misc_feature 1..20: note = CRISPR gRNA sequence
  source 1..20: mol_type = other DNA
gctttctgttcttttgcata

SEQ ID NO: 17546 - DNA, 20 bp, synthetic construct
  misc_feature 1..20: note = CRISPR gRNA sequence
  source 1..20: mol_type = other DNA
ctttctgttcttttgcataa

SEQ ID NO: 17547 - DNA, 20 bp, synthetic construct
  misc_feature 1..20: note = CRISPR gRNA sequence
  source 1..20: mol_type = other DNA
tttctgttcttttgcataag

SEQ ID NO: 17548 - DNA, 20 bp, synthetic construct
  misc_feature 1..20: note = CRISPR gRNA sequence
  source 1..20: mol_type = other DNA
ttttgcataaggggaccctg

SEQ ID NO: 17549 - DNA, 20 bp, synthetic construct
  misc_feature 1..20: note = CRISPR gRNA sequence
  source 1..20: mol_type = other DNA
aggggaccctgcagacttca

SEQ ID NO: 17550 - DNA, 20 bp, synthetic construct
  misc_feature 1..20: note = CRISPR gRNA sequence
  source 1..20: mol_type = other DNA
ggggaccctgcagacttcat

SEQ ID NO: 17551 - DNA, 20 bp, synthetic construct
  misc_feature 1..20: note = CRISPR gRNA sequence
  source 1..20: mol_type = other DNA
cctgcagacttcataggaac

SEQ ID NO: 17552 - DNA, 20 bp, synthetic construct
  misc_feature 1..20: note = CRISPR gRNA sequence
  source 1..20: mol_type = other DNA
gcagacttcataggaacaag

SEQ ID NO: 17553 - DNA, 20 bp, synthetic construct
  misc_feature 1..20: note = CRISPR gRNA sequence
  source 1..20: mol_type = other DNA
cagacttcataggaacaaga

SEQ ID NO: 17554 - DNA, 20 bp, synthetic construct
  misc_feature 1..20: note = CRISPR gRNA sequence
  source 1..20: mol_type = other DNA
agacttcataggaacaagaa

SEQ ID NO: 17555 - DNA, 20 bp, synthetic construct
  misc_feature 1..20: note = CRISPR gRNA sequence
  source 1..20: mol_type = other DNA
taggaacaagaagggcccca

SEQ ID NO: 17556 - DNA, 20 bp, synthetic construct
  misc_feature 1..20: note = CRISPR gRNA sequence
  source 1..20: mol_type = other DNA
aggaacaagaagggccccat

SEQ ID NO: 17557 - DNA, 20 bp, synthetic construct
  misc_feature 1..20: note = CRISPR gRNA sequence
  source 1..20: mol_type = other DNA
acaagaagggccccataggc

SEQ ID NO: 17558 - DNA, 20 bp, synthetic construct
  misc_feature 1..20: note = CRISPR gRNA sequence
  source 1..20: mol_type = other DNA
caagaagggccccataggcc

SEQ ID NO: 17559 - DNA, 20 bp, synthetic construct
  misc_feature 1..20: note = CRISPR gRNA sequence
  source 1..20: mol_type = other DNA
agggccccataggccgggca

SEQ ID NO: 17560 - DNA, 20 bp, synthetic construct
  misc_feature 1..20: note = CRISPR gRNA sequence
  source 1..20: mol_type = other DNA
gccccataggccgggcatgg

SEQ ID NO: 17561 - DNA, 20 bp, synthetic construct
  misc_feature 1..20: note = CRISPR gRNA sequence
  source 1..20: mol_type = other DNA
ggcatggtggctcacatctg

SEQ ID NO: 17562 - DNA, 20 bp, synthetic construct
  misc_feature 1..20: note = CRISPR gRNA sequence
  source 1..20: mol_type = other DNA
gctcacatctgtagaaattc

SEQ ID NO: 17563 - DNA, 20 bp, synthetic construct
  misc_feature 1..20: note = CRISPR gRNA sequence
  source 1..20: mol_type = other DNA
ctgtagaaattccagcactt

SEQ ID NO: 17564 - DNA, 20 bp, synthetic construct
  misc_feature 1..20: note = CRISPR gRNA sequence
  source 1..20: mol_type = other DNA
tgtagaaattccagcacttt

SEQ ID NO: 17565 - DNA, 20 bp, synthetic construct
  misc_feature 1..20: note = CRISPR gRNA sequence
  source 1..20: mol_type = other DNA
tagaaattccagcactttgg

SEQ ID NO: 17566 - DNA, 20 bp, synthetic construct
  misc_feature 1..20: note = CRISPR gRNA sequence
  source 1..20: mol_type = other DNA
ttccagcactttgggagtcc

SEQ ID NO: 17567 - DNA, 20 bp, synthetic construct
  misc_feature 1..20: note = CRISPR gRNA sequence
  source 1..20: mol_type = other DNA
tccagcactttgggagtcca

SEQ ID NO: 17568 - DNA, 20 bp, synthetic construct
  misc_feature 1..20: note = CRISPR gRNA sequence
  source 1..20: mol_type = other DNA
agcactttgggagtccaagg

SEQ ID NO: 17569 - DNA, 20 bp, synthetic construct
  misc_feature 1..20: note = CRISPR gRNA sequence
  source 1..20: mol_type = other DNA
gcactttgggagtccaaggc

SEQ ID NO: 17570 - DNA, 20 bp, synthetic construct
  misc_feature 1..20: note = CRISPR gRNA sequence
  source 1..20: mol_type = other DNA
actttgggagtccaaggcag

SEQ ID NO: 17571 - DNA, 20 bp, synthetic construct
  misc_feature 1..20: note = CRISPR gRNA sequence
  source 1..20: mol_type = other DNA
ccaaggcaggagtatcacct

SEQ ID NO: 17572 - DNA, 20 bp, synthetic construct
  misc_feature 1..20: note = CRISPR gRNA sequence
  source 1..20: mol_type = other DNA
gcaggagtatcacctcagtc

SEQ ID NO: 17573 - DNA, 20 bp, synthetic construct
  misc_feature 1..20: note = CRISPR gRNA sequence
  source 1..20: mol_type = other DNA
caggagtatcacctcagtcc

SEQ ID NO: 17574 - DNA, 20 bp, synthetic construct
  misc_feature 1..20: note = CRISPR gRNA sequence
  source 1..20: mol_type = other DNA
ggagtatcacctcagtccag

SEQ ID NO: 17575 - DNA, 20 bp, synthetic construct
  misc_feature 1..20: note = CRISPR gRNA sequence
  source 1..20: mol_type = other DNA
tcacctcagtccaggagttt

SEQ ID NO: 17576 - DNA, 20 bp, synthetic construct
  misc_feature 1..20: note = CRISPR gRNA sequence
  source 1..20: mol_type = other DNA
tcagtccaggagtttgagac

SEQ ID NO: 17577 - DNA, 20 bp, synthetic construct
  misc_feature 1..20: note = CRISPR gRNA sequence
  source 1..20: mol_type = other DNA
ccaggagtttgagaccagcc

SEQ ID NO: 17578 - DNA, 20 bp, synthetic construct
  misc_feature 1..20: note = CRISPR gRNA sequence
  source 1..20: mol_type = other DNA
caggagtttgagaccagcct

SEQ ID NO: 17579 - DNA, 20 bp, synthetic construct
  misc_feature 1..20: note = CRISPR gRNA sequence
  source 1..20: mol_type = other DNA
tgagaccagcctgggcaaca

SEQ ID NO: 17580 - DNA, 20 bp, synthetic construct
  misc_feature 1..20: note = CRISPR gRNA sequence
  source 1..20: mol_type = other DNA
ccagcctgggcaacatggtg

SEQ ID NO: 17581 - DNA, 20 bp, synthetic construct
  misc_feature 1..20: note = CRISPR gRNA sequence
  source 1..20: mol_type = other DNA
tctacaaataacacaaaact

SEQ ID NO: 17582 - DNA, 20 bp, synthetic construct
  misc_feature 1..20: note = CRISPR gRNA sequence
  source 1..20: mol_type = other DNA
caaataacacaaaacttagc

SEQ ID NO: 17583 - DNA, 20 bp, synthetic construct
  misc_feature 1..20: note = CRISPR gRNA sequence
  source 1..20: mol_type = other DNA
aaataacacaaaacttagct

SEQ ID NO: 17584 - DNA, 20 bp, synthetic construct
  misc_feature 1..20: note = CRISPR gRNA sequence
  source 1..20: mol_type = other DNA
acacaaaacttagctgggcg

SEQ ID NO: 17585 - DNA, 20 bp, synthetic construct
  misc_feature 1..20: note = CRISPR gRNA sequence
  source 1..20: mol_type = other DNA
ggcgtggtgatgtgcatctg

SEQ ID NO: 17586 - DNA, 20 bp, synthetic construct
  misc_feature 1..20: note = CRISPR gRNA sequence
  source 1..20: mol_type = other DNA
gtgatgtgcatctgtagaac

SEQ ID NO: 17587 - DNA, 20 bp, synthetic construct
  misc_feature 1..20: note = CRISPR gRNA sequence
  source 1..20: mol_type = other DNA
catctgtagaaccagctact

SEQ ID NO: 17588 - DNA, 20 bp, synthetic construct
  misc_feature 1..20: note = CRISPR gRNA sequence
  source 1..20: mol_type = other DNA
atctgtagaaccagctactc

SEQ ID NO: 17589 - DNA, 20 bp, synthetic construct
  misc_feature 1..20: note = CRISPR gRNA sequence
  source 1..20: mol_type = other DNA
ctgtagaaccagctactcag

SEQ ID NO: 17590 - DNA, 20 bp, synthetic construct
  misc_feature 1..20: note = CRISPR gRNA sequence
  source 1..20: mol_type = other DNA
tgtagaaccagctactcagg

SEQ ID NO: 17591 - DNA, 20 bp, synthetic construct
  misc_feature 1..20: note = CRISPR gRNA sequence
  source 1..20: mol_type = other DNA
aaccagctactcaggaggct

SEQ ID NO: 17592 - DNA, 20 bp, synthetic construct
  misc_feature 1..20: note = CRISPR gRNA sequence
  source 1..20: mol_type = other DNA
accagctactcaggaggctg

SEQ ID NO: 17593 - DNA, 20 bp, synthetic construct
  misc_feature 1..20: note = CRISPR gRNA sequence
  source 1..20: mol_type = other DNA
agctactcaggaggctgagg

SEQ ID NO: 17594 - DNA, 20 bp, synthetic construct
  misc_feature 1..20: note = CRISPR gRNA sequence
  source 1..20: mol_type = other DNA
gctactcaggaggctgaggt

SEQ ID NO: 17595 - DNA, 20 bp, synthetic construct
  misc_feature 1..20: note = CRISPR gRNA sequence
  source 1..20: mol_type = other DNA
tactcaggaggctgaggtgg

SEQ ID NO: 17596 - DNA, 20 bp, synthetic construct
  misc_feature 1..20: note = CRISPR gRNA sequence
  source 1..20: mol_type = other DNA
actcaggaggctgaggtggg

SEQ ID NO: 17597 - DNA, 20 bp, synthetic construct
  misc_feature 1..20: note = CRISPR gRNA sequence
  source 1..20: mol_type = other DNA
aggaggctgaggtgggagga

SEQ ID NO: 17598 - DNA, 20 bp, synthetic construct
  misc_feature 1..20: note = CRISPR gRNA sequence
  source 1..20: mol_type = other DNA
ctgaggtgggaggatagctt

SEQ ID NO: 17599 - DNA, 20 bp, synthetic construct
  misc_feature 1..20: note = CRISPR gRNA sequence
  source 1..20: mol_type = other DNA
gtgggaggatagcttgagcc

SEQ ID NO: 17600 - DNA, 20 bp, synthetic construct
  misc_feature 1..20: note = CRISPR gRNA sequence
  source 1..20: mol_type = other DNA
tgggaggatagcttgagcct

SEQ ID NO: 17601 - DNA, 20 bp, synthetic construct
  misc_feature 1..20: note = CRISPR gRNA sequence
  source 1..20: mol_type = other DNA
gggaggatagcttgagcctg

SEQ ID NO: 17602 - DNA, 20 bp, synthetic construct
  misc_feature 1..20: note = CRISPR gRNA sequence
  source 1..20: mol_type = other DNA
gaggatagcttgagcctggg

SEQ ID NO: 17603 - DNA, 20 bp, synthetic construct
  misc_feature 1..20: note = CRISPR gRNA sequence
  source 1..20: mol_type = other DNA
aggatagcttgagcctgggg

SEQ ID NO: 17604 - DNA, 20 bp, synthetic construct
  misc_feature 1..20: note = CRISPR gRNA sequence
  source 1..20: mol_type = other DNA
cttgagcctggggaggtgtc

SEQ ID NO: 17605 - DNA, 20 bp, synthetic construct
  misc_feature 1..20: note = CRISPR gRNA sequence
  source 1..20: mol_type = other DNA
ttgagcctggggaggtgtca

SEQ ID NO: 17606 - DNA, 20 bp, synthetic construct
  misc_feature 1..20: note = CRISPR gRNA sequence
  source 1..20: mol_type = other DNA
ctggggaggtgtcaaggctg

SEQ ID NO: 17607 - DNA, 20 bp, synthetic construct
  misc_feature 1..20: note = CRISPR gRNA sequence
  source 1..20: mol_type = other DNA
tgtcaaggctgcagtgaact

SEQ ID NO: 17608 - DNA, 20 bp, synthetic construct
  misc_feature 1..20: note = CRISPR gRNA sequence
  source 1..20: mol_type = other DNA
gagattgcaccactgcactc

SEQ ID NO: 17609 - DNA, 20 bp, synthetic construct
  misc_feature 1..20: note = CRISPR gRNA sequence
  source 1..20: mol_type = other DNA
tgcaccactgcactccagcc

SEQ ID NO: 17610 - DNA, 20 bp, synthetic construct
  misc_feature 1..20: note = CRISPR gRNA sequence
  source 1..20: mol_type = other DNA
gcaccactgcactccagcct

SEQ ID NO: 17611 - DNA, 20 bp, synthetic construct
  misc_feature 1..20: note = CRISPR gRNA sequence
  source 1..20: mol_type = other DNA
ctgcactccagcctgggtga

SEQ ID NO: 17612 - DNA, 20 bp, synthetic construct
  misc_feature 1..20: note = CRISPR gRNA sequence
  source 1..20: mol_type = other DNA
gcactccagcctgggtgata

SEQ ID NO: 17613 - DNA, 20 bp, synthetic construct
  misc_feature 1..20: note = CRISPR gRNA sequence
  source 1..20: mol_type = other DNA
tccagcctgggtgatagagc

SEQ ID NO: 17614 - DNA, 20 bp, synthetic construct
  misc_feature 1..20: note = CRISPR gRNA sequence
  source 1..20: mol_type = other DNA
gatagagccagactgtgtct

SEQ ID NO: 17615 - DNA, 20 bp, synthetic construct
  misc_feature 1..20: note = CRISPR gRNA sequence
  source 1..20: mol_type = other DNA
tgtgtctcagaaaaaaaaaa

SEQ ID NO: 17616 - DNA, 20 bp, synthetic construct
  misc_feature 1..20: note = CRISPR gRNA sequence
  source 1..20: mol_type = other DNA
gtgtctcagaaaaaaaaaaa

SEQ ID NO: 17617 - DNA, 20 bp, synthetic construct
  misc_feature 1..20: note = CRISPR gRNA sequence
  source 1..20: mol_type = other DNA
aaaaaaaaaaaaggccccca

SEQ ID NO: 17618 - DNA, 20 bp, synthetic construct
  misc_feature 1..20: note = CRISPR gRNA sequence
  source 1..20: mol_type = other DNA
aaaaaaaaggcccccacagc

SEQ ID NO: 17619 - DNA, 20 bp, synthetic construct
  misc_feature 1..20: note = CRISPR gRNA sequence
  source 1..20: mol_type = other DNA
aaaaaggcccccacagccag

SEQ ID NO: 17620 - DNA, 20 bp, synthetic construct
  misc_feature 1..20: note = CRISPR gRNA sequence
  source 1..20: mol_type = other DNA
aaaaggcccccacagccagc

SEQ ID NO: 17621 - DNA, 20 bp, synthetic construct
  misc_feature 1..20: note = CRISPR gRNA sequence
  source 1..20: mol_type = other DNA
aaaggcccccacagccagca

SEQ ID NO: 17622 - DNA, 20 bp, synthetic construct
  misc_feature 1..20: note = CRISPR gRNA sequence
  source 1..20: mol_type = other DNA
ggcccccacagccagcaggg

SEQ ID NO: 17623 - DNA, 20 bp, synthetic construct
  misc_feature 1..20: note = CRISPR gRNA sequence
  source 1..20: mol_type = other DNA
ccacagccagcagggcagct

SEQ ID NO: 17624 - DNA, 20 bp, synthetic construct
  misc_feature 1..20: note = CRISPR gRNA sequence
  source 1..20: mol_type = other DNA
agccagcagggcagcttgga

SEQ ID NO: 17625 - DNA, 20 bp, synthetic construct
  misc_feature 1..20: note = CRISPR gRNA sequence
  source 1..20: mol_type = other DNA
gcagggcagcttggatggtc

SEQ ID NO: 17626 - DNA, 20 bp, synthetic construct
  misc_feature 1..20: note = CRISPR gRNA sequence
  source 1..20: mol_type = other DNA
cgctccccatcaccaccact

SEQ ID NO: 17627 - DNA, 20 bp, synthetic construct
  misc_feature 1..20: note = CRISPR gRNA sequence
  source 1..20: mol_type = other DNA
tccccatcaccaccactgag

SEQ ID NO: 17628 - DNA, 20 bp, synthetic construct
  misc_feature 1..20: note = CRISPR gRNA sequence
  source 1..20: mol_type = other DNA
accaccactgagaagttgcc

SEQ ID NO: 17629 - DNA, 20 bp, synthetic construct
  misc_feature 1..20: note = CRISPR gRNA sequence
  source 1..20: mol_type = other DNA
ccaccactgagaagttgcct

SEQ ID NO: 17630 - DNA, 20 bp, synthetic construct
  misc_feature 1..20: note = CRISPR gRNA sequence
  source 1..20: mol_type = other DNA
tgagaagttgcctgggcaaa

SEQ ID NO: 17631 - DNA, 20 bp, synthetic construct
  misc_feature 1..20: note = CRISPR gRNA sequence
  source 1..20: mol_type = other DNA
ttgcctgggcaaaaagtcac

SEQ ID NO: 17632 - DNA, 20 bp, synthetic construct
  misc_feature 1..20: note = CRISPR gRNA sequence
  source 1..20: mol_type = other DNA
gcctgggcaaaaagtcacca

SEQ ID NO: 17633 - DNA, 20 bp, synthetic construct
  misc_feature 1..20: note = CRISPR gRNA sequence
  source 1..20: mol_type = other DNA
cctgggcaaaaagtcaccag

SEQ ID NO: 17634 - DNA, 20 bp, synthetic construct
  misc_feature 1..20: note = CRISPR gRNA sequence
  source 1..20: mol_type = other DNA
ctgggcaaaaagtcaccaga

SEQ ID NO: 17635 - DNA, 20 bp, synthetic construct
  misc_feature 1..20: note = CRISPR gRNA sequence
  source 1..20: mol_type = other DNA
aaaaagtcaccagagggcct

SEQ ID NO: 17636 - DNA, 20 bp, synthetic construct
  misc_feature 1..20: note = CRISPR gRNA sequence
  source 1..20: mol_type = other DNA
gggcctaagatctgcgtcat

SEQ ID NO: 17637 - DNA, 20 bp, synthetic construct
  misc_feature 1..20: note = CRISPR gRNA sequence
  source 1..20: mol_type = other DNA
tctgcgtcattggctcaacc

SEQ ID NO: 17638 - DNA, 20 bp, synthetic construct
  misc_feature 1..20: note = CRISPR gRNA sequence
  source 1..20: mol_type = other DNA
gtcattggctcaacctggac

SEQ ID NO: 17639 - DNA, 20 bp, synthetic construct
  misc_feature 1..20: note = CRISPR gRNA sequence
  source 1..20: mol_type = other DNA
attggctcaacctggacaag

SEQ ID NO: 17640 - DNA, 20 bp, synthetic construct
  misc_feature 1..20: note = CRISPR gRNA sequence
  source 1..20: mol_type = other DNA
gacaagaagaaaccccctcc

SEQ ID NO: 17641 - DNA, 20 bp, synthetic construct
  misc_feature 1..20: note = CRISPR gRNA sequence
  source 1..20: mol_type = other DNA
aagaagaaaccccctcccag

SEQ ID NO: 17642 - DNA, 20 bp, synthetic construct
  misc_feature 1..20: note = CRISPR gRNA sequence
  source 1..20: mol_type = other DNA
gaagcccccaatacacattt

SEQ ID NO: 17643 - DNA, 20 bp, synthetic construct
  misc_feature 1..20: note = CRISPR gRNA sequence
  source 1..20: mol_type = other DNA
gccccacttcctgcttccct

SEQ ID NO: 17644 - DNA, 20 bp, synthetic construct
  misc_feature 1..20: note = CRISPR gRNA sequence
  source 1..20: mol_type = other DNA
ttcctgcttccctaagactg

SEQ ID NO: 17645 - DNA, 20 bp, synthetic construct
  misc_feature 1..20: note = CRISPR gRNA sequence
  source 1..20: mol_type = other DNA
aagactgaagcctgcacctt

SEQ ID NO: 17646 - DNA, 20 bp, synthetic construct
  misc_feature 1..20: note = CRISPR gRNA sequence
  source 1..20: mol_type = other DNA
gcaccttaagcacttcctct

SEQ ID NO: 17647 - DNA, 20 bp, synthetic construct
  misc_feature 1..20: note = CRISPR gRNA sequence
  source 1..20: mol_type = other DNA
caccttaagcacttcctctt

SEQ ID NO: 17648 - DNA, 20 bp, synthetic construct
  misc_feature 1..20: note = CRISPR gRNA sequence
  source 1..20: mol_type = other DNA
gcacttcctcttgggtgatc

SEQ ID NO: 17649 - DNA, 20 bp, synthetic construct
  misc_feature 1..20: note = CRISPR gRNA sequence
  source 1..20: mol_type = other DNA
cacttcctcttgggtgatca

SEQ ID NO: 17650 - DNA, 20 bp, synthetic construct
  misc_feature 1..20: note = CRISPR gRNA sequence
  source 1..20: mol_type = other DNA
cttgggtgatcaaggatttg

SEQ ID NO: 17651 - DNA, 20 bp, synthetic construct
  misc_feature 1..20: note = CRISPR gRNA sequence
  source 1..20: mol_type = other DNA
gatcaaggatttgcagctca

SEQ ID NO: 17652 - DNA, 20 bp, synthetic construct
  misc_feature 1..20: note = CRISPR gRNA sequence
  source 1..20: mol_type = other DNA
caaggatttgcagctcacag

SEQ ID NO: 17653 - DNA, 20 bp, synthetic construct
  misc_feature 1..20: note = CRISPR gRNA sequence
  source 1..20: mol_type = other DNA
ctccatcctccacaccatct

SEQ ID NO: 17654 - DNA, 20 bp, synthetic construct
  misc_feature 1..20: note = CRISPR gRNA sequence
  source 1..20: mol_type = other DNA
acaccatctgagttcccaaa

SEQ ID NO: 17655 - DNA, 20 bp, synthetic construct
  misc_feature 1..20: note = CRISPR gRNA sequence
  source 1..20: mol_type = other DNA
tctgagttcccaaaaagctc

SEQ ID NO: 17656 - DNA, 20 bp, synthetic construct
  misc_feature 1..20: note = CRISPR gRNA sequence
  source 1..20: mol_type = other DNA
ctgagttcccaaaaagctct

SEQ ID NO: 17657 - DNA, 20 bp, synthetic construct
  misc_feature 1..20: note = CRISPR gRNA sequence
  source 1..20: mol_type = other DNA
tgagttcccaaaaagctctg

SEQ ID NO: 17658 - DNA, 20 bp, synthetic construct
  misc_feature 1..20: note = CRISPR gRNA sequence
  source 1..20: mol_type = other DNA
tcccaaaaagctctggggaa

SEQ ID NO: 17659 - DNA, 20 bp, synthetic construct
  misc_feature 1..20: note = CRISPR gRNA sequence
  source 1..20: mol_type = other DNA
cccaaaaagctctggggaaa

SEQ ID NO: 17660 - DNA, 20 bp, synthetic construct
  misc_feature 1..20: note = CRISPR gRNA sequence
  source 1..20: mol_type = other DNA
aaaaagctctggggaaaagg

SEQ ID NO: 17661 - DNA, 20 bp, synthetic construct
  misc_feature 1..20: note = CRISPR gRNA sequence
  source 1..20: mol_type = other DNA
aaaagctctggggaaaaggc

SEQ ID NO: 17662 - DNA, 20 bp, synthetic construct
  misc_feature 1..20: note = CRISPR gRNA sequence
  source 1..20: mol_type = other DNA
aaagctctggggaaaaggca

SEQ ID NO: 17663 - DNA, 20 bp, synthetic construct
  misc_feature 1..20: note = CRISPR gRNA sequence
  source 1..20: mol_type = other DNA
gctctggggaaaaggcaggg

SEQ ID NO: 17664 - DNA, 20 bp, synthetic construct
  misc_feature 1..20: note = CRISPR gRNA sequence
  source 1..20: mol_type = other DNA
tctggggaaaaggcagggta

SEQ ID NO: 17665 - DNA, 20 bp, synthetic construct
  misc_feature 1..20: note = CRISPR gRNA sequence
  source 1..20: mol_type = other DNA
gtagagtgttatgcccattt

SEQ ID NO: 17666 - DNA, 20 bp, synthetic construct
  misc_feature 1..20: note = CRISPR gRNA sequence
  source 1..20: mol_type = other DNA
gtgttatgcccatttgagct

SEQ ID NO: 17667 - DNA, 20 bp, synthetic construct
  misc_feature 1..20: note = CRISPR gRNA sequence
  source 1..20: mol_type = other DNA
gttatgcccatttgagctta

SEQ ID NO: 17668 - DNA, 20 bp, synthetic construct
  misc_feature 1..20: note = CRISPR gRNA sequence
  source 1..20: mol_type = other DNA
ttatgcccatttgagcttag

SEQ ID NO: 17669 - DNA, 20 bp, synthetic construct
  misc_feature 1..20: note = CRISPR gRNA sequence
  source 1..20: mol_type = other DNA
atgcccatttgagcttagag

SEQ ID NO: 17670 - DNA, 20 bp, synthetic construct
  misc_feature 1..20: note = CRISPR gRNA sequence
  source 1..20: mol_type = other DNA
tgcccatttgagcttagagg

SEQ ID NO: 17671 - DNA, 20 bp, synthetic construct
  misc_feature 1..20: note = CRISPR gRNA sequence
  source 1..20: mol_type = other DNA
tagaggaggttcacacgcct

SEQ ID NO: 17672 - DNA, 20 bp, synthetic construct
  misc_feature 1..20: note = CRISPR gRNA sequence
  source 1..20: mol_type = other DNA
gttcacacgcctcagtgaaa

SEQ ID NO: 17673 - DNA, 20 bp, synthetic construct
  misc_feature 1..20: note = CRISPR gRNA sequence
  source 1..20: mol_type = other DNA
ctcagtgaaatggcttgtcc

SEQ ID NO: 17674 - DNA, 20 bp, synthetic construct
  misc_feature 1..20: note = CRISPR gRNA sequence
  source 1..20: mol_type = other DNA
tcagtgaaatggcttgtcca

SEQ ID NO: 17675 - DNA, 20 bp, synthetic construct
  misc_feature 1..20: note = CRISPR gRNA sequence
  source 1..20: mol_type = other DNA
atggcttgtccaaggtcatg

SEQ ID NO: 17676 - DNA, 20 bp, synthetic construct
  misc_feature 1..20: note = CRISPR gRNA sequence
  source 1..20: mol_type = other DNA
ttgtccaaggtcatgtggtt

SEQ ID NO: 17677 - DNA, 20 bp, synthetic construct
  misc_feature 1..20: note = CRISPR gRNA sequence
  source 1..20: mol_type = other DNA
tgtccaaggtcatgtggttt

SEQ ID NO: 17678 - DNA, 20 bp, synthetic construct
  misc_feature 1..20: note = CRISPR gRNA sequence
  source 1..20: mol_type = other DNA
tccaaggtcatgtggtttag

SEQ ID NO: 17679 - DNA, 20 bp, synthetic construct
  misc_feature 1..20: note = CRISPR gRNA sequence
  source 1..20: mol_type = other DNA
aggagcttgcatctgaattc

SEQ ID NO: 17680 - DNA, 20 bp, synthetic construct
  misc_feature 1..20: note = CRISPR gRNA sequence
  source 1..20: mol_type = other DNA
gaattctggctgtgatgcct

SEQ ID NO: 17681 - DNA, 20 bp, synthetic construct
  misc_feature 1..20: note = CRISPR gRNA sequence
  source 1..20: mol_type = other DNA
ctggctgtgatgccttagcc

SEQ ID NO: 17682 - DNA, 20 bp, synthetic construct
  misc_feature 1..20: note = CRISPR gRNA sequence
  source 1..20: mol_type = other DNA
cacttgacctctctgaacat

SEQ ID NO: 17683 - DNA, 20 bp, synthetic construct
  misc_feature 1..20: note = CRISPR gRNA sequence
  source 1..20: mol_type = other DNA
aacatcagttttcccaatat

SEQ ID NO: 17684 - DNA, 20 bp, synthetic construct
  misc_feature 1..20: note = CRISPR gRNA sequence
  source 1..20: mol_type = other DNA
agttttcccaatattagttc

SEQ ID NO: 17685 - DNA, 20 bp, synthetic construct
  misc_feature 1..20: note = CRISPR gRNA sequence
  source 1..20: mol_type = other DNA
ttttcccaatattagttctg

SEQ ID NO: 17686 - DNA, 20 bp, synthetic construct
  misc_feature 1..20: note = CRISPR gRNA sequence
  source 1..20: mol_type = other DNA
aatattagttctggagaatg

SEQ ID NO: 17687 - DNA, 20 bp, synthetic construct
  misc_feature 1..20: note = CRISPR gRNA sequence
  source 1..20: mol_type = other DNA
ggagaatgaagattgccttg

SEQ ID NO: 17688 - DNA, 20 bp, synthetic construct
  misc_feature 1..20: note = CRISPR gRNA sequence
  source 1..20: mol_type = other DNA
tgccttgcagcccaccactg

SEQ ID NO: 17689 - DNA, 20 bp, synthetic construct
  misc_feature 1..20: note = CRISPR gRNA sequence
  source 1..20: mol_type = other DNA
gccttgcagcccaccactgt

SEQ ID NO: 17690 - DNA, 20 bp, synthetic construct
  misc_feature 1..20: note = CRISPR gRNA sequence
  source 1..20: mol_type = other DNA
cttgcagcccaccactgtgg

SEQ ID NO: 17691 - DNA, 20 bp, synthetic construct
  misc_feature 1..20: note = CRISPR gRNA sequence
  source 1..20: mol_type = other DNA
ttgcagcccaccactgtggg

SEQ ID NO: 17692 - DNA, 20 bp, synthetic construct
  misc_feature 1..20: note = CRISPR gRNA sequence
  source 1..20: mol_type = other DNA
gcccaccactgtgggaggcc

SEQ ID NO: 17693 - DNA, 20 bp, synthetic construct
  misc_feature 1..20: note = CRISPR gRNA sequence
  source 1..20: mol_type = other DNA
cccaccactgtgggaggccg

SEQ ID NO: 17694 - DNA, 20 bp, synthetic construct
  misc_feature 1..20: note = CRISPR gRNA sequence
  source 1..20: mol_type = other DNA
accactgtgggaggccgagg

SEQ ID NO: 17695 - DNA, 20 bp, synthetic construct
  misc_feature 1..20: note = CRISPR gRNA sequence
  source 1..20: mol_type = other DNA
ccactgtgggaggccgaggc

SEQ ID NO: 17696 - DNA, 20 bp, synthetic construct
  misc_feature 1..20: note = CRISPR gRNA sequence
  source 1..20: mol_type = other DNA
ctgtgggaggccgaggcagg

SEQ ID NO: 17697 - DNA, 20 bp, synthetic construct
  misc_feature 1..20: note = CRISPR gRNA sequence
  source 1..20: mol_type = other DNA
ccgaggcaggcagatcactt

SEQ ID NO: 17698 - DNA, 20 bp, synthetic construct
  misc_feature 1..20: note = CRISPR gRNA sequence
  source 1..20: mol_type = other DNA
cgaggcaggcagatcacttg

SEQ ID NO: 17699 - DNA, 20 bp, synthetic construct
  misc_feature 1..20: note = CRISPR gRNA sequence
  source 1..20: mol_type = other DNA
gcaggcagatcacttgaggt

SEQ ID NO: 17700 - DNA, 20 bp, synthetic construct
  misc_feature 1..20: note = CRISPR gRNA sequence
  source 1..20: mol_type = other DNA
caggcagatcacttgaggtc

SEQ ID NO: 17701 - DNA, 20 bp, synthetic construct
  misc_feature 1..20: note = CRISPR gRNA sequence
  source 1..20: mol_type = other DNA
ggcagatcacttgaggtcag

SEQ ID NO: 17702 - DNA, 20 bp, synthetic construct
  misc_feature 1..20: note = CRISPR gRNA sequence
  source 1..20: mol_type = other DNA
tcacttgaggtcaggagttt

SEQ ID NO: 17703 - DNA, 20 bp, synthetic construct
  misc_feature 1..20: note = CRISPR gRNA sequence
  source 1..20: mol_type = other DNA
tgaggtcaggagtttgagac

SEQ ID NO: 17704 - DNA, 20 bp, synthetic construct
  misc_feature 1..20: note = CRISPR gRNA sequence
  source 1..20: mol_type = other DNA
tcaggagtttgagaccagcc

SEQ ID NO: 17705 - DNA, 20 bp, synthetic construct
  misc_feature 1..20: note = CRISPR gRNA sequence
  source 1..20: mol_type = other DNA
caggagtttgagaccagccc

SEQ ID NO: 17706 - DNA, 20 bp, synthetic construct
  misc_feature 1..20: note = CRISPR gRNA sequence
  source 1..20: mol_type = other DNA
tgagaccagcccgggcaaca

SEQ ID NO: 17707 - DNA, 20 bp, synthetic construct
  misc_feature 1..20: note = CRISPR gRNA sequence
  source 1..20: mol_type = other DNA
ctctactaaaaatacaaaat

SEQ ID NO: 17708 - DNA, 20 bp, synthetic construct
  misc_feature 1..20: note = CRISPR gRNA sequence
  source 1..20: mol_type = other DNA
actaaaaatacaaaattagc

SEQ ID NO: 17709 - DNA, 20 bp, synthetic construct
  misc_feature 1..20: note = CRISPR gRNA sequence
  source 1..20: mol_type = other DNA
ctaaaaatacaaaattagcc

SEQ ID NO: 17710 - DNA, 20 bp, synthetic construct
  misc_feature 1..20: note = CRISPR gRNA sequence
  source 1..20: mol_type = other DNA
aatacaaaattagccaggca

SEQ ID NO: 17711 - DNA, 20 bp, synthetic construct
  misc_feature 1..20: note = CRISPR gRNA sequence
  source 1..20: mol_type = other DNA
acaaaattagccaggcatgg

SEQ ID NO: 17712 - DNA, 20 bp, synthetic construct
  misc_feature 1..20: note = CRISPR gRNA sequence
  source 1..20: mol_type = other DNA
gtggcgtgcttctgtaatcc

SEQ ID NO: 17713 - DNA, 20 bp, synthetic construct
  misc_feature 1..20: note = CRISPR gRNA sequence
  source 1..20: mol_type = other DNA
cttctgtaatcccagctact

SEQ ID NO: 17714 - DNA, 20 bp, synthetic construct
  misc_feature 1..20: note = CRISPR gRNA sequence
  source 1..20: mol_type = other DNA
ttctgtaatcccagctactt

SEQ ID NO: 17715 - DNA, 20 bp, synthetic construct
  misc_feature 1..20: note = CRISPR gRNA sequence
  source 1..20: mol_type = other DNA
ctgtaatcccagctacttgg

SEQ ID NO: 17716 - DNA, 20 bp, synthetic construct
  misc_feature 1..20: note = CRISPR gRNA sequence
  source 1..20: mol_type = other DNA
tgtaatcccagctacttggg

SEQ ID NO: 17717 - DNA, 20 bp, synthetic construct
  misc_feature 1..20: note = CRISPR gRNA sequence
  source 1..20: mol_type = other DNA
tcccagctacttgggaggct

SEQ ID NO: 17718 - DNA, 20 bp, synthetic construct
  misc_feature 1..20: note = CRISPR gRNA sequence
  source 1..20: mol_type = other DNA
cccagctacttgggaggctg

SEQ ID NO: 17719 - DNA, 20 bp, synthetic construct
  misc_feature 1..20: note = CRISPR gRNA sequence
  source 1..20: mol_type = other DNA
agctacttgggaggctgagg

SEQ ID NO: 17720 - DNA, 20 bp, synthetic construct
  misc_feature 1..20: note = CRISPR gRNA sequence
  source 1..20: mol_type = other DNA
gctacttgggaggctgaggc

SEQ ID NO: 17721 - DNA, 20 bp, synthetic construct
  misc_feature 1..20: note = CRISPR gRNA sequence
  source 1..20: mol_type = other DNA
tacttgggaggctgaggcag

SEQ ID NO: 17722 - DNA, 20 bp, synthetic construct
  misc_feature 1..20: note = CRISPR gRNA sequence
  source 1..20: mol_type = other DNA
gcaggagaatcgcttgaacc

SEQ ID NO: 17723 - DNA, 20 bp, synthetic construct
  misc_feature 1..20: note = CRISPR gRNA sequence
  source 1..20: mol_type = other DNA
caggagaatcgcttgaacct

SEQ ID NO: 17724 - DNA, 20 bp, synthetic construct
  misc_feature 1..20: note = CRISPR gRNA sequence
  source 1..20: mol_type = other DNA
ggagaatcgcttgaacctgg

SEQ ID NO: 17725 - DNA, 20 bp, synthetic construct
  misc_feature 1..20: note = CRISPR gRNA sequence
  source 1..20: mol_type = other DNA
gagaatcgcttgaacctggg

SEQ ID NO: 17726 - DNA, 20 bp, synthetic construct
  misc_feature 1..20: note = CRISPR gRNA sequence
  source 1..20: mol_type = other DNA
aatcgcttgaacctgggagg

SEQ ID NO: 17727 - DNA, 20 bp, synthetic construct
  misc_feature 1..20: note = CRISPR gRNA sequence
  source 1..20: mol_type = other DNA
tcgcttgaacctgggaggca

SEQ ID NO: 17728 - DNA, 20 bp, synthetic construct
  misc_feature 1..20: note = CRISPR gRNA sequence
  source 1..20: mol_type = other DNA
cgcttgaacctgggaggcag

SEQ ID NO: 17729 - DNA, 20 bp, synthetic construct
  misc_feature 1..20: note = CRISPR gRNA sequence
  source 1..20: mol_type = other DNA
aacctgggaggcagaggctg

SEQ ID NO: 17730 - DNA, 20 bp, synthetic construct
  misc_feature 1..20: note = CRISPR gRNA sequence
  source 1..20: mol_type = other DNA
ggcagaggctgcagtgaacc

SEQ ID NO: 17731 - DNA, 20 bp, synthetic construct
  misc_feature 1..20: note = CRISPR gRNA sequence
  source 1..20: mol_type = other DNA
aagactgcgccactgcactc

SEQ ID NO: 17732 - DNA, 20 bp, synthetic construct
  misc_feature 1..20: note = CRISPR gRNA sequence
  source 1..20: mol_type = other DNA
tgcgccactgcactccagcc

SEQ ID NO: 17733 - DNA, 20 bp, synthetic construct
  misc_feature 1..20: note = CRISPR gRNA sequence
  source 1..20: mol_type = other DNA
gcgccactgcactccagcct

SEQ ID NO: 17734 - DNA, 20 bp, synthetic construct
  misc_feature 1..20: note = CRISPR gRNA sequence
  source 1..20: mol_type = other DNA
gcactccagcctgggcgaca

SEQ ID NO: 17735 - DNA, 20 bp, synthetic construct
  misc_feature 1..20: note = CRISPR gRNA sequence
  source 1..20: mol_type = other DNA
tccagcctgggcgacaaagt

SEQ ID NO: 17736 - DNA, 20 bp, synthetic construct
  misc_feature 1..20: note = CRISPR gRNA sequence
  source 1..20: mol_type = other DNA
acaaaaaacaaaaaacaaaa

SEQ ID NO: 17737 - DNA, 20 bp, synthetic construct
  misc_feature 1..20: note = CRISPR gRNA sequence
  source 1..20: mol_type = other DNA
aaacaaaaaagattgtcctg

SEQ ID NO: 17738 - DNA, 20 bp, synthetic construct
  misc_feature 1..20: note = CRISPR gRNA sequence
  source 1..20: mol_type = other DNA
aacaaaaaagattgtcctgc

SEQ ID NO: 17739 - DNA, 20 bp, synthetic construct
  misc_feature 1..20: note = CRISPR gRNA sequence
  source 1..20: mol_type = other DNA
agattgtcctgcaggatcat

SEQ ID NO: 17740 - DNA, 20 bp, synthetic construct
  misc_feature 1..20: note = CRISPR gRNA sequence
  source 1..20: mol_type = other DNA
ttgtcctgcaggatcatcag

SEQ ID NO: 17741 - DNA, 20 bp, synthetic construct
  misc_feature 1..20: note = CRISPR gRNA sequence
  source 1..20: mol_type = other DNA
tgtcctgcaggatcatcaga

SEQ ID NO: 17742 - DNA, 20 bp, synthetic construct
  misc_feature 1..20: note = CRISPR gRNA sequence
  source 1..20: mol_type = other DNA
tgcaggatcatcagaaggcc

SEQ ID NO: 17743 - DNA, 20 bp, synthetic construct
  misc_feature 1..20: note = CRISPR gRNA sequence
  source 1..20: mol_type = other DNA
gcaggatcatcagaaggcca

SEQ ID NO: 17744 - DNA, 20 bp, synthetic construct
  misc_feature 1..20: note = CRISPR gRNA sequence
  source 1..20: mol_type = other DNA
caggatcatcagaaggccaa

SEQ ID NO: 17745 - DNA, 20 bp, synthetic construct
  misc_feature 1..20: note = CRISPR gRNA sequence
  source 1..20: mol_type = other DNA
ggatcatcagaaggccaagg

SEQ ID NO: 17746 - DNA, 20 bp, synthetic construct
  misc_feature 1..20: note = CRISPR gRNA sequence
  source 1..20: mol_type = other DNA
aaggccaagggagttctgtg

SEQ ID NO: 17747 - DNA, 20 bp, synthetic construct
  misc_feature 1..20: note = CRISPR gRNA sequence
  source 1..20: mol_type = other DNA
aggccaagggagttctgtgt

SEQ ID NO: 17748 - DNA, 20 bp, synthetic construct
  misc_feature 1..20: note = CRISPR gRNA sequence
  source 1..20: mol_type = other DNA
ggccaagggagttctgtgtg

SEQ ID NO: 17749 - DNA, 20 bp, synthetic construct
  misc_feature 1..20: note = CRISPR gRNA sequence
  source 1..20: mol_type = other DNA
gggagttctgtgtggggtgc

SEQ ID NO: 17750 - DNA, 20 bp, synthetic construct
  misc_feature 1..20: note = CRISPR gRNA sequence
  source 1..20: mol_type = other DNA
tgtgtggggtgccagctatg

SEQ ID NO: 17751 - DNA, 20 bp, synthetic construct
  misc_feature 1..20: note = CRISPR gRNA sequence
  source 1..20: mol_type = other DNA
gtgtggggtgccagctatgt

SEQ ID NO: 17752 - DNA, 20 bp, synthetic construct
  misc_feature 1..20: note = CRISPR gRNA sequence
  source 1..20: mol_type = other DNA
tggggtgccagctatgtggg

SEQ ID NO: 17753 - DNA, 20 bp, synthetic construct
  misc_feature 1..20: note = CRISPR gRNA sequence
  source 1..20: mol_type = other DNA
ccagctatgtgggaagccta

SEQ ID NO: 17754 - DNA, 20 bp, synthetic construct
  misc_feature 1..20: note = CRISPR gRNA sequence
  source 1..20: mol_type = other DNA
atgtgggaagcctacagtca

SEQ ID NO: 17755 - DNA, 20 bp, synthetic construct
  misc_feature 1..20: note = CRISPR gRNA sequence
  source 1..20: mol_type = other DNA
tgtgggaagcctacagtcaa

SEQ ID NO: 17756 - DNA, 20 bp, synthetic construct
  misc_feature 1..20: note = CRISPR gRNA sequence
  source 1..20: mol_type = other DNA
gggaagcctacagtcaaagg

SEQ ID NO: 17757 - DNA, 20 bp, synthetic construct
  misc_feature 1..20: note = CRISPR gRNA sequence
  source 1..20: mol_type = other DNA
tcaaaggaagcccattacat

SEQ ID NO: 17758 - DNA, 20 bp, synthetic construct
  misc_feature 1..20: note = CRISPR gRNA sequence
  source 1..20: mol_type = other DNA
aaaggaagcccattacatta

SEQ ID NO: 17759 - DNA, 20 bp, synthetic construct
  misc_feature 1..20: note = CRISPR gRNA sequence
  source 1..20: mol_type = other DNA
aaggaagcccattacattag

SEQ ID NO: 17760 - DNA, 20 bp, synthetic construct
  misc_feature 1..20: note = CRISPR gRNA sequence
  source 1..20: mol_type = other DNA
aggaagcccattacattaga

SEQ ID NO: 17761 - DNA, 20 bp, synthetic construct
  misc_feature 1..20: note = CRISPR gRNA sequence
  source 1..20: mol_type = other DNA
cattacattagagggtgtca

SEQ ID NO: 17762 - DNA, 20 bp, synthetic construct
  misc_feature 1..20: note = CRISPR gRNA sequence
  source 1..20: mol_type = other DNA
agggtgtcaaagctgaaatt

SEQ ID NO: 17763 - DNA, 20 bp, synthetic construct
  misc_feature 1..20: note = CRISPR gRNA sequence
  source 1..20: mol_type = other DNA
gggtgtcaaagctgaaattc

SEQ ID NO: 17764 - DNA, 20 bp, synthetic construct
  misc_feature 1..20: note = CRISPR gRNA sequence
  source 1..20: mol_type = other DNA
caaagctgaaattcaggccc

SEQ ID NO: 17765 - DNA, 20 bp, synthetic construct
  misc_feature 1..20: note = CRISPR gRNA sequence
  source 1..20: mol_type = other DNA
gaaattcaggcccaagactc

SEQ ID NO: 17766 - DNA, 20 bp, synthetic construct
  misc_feature 1..20: note = CRISPR gRNA sequence
  source 1..20: mol_type = other DNA
aaattcaggcccaagactct

SEQ ID NO: 17767 - DNA, 20 bp, synthetic construct
  misc_feature 1..20: note = CRISPR gRNA sequence
  source 1..20: mol_type = other DNA
taggtttccccacaacgcca

SEQ ID NO: 17768 - DNA, 20 bp, synthetic construct
  misc_feature 1..20: note = CRISPR gRNA sequence
  source 1..20: mol_type = other DNA
acaacgccacagctgcctcc

SEQ ID NO: 17769 - DNA, 20 bp, synthetic construct
  misc_feature 1..20: note = CRISPR gRNA sequence
  source 1..20: mol_type = other DNA
agctgcctcccagtcacacc

SEQ ID NO: 17770 - DNA, 20 bp, synthetic construct
  misc_feature 1..20: note = CRISPR gRNA sequence
  source 1..20: mol_type = other DNA
accaagatctacttgaatct

SEQ ID NO: 17771 - DNA, 20 bp, synthetic construct
  misc_feature 1..20: note = CRISPR gRNA sequence
  source 1..20: mol_type = other DNA
gatctacttgaatcttggca

SEQ ID NO: 17772 - DNA, 20 bp, synthetic construct
  misc_feature 1..20: note = CRISPR gRNA sequence
  source 1..20: mol_type = other DNA
atctacttgaatcttggcat

SEQ ID NO: 17773 - DNA, 20 bp, synthetic construct
  misc_feature 1..20: note = CRISPR gRNA sequence
  source 1..20: mol_type = other DNA
atgggaccttcctctatccc

SEQ ID NO: 17774 - DNA, 20 bp, synthetic construct
  misc_feature 1..20: note = CRISPR gRNA sequence
  source 1..20: mol_type = other DNA
gggaccttcctctatcccca

SEQ ID NO: 17775 - DNA, 20 bp, synthetic construct
  misc_feature 1..20: note = CRISPR gRNA sequence
  source 1..20: mol_type = other DNA
cttcctctatccccagagcc

SEQ ID NO: 17776 - DNA, 20 bp, synthetic construct
  misc_feature 1..20: note = CRISPR gRNA sequence
  source 1..20: mol_type = other DNA
agccaagtttcctatgtcta

SEQ ID NO: 17777 - DNA, 20 bp, synthetic construct
  misc_feature 1..20: note = CRISPR gRNA sequence
  source 1..20: mol_type = other DNA
ttcctatgtctatagatgct

SEQ ID NO: 17778 - DNA, 20 bp, synthetic construct
  misc_feature 1..20: note = CRISPR gRNA sequence
  source 1..20: mol_type = other DNA
tcctatgtctatagatgctt

SEQ ID NO: 17779 - DNA, 20 bp, synthetic construct
  misc_feature 1..20: note = CRISPR gRNA sequence
  source 1..20: mol_type = other DNA
tatgtctatagatgcttagg

SEQ ID NO: 17780 - DNA, 20 bp, synthetic construct
  misc_feature 1..20: note = CRISPR gRNA sequence
  source 1..20: mol_type = other DNA
gatgcttaggaagtgcttca

SEQ ID NO: 17781 - DNA, 20 bp, synthetic construct
  misc_feature 1..20: note = CRISPR gRNA sequence
  source 1..20: mol_type = other DNA
atgcttaggaagtgcttcaa

SEQ ID NO: 17782 - DNA, 20 bp, synthetic construct
  misc_feature 1..20: note = CRISPR gRNA sequence
  source 1..20: mol_type = other DNA
tgcttcaaaggccccttcat

SEQ ID NO: 17783 - DNA, 20 bp, synthetic construct
  misc_feature 1..20: note = CRISPR gRNA sequence
  source 1..20: mol_type = other DNA
gtttctccaaaccacattgc

SEQ ID NO: 17784 - DNA, 20 bp, synthetic construct
  misc_feature 1..20: note = CRISPR gRNA sequence
  source 1..20: mol_type = other DNA
ttctccaaaccacattgcca

SEQ ID NO: 17785 - DNA, 20 bp, synthetic construct
  misc_feature 1..20: note = CRISPR gRNA sequence
  source 1..20: mol_type = other DNA
tccaaaccacattgccagag

SEQ ID NO: 17786 - DNA, 20 bp, synthetic construct
  misc_feature 1..20: note = CRISPR gRNA sequence
  source 1..20: mol_type = other DNA
ccaaaccacattgccagagc

SEQ ID NO: 17787 - DNA, 20 bp, synthetic construct
  misc_feature 1..20: note = CRISPR gRNA sequence
  source 1..20: mol_type = other DNA
accacattgccagagcggga

SEQ ID NO: 17788 - DNA, 20 bp, synthetic construct
  misc_feature 1..20: note = CRISPR gRNA sequence
  source 1..20: mol_type = other DNA
cacattgccagagcgggatg

SEQ ID NO: 17789 - DNA, 20 bp, synthetic construct
  misc_feature 1..20: note = CRISPR gRNA sequence
  source 1..20: mol_type = other DNA
acattgccagagcgggatgg

SEQ ID NO: 17790 - DNA, 20 bp, synthetic construct
  misc_feature 1..20: note = CRISPR gRNA sequence
  source 1..20: mol_type = other DNA
cattgccagagcgggatgga

SEQ ID NO: 17791 - DNA, 20 bp, synthetic construct
  misc_feature 1..20: note = CRISPR gRNA sequence
  source 1..20: mol_type = other DNA
ccagagcgggatggagggaa

SEQ ID NO: 17792 - DNA, 20 bp, synthetic construct
  misc_feature 1..20: note = CRISPR gRNA sequence
  source 1..20: mol_type = other DNA
agcgggatggagggaaaaga

SEQ ID NO: 17793 - DNA, 20 bp, synthetic construct
  misc_feature 1..20: note = CRISPR gRNA sequence
  source 1..20: mol_type = other DNA
agatggccctgatcatcccg

SEQ ID NO: 17794 - DNA, 20 bp, synthetic construct
  misc_feature 1..20: note = CRISPR gRNA sequence
  source 1..20: mol_type = other DNA
tggccctgatcatcccgtgg

SEQ ID NO: 17795 - DNA, 20 bp, synthetic construct
  misc_feature 1..20: note = CRISPR gRNA sequence
  source 1..20: mol_type = other DNA
ggccctgatcatcccgtggc

SEQ ID NO: 17796 - DNA, 20 bp, synthetic construct
  misc_feature 1..20: note = CRISPR gRNA sequence
  source 1..20: mol_type = other DNA
ccctgatcatcccgtggcag

SEQ ID NO: 17797 - DNA, 20 bp, synthetic construct
  misc_feature 1..20: note = CRISPR gRNA sequence
  source 1..20: mol_type = other DNA
ctgatcatcccgtggcagga

SEQ ID NO: 17798 - DNA, 20 bp, synthetic construct
  misc_feature 1..20: note = CRISPR gRNA sequence
  source 1..20: mol_type = other DNA
gatcatcccgtggcaggaga

SEQ ID NO: 17799 - DNA, 20 bp, synthetic construct
  misc_feature 1..20: note = CRISPR gRNA sequence
  source 1..20: mol_type = other DNA
tcatcccgtggcaggagaga

SEQ ID NO: 17800 - DNA, 20 bp, synthetic construct
  misc_feature 1..20: note = CRISPR gRNA sequence
  source 1..20: mol_type = other DNA
tggcaggagagagagccctt

SEQ ID NO: 17801 - DNA, 20 bp, synthetic construct
  misc_feature 1..20: note = CRISPR gRNA sequence
  source 1..20: mol_type = other DNA
agagcccttcagctctccct

SEQ ID NO: 17802 - DNA, 20 bp, synthetic construct
  misc_feature 1..20: note = CRISPR gRNA sequence
  source 1..20: mol_type = other DNA
gagcccttcagctctccctg

SEQ ID NO: 17803 - DNA, 20 bp, synthetic construct
  misc_feature 1..20: note = CRISPR gRNA sequence
  source 1..20: mol_type = other DNA
agcccttcagctctccctga

SEQ ID NO: 17804 - DNA, 20 bp, synthetic construct
  misc_feature 1..20: note = CRISPR gRNA sequence
  source 1..20: mol_type = other DNA
ccttcagctctccctgaggg

SEQ ID NO: 17805 - DNA, 20 bp, synthetic construct
  misc_feature 1..20: note = CRISPR gRNA sequence
  source 1..20: mol_type = other DNA
cttcagctctccctgagggc

SEQ ID NO: 17806 - DNA, 20 bp, synthetic construct
  misc_feature 1..20: note = CRISPR gRNA sequence
  source 1..20: mol_type = other DNA
ttcagctctccctgagggca

SEQ ID NO: 17807 - DNA, 20 bp, synthetic construct
  misc_feature 1..20: note = CRISPR gRNA sequence
  source 1..20: mol_type = other DNA
gggcagggactgtatccctc

SEQ ID NO: 17808 - DNA, 20 bp, synthetic construct
  misc_feature 1..20: note = CRISPR gRNA sequence
  source 1..20: mol_type = other DNA
ccctctagctcaccttctcc

SEQ ID NO: 17809 - DNA, 20 bp, synthetic construct
  misc_feature 1..20: note = CRISPR gRNA sequence
  source 1..20: mol_type = other DNA
gctcaccttctcccagctct

SEQ ID NO: 17810 - DNA, 20 bp, synthetic construct
  misc_feature 1..20: note = CRISPR gRNA sequence
  source 1..20: mol_type = other DNA
tctcagcatgtttctgcgca

SEQ ID NO: 17811 - DNA, 20 bp, synthetic construct
  misc_feature 1..20: note = CRISPR gRNA sequence
  source 1..20: mol_type = other DNA
cagcatgtttctgcgcatgg

SEQ ID NO: 17812 - DNA, 20 bp, synthetic construct
  misc_feature 1..20: note = CRISPR gRNA sequence
  source 1..20: mol_type = other DNA
tggcagcctctcttcatccg

SEQ ID NO: 17813 - DNA, 20 bp, synthetic construct
  misc_feature 1..20: note = CRISPR gRNA sequence
  source 1..20: mol_type = other DNA
cttcatccgtggcaatgata

SEQ ID NO: 17814 - DNA, 20 bp, synthetic construct
  misc_feature 1..20: note = CRISPR gRNA sequence
  source 1..20: mol_type = other DNA
ccgtggcaatgatatagaac

SEQ ID NO: 17815 - DNA, 20 bp, synthetic construct
  misc_feature 1..20: note = CRISPR gRNA sequence
  source 1..20: mol_type = other DNA
tgatatagaactagaattca

SEQ ID NO: 17816 - DNA, 20 bp, synthetic construct
  misc_feature 1..20: note = CRISPR gRNA sequence
  source 1..20: mol_type = other DNA
gaactagaattcacagtgtc

SEQ ID NO: 17817 - DNA, 20 bp, synthetic construct
  misc_feature 1..20: note = CRISPR gRNA sequence
  source 1..20: mol_type = other DNA
tagaattcacagtgtccagc

SEQ ID NO: 17818 - DNA, 20 bp, synthetic construct
  misc_feature 1..20: note = CRISPR gRNA sequence
  source 1..20: mol_type = other DNA
tcacagtgtccagcaagtgc

SEQ ID NO: 17819 - DNA, 20 bp, synthetic construct
  misc_feature 1..20: note = CRISPR gRNA sequence
  source 1..20: mol_type = other DNA
cacagtgtccagcaagtgcc

SEQ ID NO: 17820 - DNA, 20 bp, synthetic construct
  misc_feature 1..20: note = CRISPR gRNA sequence
  source 1..20: mol_type = other DNA
gtaccaaatgacatgactcg

SEQ ID NO: 17821 - DNA, 20 bp, synthetic construct
  misc_feature 1..20: note = CRISPR gRNA sequence
  source 1..20: mol_type = other DNA
taccaaatgacatgactcgt

SEQ ID NO: 17822 - DNA, 20 bp, synthetic construct
  misc_feature 1..20: note = CRISPR gRNA sequence
  source 1..20: mol_type = other DNA
ctcgtaggcattaccccatt

SEQ ID NO: 17823 - DNA, 20 bp, synthetic construct
  misc_feature 1..20: note = CRISPR gRNA sequence
  source 1..20: mol_type = other DNA
atttggtctaacttacacat

SEQ ID NO: 17824 - DNA, 20 bp, synthetic construct
  misc_feature 1..20: note = CRISPR gRNA sequence
  source 1..20: mol_type = other DNA
ctatttgtattcctgttttt

SEQ ID NO: 17825 - DNA, 20 bp, synthetic construct
  misc_feature 1..20: note = CRISPR gRNA sequence
  source 1..20: mol_type = other DNA
gtattcctgtttttcagatg

SEQ ID NO: 17826 - DNA, 20 bp, synthetic construct
  misc_feature 1..20: note = CRISPR gRNA sequence
  source 1..20: mol_type = other DNA
attcctgtttttcagatgaa

SEQ ID NO: 17827 - DNA, 20 bp, synthetic construct
  misc_feature 1..20: note = CRISPR gRNA sequence
  source 1..20: mol_type = other DNA
ctgtttttcagatgaagaga

SEQ ID NO: 17828 - DNA, 20 bp, synthetic construct
  misc_feature 1..20: note = CRISPR gRNA sequence
  source 1..20: mol_type = other DNA
tgtttttcagatgaagagac

SEQ ID NO: 17829 - DNA, 20 bp, synthetic construct
  misc_feature 1..20: note = CRISPR gRNA sequence
  source 1..20: mol_type = other DNA
ttcagatgaagagacaggct

SEQ ID NO: 17830 - DNA, 20 bp, synthetic construct
  misc_feature 1..20: note = CRISPR gRNA sequence
  source 1..20: mol_type = other DNA
cagatgaagagacaggctca

SEQ ID NO: 17831 - DNA, 20 bp, synthetic construct
  misc_feature 1..20: note = CRISPR gRNA sequence
  source 1..20: mol_type = other DNA
agatgaagagacaggctcag

SEQ ID NO: 17832 - DNA, 20 bp, synthetic construct
  misc_feature 1..20: note = CRISPR gRNA sequence
  source 1..20: mol_type = other DNA
gatgaagagacaggctcaga

SEQ ID NO: 17833 - DNA, 20 bp, synthetic construct
  misc_feature 1..20: note = CRISPR gRNA sequence
  source 1..20: mol_type = other DNA
agagacaggctcagagggat

SEQ ID NO: 17834 - DNA, 20 bp, synthetic construct
  misc_feature 1..20: note = CRISPR gRNA sequence
  source 1..20: mol_type = other DNA
gacaggctcagagggattag

SEQ ID NO: 17835 - DNA, 20 bp, synthetic construct
  misc_feature 1..20: note = CRISPR gRNA sequence
  source 1..20: mol_type = other DNA
acaggctcagagggattagt

SEQ ID NO: 17836 - DNA, 20 bp, synthetic construct
  misc_feature 1..20: note = CRISPR gRNA sequence
  source 1..20: mol_type = other DNA
ctcagagggattagtgggct

SEQ ID NO: 17837 - DNA, 20 bp, synthetic construct
  misc_feature 1..20: note = CRISPR gRNA sequence
  source 1..20: mol_type = other DNA
aaccaaactacccatctcca

SEQ ID NO: 17838 - DNA, 20 bp, synthetic construct
  misc_feature 1..20: note = CRISPR gRNA sequence
  source 1..20: mol_type = other DNA
actacccatctccaaagtct

SEQ ID NO: 17839 - DNA, 20 bp, synthetic construct
  misc_feature 1..20: note = CRISPR gRNA sequence
  source 1..20: mol_type = other DNA
caaagtctcagcccactcta

SEQ ID NO: 17840 - DNA, 20 bp, synthetic construct
  misc_feature 1..20: note = CRISPR gRNA sequence
  source 1..20: mol_type = other DNA
tagcctttttgaattgctgt

SEQ ID NO: 17841 - DNA, 20 bp, synthetic construct
  misc_feature 1..20: note = CRISPR gRNA sequence
  source 1..20: mol_type = other DNA
ttgaattgctgttggccccc

SEQ ID NO: 17842 - DNA, 20 bp, synthetic construct
  misc_feature 1..20: note = CRISPR gRNA sequence
  source 1..20: mol_type = other DNA
ctgttggccccccagcaccc

SEQ ID NO: 17843 - DNA, 20 bp, synthetic construct
  misc_feature 1..20: note = CRISPR gRNA sequence
  source 1..20: mol_type = other DNA
tggccccccagcaccccggc

SEQ ID NO: 17844 - DNA, 20 bp, synthetic construct
  misc_feature 1..20: note = CRISPR gRNA sequence
  source 1..20: mol_type = other DNA
ggccccccagcaccccggcg

SEQ ID NO: 17845 - DNA, 20 bp, synthetic construct
  misc_feature 1..20: note = CRISPR gRNA sequence
  source 1..20: mol_type = other DNA
gccccccagcaccccggcga

SEQ ID NO: 17846 - DNA, 20 bp, synthetic construct
  misc_feature 1..20: note = CRISPR gRNA sequence
  source 1..20: mol_type = other DNA
ccccagcaccccggcgaggg

SEQ ID NO: 17847 - DNA, 20 bp, synthetic construct
  misc_feature 1..20: note = CRISPR gRNA sequence
  source 1..20: mol_type = other DNA
cccagcaccccggcgaggga

SEQ ID NO: 17848 - DNA, 20 bp, synthetic construct
  misc_feature 1..20: note = CRISPR gRNA sequence
  source 1..20: mol_type = other DNA
caccccggcgagggaaggcg

SEQ ID NO: 17849 - DNA, 20 bp, synthetic construct
  misc_feature 1..20: note = CRISPR gRNA sequence
  source 1..20: mol_type = other DNA
accccggcgagggaaggcgt

SEQ ID NO: 17850 - DNA, 20 bp, synthetic construct
  misc_feature 1..20: note = CRISPR gRNA sequence
  source 1..20: mol_type = other DNA
ccggcgagggaaggcgtggg

SEQ ID NO: 17851 - DNA, 20 bp, synthetic construct
  misc_feature 1..20: note = CRISPR gRNA sequence
  source 1..20: mol_type = other DNA
cgagggaaggcgtgggtggc

SEQ ID NO: 17852 - DNA, 20 bp, synthetic construct
  misc_feature 1..20: note = CRISPR gRNA sequence
  source 1..20: mol_type = other DNA
gcaagacaatttctcctttt

SEQ ID NO: 17853 - DNA, 20 bp, synthetic construct
  misc_feature 1..20: note = CRISPR gRNA sequence
  source 1..20: mol_type = other DNA
caagacaatttctccttttg

SEQ ID NO: 17854 - DNA, 20 bp, synthetic construct
  misc_feature 1..20: note = CRISPR gRNA sequence
  source 1..20: mol_type = other DNA
agacaatttctccttttgag

SEQ ID NO: 17855 - DNA, 20 bp, synthetic construct
  misc_feature 1..20: note = CRISPR gRNA sequence
  source 1..20: mol_type = other DNA
tctccttttgaggagccatg

SEQ ID NO: 17856 - DNA, 20 bp, synthetic construct
  misc_feature 1..20: note = CRISPR gRNA sequence
  source 1..20: mol_type = other DNA
ctccttttgaggagccatgt

SEQ ID NO: 17857 - DNA, 20 bp, synthetic construct
  misc_feature 1..20: note = CRISPR gRNA sequence
  source 1..20: mol_type = other DNA
tccttttgaggagccatgtg

SEQ ID NO: 17858 - DNA, 20 bp, synthetic construct
  misc_feature 1..20: note = CRISPR gRNA sequence
  source 1..20: mol_type = other DNA
ccttttgaggagccatgtgg

SEQ ID NO: 17859 - DNA, 20 bp, synthetic construct
  misc_feature 1..20: note = CRISPR gRNA sequence
  source 1..20: mol_type = other DNA
tttgaggagccatgtggggg

SEQ ID NO: 17860 - DNA, 20 bp, synthetic construct
  misc_feature 1..20: note = CRISPR gRNA sequence
  source 1..20: mol_type = other DNA
ttgaggagccatgtgggggc

SEQ ID NO: 17861 - DNA, 20 bp, synthetic construct
  misc_feature 1..20: note = CRISPR gRNA sequence
  source 1..20: mol_type = other DNA
tgaggagccatgtgggggca

SEQ ID NO: 17862 - DNA, 20 bp, synthetic construct
  misc_feature 1..20: note = CRISPR gRNA sequence
  source 1..20: mol_type = other DNA
ggagccatgtgggggcaggg

SEQ ID NO: 17863 - DNA, 20 bp, synthetic construct
  misc_feature 1..20: note = CRISPR gRNA sequence
  source 1..20: mol_type = other DNA
agccatgtgggggcagggca

SEQ ID NO: 17864 - DNA, 20 bp, synthetic construct
  misc_feature 1..20: note = CRISPR gRNA sequence
  source 1..20: mol_type = other DNA
gccatgtgggggcagggcag

SEQ ID NO: 17865 - DNA, 20 bp, synthetic construct
  misc_feature 1..20: note = CRISPR gRNA sequence
  source 1..20: mol_type = other DNA
gtgggggcagggcagaggcg

SEQ ID NO: 17866 - DNA, 20 bp, synthetic construct
  misc_feature 1..20: note = CRISPR gRNA sequence
  source 1..20: mol_type = other DNA
aggcgcggtctgtgtctttt

SEQ ID NO: 17867 - DNA, 20 bp, synthetic construct
  misc_feature 1..20: note = CRISPR gRNA sequence
  source 1..20: mol_type = other DNA
gtctgtgtctttttggtaaa

SEQ ID NO: 17868 - DNA, 20 bp, synthetic construct
  misc_feature 1..20: note = CRISPR gRNA sequence
  source 1..20: mol_type = other DNA
tctgtgtctttttggtaaat

SEQ ID NO: 17869 - DNA, 20 bp, synthetic construct
  misc_feature 1..20: note = CRISPR gRNA sequence
  source 1..20: mol_type = other DNA
gtgtctttttggtaaatggg

SEQ ID NO: 17870 - DNA, 20 bp, synthetic construct
  misc_feature 1..20: note = CRISPR gRNA sequence
  source 1..20: mol_type = other DNA
tggtaaatgggcagtatttt

SEQ ID NO: 17871 - DNA, 20 bp, synthetic construct
  misc_feature 1..20: note = CRISPR gRNA sequence
  source 1..20: mol_type = other DNA
taaatgggcagtatttttag

SEQ ID NO: 17872 - DNA, 20 bp, synthetic construct
  misc_feature 1..20: note = CRISPR gRNA sequence
  source 1..20: mol_type = other DNA
aaatgggcagtatttttaga

SEQ ID NO: 17873 - DNA, 20 bp, synthetic construct
  misc_feature 1..20: note = CRISPR gRNA sequence
  source 1..20: mol_type = other DNA
tttgaaactgtgcttccccc

SEQ ID NO: 17874 - DNA, 20 bp, synthetic construct
  misc_feature 1..20: note = CRISPR gRNA sequence
  source 1..20: mol_type = other DNA
ttgaaactgtgcttccccct

SEQ ID NO: 17875 - DNA, 20 bp, synthetic construct
  misc_feature 1..20: note = CRISPR gRNA sequence
  source 1..20: mol_type = other DNA
ccaccttccacatccaactc

SEQ ID NO: 17876 - DNA, 20 bp, synthetic construct
  misc_feature 1..20: note = CRISPR gRNA sequence
  source 1..20: mol_type = other DNA
cctgatctttttgccatcaa

SEQ ID NO: 17877 - DNA, 20 bp, synthetic construct
  misc_feature 1..20: note = CRISPR gRNA sequence
  source 1..20: mol_type = other DNA
ttgccatcaaaagtcctttt

SEQ ID NO: 17878 - DNA, 20 bp, synthetic construct
  misc_feature 1..20: note = CRISPR gRNA sequence
  source 1..20: mol_type = other DNA
tgccatcaaaagtccttttt

SEQ ID NO: 17879 - DNA, 20 bp, synthetic construct
  misc_feature 1..20: note = CRISPR gRNA sequence
  source 1..20: mol_type = other DNA
gccatcaaaagtcctttttg

SEQ ID NO: 17880 - DNA, 20 bp, synthetic construct
  misc_feature 1..20: note = CRISPR gRNA sequence
  source 1..20: mol_type = other DNA
tccccacttcacactgcatg

SEQ ID NO: 17881 - DNA, 20 bp, synthetic construct
  misc_feature 1..20: note = CRISPR gRNA sequence
  source 1..20: mol_type = other DNA
ccccacttcacactgcatgc

SEQ ID NO: 17882 - DNA, 20 bp, synthetic construct
  misc_feature 1..20: note = CRISPR gRNA sequence
  source 1..20: mol_type = other DNA
acactgcatgcaggatttga

SEQ ID NO: 17883 - DNA, 20 bp, synthetic construct
  misc_feature 1..20: note = CRISPR gRNA sequence
  source 1..20: mol_type = other DNA
cactgcatgcaggatttgaa

SEQ ID NO: 17884 - DNA, 20 bp, synthetic construct
  misc_feature 1..20: note = CRISPR gRNA sequence
  source 1..20: mol_type = other DNA
catgcaggatttgaaaggct

SEQ ID NO: 17885 - DNA, 20 bp, synthetic construct
  misc_feature 1..20: note = CRISPR gRNA sequence
  source 1..20: mol_type = other DNA
aggatttgaaaggctaagtg

SEQ ID NO: 17886 - DNA, 20 bp, synthetic construct
  misc_feature 1..20: note = CRISPR gRNA sequence
  source 1..20: mol_type = other DNA
ggctaagtgtagacactaaa

SEQ ID NO: 17887 - DNA, 20 bp, synthetic construct
  misc_feature 1..20: note = CRISPR gRNA sequence
  source 1..20: mol_type = other DNA
gctaagtgtagacactaaac

SEQ ID NO: 17888 - DNA, 20 bp, synthetic construct
  misc_feature 1..20: note = CRISPR gRNA sequence
  source 1..20: mol_type = other DNA
aattcacctctctctccccc

SEQ ID NO: 17889 - DNA, 20 bp, synthetic construct
  misc_feature 1..20: note = CRISPR gRNA sequence
  source 1..20: mol_type = other DNA
attcacctctctctcccccg

SEQ ID NO: 17890 - DNA, 20 bp, synthetic construct
  misc_feature 1..20: note = CRISPR gRNA sequence
  source 1..20: mol_type = other DNA
ttcacctctctctcccccga

SEQ ID NO: 17891 - DNA, 20 bp, synthetic construct
  misc_feature 1..20: note = CRISPR gRNA sequence
  source 1..20: mol_type = other DNA
ctctctcccccgagggaaat

SEQ ID NO: 17892 - DNA, 20 bp, synthetic construct
  misc_feature 1..20: note = CRISPR gRNA sequence
  source 1..20: mol_type = other DNA
tctctcccccgagggaaatc

SEQ ID NO: 17893 - DNA, 20 bp, synthetic construct
  misc_feature 1..20: note = CRISPR gRNA sequence
  source 1..20: mol_type = other DNA
gtcgccacaatgttctaact

SEQ ID NO: 17894 - DNA, 20 bp, synthetic construct
  misc_feature 1..20: note = CRISPR gRNA sequence
  source 1..20: mol_type = other DNA
actcagacttaaactatctg

SEQ ID NO: 17895 - DNA, 20 bp, synthetic construct
  misc_feature 1..20: note = CRISPR gRNA sequence
  source 1..20: mol_type = other DNA
gacttaaactatctgaagat

SEQ ID NO: 17896 - DNA, 20 bp, synthetic construct
  misc_feature 1..20: note = CRISPR gRNA sequence
  source 1..20: mol_type = other DNA
atcagtgcatgcatctcttc

SEQ ID NO: 17897 - DNA, 20 bp, synthetic construct
  misc_feature 1..20: note = CRISPR gRNA sequence
  source 1..20: mol_type = other DNA
tcagtgcatgcatctcttct

SEQ ID NO: 17898 - DNA, 20 bp, synthetic construct
  misc_feature 1..20: note = CRISPR gRNA sequence
  source 1..20: mol_type = other DNA
gcatgcatctcttctgggaa

SEQ ID NO: 17899 - DNA, 20 bp, synthetic construct
  misc_feature 1..20: note = CRISPR gRNA sequence
  source 1..20: mol_type = other DNA
aacagcataacgttccatct

SEQ ID NO: 17900 - DNA, 20 bp, synthetic construct
  misc_feature 1..20: note = CRISPR gRNA sequence
  source 1..20: mol_type = other DNA
gcataacgttccatctcagc

SEQ ID NO: 17901 - DNA, 20 bp, synthetic construct
  misc_feature 1..20: note = CRISPR gRNA sequence
  source 1..20: mol_type = other DNA
taacgttccatctcagctgg

SEQ ID NO: 17902 - DNA, 20 bp, synthetic construct
  misc_feature 1..20: note = CRISPR gRNA sequence
  source 1..20: mol_type = other DNA
aacgttccatctcagctggt

SEQ ID NO: 17903 - DNA, 20 bp, synthetic construct
  misc_feature 1..20: note = CRISPR gRNA sequence
  source 1..20: mol_type = other DNA
cgttccatctcagctggtgg

SEQ ID NO: 17904 - DNA, 20 bp, synthetic construct
  misc_feature 1..20: note = CRISPR gRNA sequence
  source 1..20: mol_type = other DNA
ctcagctggtgggagatgaa

SEQ ID NO: 17905 - DNA, 20 bp, synthetic construct
  misc_feature 1..20: note = CRISPR gRNA sequence
  source 1..20: mol_type = other DNA
cagctggtgggagatgaatg

SEQ ID NO: 17906 - DNA, 20 bp, synthetic construct
  misc_feature 1..20: note = CRISPR gRNA sequence
  source 1..20: mol_type = other DNA
ggtgggagatgaatggagct

SEQ ID NO: 17907 - DNA, 20 bp, synthetic construct
  misc_feature 1..20: note = CRISPR gRNA sequence
  source 1..20: mol_type = other DNA
ggagatgaatggagctcaga

SEQ ID NO: 17908 - DNA, 20 bp, synthetic construct
  misc_feature 1..20: note = CRISPR gRNA sequence
  source 1..20: mol_type = other DNA
atgaatggagctcagatggt

SEQ ID NO: 17909 - DNA, 20 bp, synthetic construct
  misc_feature 1..20: note = CRISPR gRNA sequence
  source 1..20: mol_type = other DNA
ggagctcagatggtgagctt

SEQ ID NO: 17910 - DNA, 20 bp, synthetic construct
  misc_feature 1..20: note = CRISPR gRNA sequence
  source 1..20: mol_type = other DNA
gagctcagatggtgagcttt

SEQ ID NO: 17911 - DNA, 20 bp, synthetic construct
  misc_feature 1..20: note = CRISPR gRNA sequence
  source 1..20: mol_type = other DNA
agctcagatggtgagctttg

SEQ ID NO: 17912 - DNA, 20 bp, synthetic construct
  misc_feature 1..20: note = CRISPR gRNA sequence
  source 1..20: mol_type = other DNA
gggtgaaatttcccaacttt

SEQ ID NO: 17913 - DNA, 20 bp, synthetic construct
  misc_feature 1..20: note = CRISPR gRNA sequence
  source 1..20: mol_type = other DNA
ggtgaaatttcccaactttc

SEQ ID NO: 17914 - DNA, 20 bp, synthetic construct
  misc_feature 1..20: note = CRISPR gRNA sequence
  source 1..20: mol_type = other DNA
cctaccaacgcactacaatc

SEQ ID NO: 17915 - DNA, 20 bp, synthetic construct
  misc_feature 1..20: note = CRISPR gRNA sequence
  source 1..20: mol_type = other DNA
ctaccaacgcactacaatct

SEQ ID NO: 17916 - DNA, 20 bp, synthetic construct
  misc_feature 1..20: note = CRISPR gRNA sequence
  source 1..20: mol_type = other DNA
caacgcactacaatctgggt

SEQ ID NO: 17917 - DNA, 20 bp, synthetic construct
  misc_feature 1..20: note = CRISPR gRNA sequence
  source 1..20: mol_type = other DNA
agttcattttttaaaccact

SEQ ID NO: 17918 - DNA, 20 bp, synthetic construct
  misc_feature 1..20: note = CRISPR gRNA sequence
  source 1..20: mol_type = other DNA
ttcattttttaaaccacttg

SEQ ID NO: 17919 - DNA, 20 bp, synthetic construct
  misc_feature 1..20: note = CRISPR gRNA sequence
  source 1..20: mol_type = other DNA
ttttaaaccacttggagcct

SEQ ID NO: 17920 - DNA, 20 bp, synthetic construct
  misc_feature 1..20: note = CRISPR gRNA sequence
  source 1..20: mol_type = other DNA
cctcagtttccttatctgta

SEQ ID NO: 17921 - DNA, 20 bp, synthetic construct
  misc_feature 1..20: note = CRISPR gRNA sequence
  source 1..20: mol_type = other DNA
cagtttccttatctgtaaag

SEQ ID NO: 17922 - DNA, 20 bp, synthetic construct
  misc_feature 1..20: note = CRISPR gRNA sequence
  source 1..20: mol_type = other DNA
agtttccttatctgtaaagt

SEQ ID NO: 17923 - DNA, 20 bp, synthetic construct
  misc_feature 1..20: note = CRISPR gRNA sequence
  source 1..20: mol_type = other DNA
gtttccttatctgtaaagtg

SEQ ID NO: 17924 - DNA, 20 bp, synthetic construct
  misc_feature 1..20: note = CRISPR gRNA sequence
  source 1..20: mol_type = other DNA
tttccttatctgtaaagtgg

SEQ ID NO: 17925 - DNA, 20 bp, synthetic construct
  misc_feature 1..20: note = CRISPR gRNA sequence
  source 1..20: mol_type = other DNA
gtaaagtgggggataataat

SEQ ID NO: 17926 - DNA, 20 bp, synthetic construct
  misc_feature 1..20: note = CRISPR gRNA sequence
  source 1..20: mol_type = other DNA
ggataataattggcaactca

SEQ ID NO: 17927 - DNA, 20 bp, synthetic construct
  misc_feature 1..20: note = CRISPR gRNA sequence
  source 1..20: mol_type = other DNA
gataataattggcaactcat

SEQ ID NO: 17928 - DNA, 20 bp, synthetic construct
  misc_feature 1..20: note = CRISPR gRNA sequence
  source 1..20: mol_type = other DNA
taattggcaactcataggat

SEQ ID NO: 17929 - DNA, 20 bp, synthetic construct
  misc_feature 1..20: note = CRISPR gRNA sequence
  source 1..20: mol_type = other DNA
aattggcaactcataggatt

SEQ ID NO: 17930 - DNA, 20 bp, synthetic construct
  misc_feature 1..20: note = CRISPR gRNA sequence
  source 1..20: mol_type = other DNA
attggcaactcataggatta

SEQ ID NO: 17931 - DNA, 20 bp, synthetic construct
  misc_feature 1..20: note = CRISPR gRNA sequence
  source 1..20: mol_type = other DNA
ttggcaactcataggattag

SEQ ID NO: 17932 - DNA, 20 bp, synthetic construct
  misc_feature 1..20: note = CRISPR gRNA sequence
  source 1..20: mol_type = other DNA
ggcaactcataggattaggg

SEQ ID NO: 17933 - DNA, 20 bp, synthetic construct
  misc_feature 1..20: note = CRISPR gRNA sequence
  source 1..20: mol_type = other DNA
ctcataggattaggggagtt

SEQ ID NO: 17934 - DNA, 20 bp, synthetic construct
  misc_feature 1..20: note = CRISPR gRNA sequence
  source 1..20: mol_type = other DNA
attaggggagttaagttgca

SEQ ID NO: 17935 - DNA, 20 bp, synthetic construct
  misc_feature 1..20: note = CRISPR gRNA sequence
  source 1..20: mol_type = other DNA
taggggagttaagttgcatg

SEQ ID NO: 17936 - DNA, 20 bp, synthetic construct
  misc_feature 1..20: note = CRISPR gRNA sequence
  source 1..20: mol_type = other DNA
gttaagttgcatggagccct

SEQ ID NO: 17937 - DNA, 20 bp, synthetic construct
  misc_feature 1..20: note = CRISPR gRNA sequence
  source 1..20: mol_type = other DNA
agttgcatggagcccttaga

SEQ ID NO: 17938 - DNA, 20 bp, synthetic construct
  misc_feature 1..20: note = CRISPR gRNA sequence
  source 1..20: mol_type = other DNA
gttgcatggagcccttagaa

SEQ ID NO: 17939 - DNA, 20 bp, synthetic construct
  misc_feature 1..20: note = CRISPR gRNA sequence
  source 1..20: mol_type = other DNA
ttgcatggagcccttagaaa

SEQ ID NO: 17940 - DNA, 20 bp, synthetic construct
  misc_feature 1..20: note = CRISPR gRNA sequence
  source 1..20: mol_type = other DNA
tgcatggagcccttagaaag

SEQ ID NO: 17941 - DNA, 20 bp, synthetic construct
  misc_feature 1..20: note = CRISPR gRNA sequence
  source 1..20: mol_type = other DNA
ggagcccttagaaaggggac

SEQ ID NO: 17942 - DNA, 20 bp, synthetic construct
  misc_feature 1..20: note = CRISPR gRNA sequence
  source 1..20: mol_type = other DNA
ttagaaaggggactggcgac

SEQ ID NO: 17943 - DNA, 20 bp, synthetic construct
  misc_feature 1..20: note = CRISPR gRNA sequence
  source 1..20: mol_type = other DNA
aaaggggactggcgaccagt

SEQ ID NO: 17944 - DNA, 20 bp, synthetic construct
  misc_feature 1..20: note = CRISPR gRNA sequence
  source 1..20: mol_type = other DNA
accagtaagtgctcaatgaa

SEQ ID NO: 17945 - DNA, 20 bp, synthetic construct
  misc_feature 1..20: note = CRISPR gRNA sequence
  source 1..20: mol_type = other DNA
agtaagtgctcaatgaacag

SEQ ID NO: 17946 - DNA, 20 bp, synthetic construct
  misc_feature 1..20: note = CRISPR gRNA sequence
  source 1..20: mol_type = other DNA
tgctcaatgaacagtagctt

SEQ ID NO: 17947 - DNA, 20 bp, synthetic construct
  misc_feature 1..20: note = CRISPR gRNA sequence
  source 1..20: mol_type = other DNA
gctcaatgaacagtagctta

SEQ ID NO: 17948 - DNA, 20 bp, synthetic construct
  misc_feature 1..20: note = CRISPR gRNA sequence
  source 1..20: mol_type = other DNA
caatgaacagtagcttaagg

SEQ ID NO: 17949 - DNA, 20 bp, synthetic construct
  misc_feature 1..20: note = CRISPR gRNA sequence
  source 1..20: mol_type = other DNA
aaggcagcacaacttctgca

SEQ ID NO: 17950 - DNA, 20 bp, synthetic construct
  misc_feature 1..20: note = CRISPR gRNA sequence
  source 1..20: mol_type = other DNA
cagcacaacttctgcatggt

SEQ ID NO: 17951 - DNA, 20 bp, synthetic construct
  misc_feature 1..20: note = CRISPR gRNA sequence
  source 1..20: mol_type = other DNA
aatgtgcttcttacctctgt

SEQ ID NO: 17952 - DNA, 20 bp, synthetic construct
  misc_feature 1..20: note = CRISPR gRNA sequence
  source 1..20: mol_type = other DNA
tgtgcttcttacctctgtga

SEQ ID NO: 17953 - DNA, 20 bp, synthetic construct
  misc_feature 1..20: note = CRISPR gRNA sequence
  source 1..20: mol_type = other DNA
cttacctctgtgagagtgac

SEQ ID NO: 17954 - DNA, 20 bp, synthetic construct
  misc_feature 1..20: note = CRISPR gRNA sequence
  source 1..20: mol_type = other DNA
ttacctctgtgagagtgacc

SEQ ID NO: 17955 - DNA, 20 bp, synthetic construct
  misc_feature 1..20: note = CRISPR gRNA sequence
  source 1..20: mol_type = other DNA
tacctctgtgagagtgacca

SEQ ID NO: 17956 - DNA, 20 bp, synthetic construct
  misc_feature 1..20: note = CRISPR gRNA sequence
  source 1..20: mol_type = other DNA
acctctgtgagagtgaccag

SEQ ID NO: 17957 - DNA, 20 bp, synthetic construct
  misc_feature 1..20: note = CRISPR gRNA sequence
  source 1..20: mol_type = other DNA
ctctgtgagagtgaccaggg

SEQ ID NO: 17958 - DNA, 20 bp, synthetic construct
  misc_feature 1..20: note = CRISPR gRNA sequence
  source 1..20: mol_type = other DNA
aggggagatttctctgtgtc

SEQ ID NO: 17959 - DNA, 20 bp, synthetic construct
  misc_feature 1..20: note = CRISPR gRNA sequence
  source 1..20: mol_type = other DNA
ggggagatttctctgtgtct

SEQ ID NO: 17960 - DNA, 20 bp, synthetic construct
  misc_feature 1..20: note = CRISPR gRNA sequence
  source 1..20: mol_type = other DNA
gggagatttctctgtgtctg

SEQ ID NO: 17961 - DNA, 20 bp, synthetic construct
  misc_feature 1..20: note = CRISPR gRNA sequence
  source 1..20: mol_type = other DNA
ctctgtgtctggggctgtgc

SEQ ID NO: 17962 - DNA, 20 bp, synthetic construct
  misc_feature 1..20: note = CRISPR gRNA sequence
  source 1..20: mol_type = other DNA
tattctgtttcaactgttaa

SEQ ID NO: 17963 - DNA, 20 bp, synthetic construct
  misc_feature 1..20: note = CRISPR gRNA sequence
  source 1..20: mol_type = other DNA
tcaactgttaacggcaactc

SEQ ID NO: 17964 - DNA, 20 bp, synthetic construct
  misc_feature 1..20: note = CRISPR gRNA sequence
  source 1..20: mol_type = other DNA
caactgttaacggcaactct

SEQ ID NO: 17965 - DNA, 20 bp, synthetic construct
  misc_feature 1..20: note = CRISPR gRNA sequence
  source 1..20: mol_type = other DNA
actgttaacggcaactctgg

SEQ ID NO: 17966 - DNA, 20 bp, synthetic construct
  misc_feature 1..20: note = CRISPR gRNA sequence
  source 1..20: mol_type = other DNA
ctgggagattgttgttatta

SEQ ID NO: 17967 - DNA, 20 bp, synthetic construct
  misc_feature 1..20: note = CRISPR gRNA sequence
  source 1..20: mol_type = other DNA
ttgttattatagccatttta

SEQ ID NO: 17968 - DNA, 20 bp, synthetic construct
  misc_feature 1..20: note = CRISPR gRNA sequence
  source 1..20: mol_type = other DNA
ttatagccattttacagacg

SEQ ID NO: 17969 - DNA, 20 bp, synthetic construct
  misc_feature 1..20: note = CRISPR gRNA sequence
  source 1..20: mol_type = other DNA
tatagccattttacagacgc

SEQ ID NO: 17970 - DNA, 20 bp, synthetic construct
  misc_feature 1..20: note = CRISPR gRNA sequence
  source 1..20: mol_type = other DNA
attttacagacgcaggcgct

SEQ ID NO: 17971 - DNA, 20 bp, synthetic construct
  misc_feature 1..20: note = CRISPR gRNA sequence
  source 1..20: mol_type = other DNA
gcaggcgctgagattacgtc

SEQ ID NO: 17972 - DNA, 20 bp, synthetic construct
  misc_feature 1..20: note = CRISPR gRNA sequence
  source 1..20: mol_type = other DNA
tgagattacgtccagttcat

SEQ ID NO: 17973 - DNA, 20 bp, synthetic construct
  misc_feature 1..20: note = CRISPR gRNA sequence
  source 1..20: mol_type = other DNA
ttcattagatgttttcttcc

SEQ ID NO: 17974 - DNA, 20 bp, synthetic construct
  misc_feature 1..20: note = CRISPR gRNA sequence
  source 1..20: mol_type = other DNA
cattagatgttttcttccca

SEQ ID NO: 17975 - DNA, 20 bp, synthetic construct
  misc_feature 1..20: note = CRISPR gRNA sequence
  source 1..20: mol_type = other DNA
attagatgttttcttcccag

SEQ ID NO: 17976 - DNA, 20 bp, synthetic construct
  misc_feature 1..20: note = CRISPR gRNA sequence
  source 1..20: mol_type = other DNA
agatgttttcttcccagagg

SEQ ID NO: 17977 - DNA, 20 bp, synthetic construct
  misc_feature 1..20: note = CRISPR gRNA sequence
  source 1..20: mol_type = other DNA
gatgttttcttcccagaggc

SEQ ID NO: 17978 - DNA, 20 bp, synthetic construct
  misc_feature 1..20: note = CRISPR gRNA sequence
  source 1..20: mol_type = other DNA
atgttttcttcccagaggcg

SEQ ID NO: 17979 - DNA, 20 bp, synthetic construct
  misc_feature 1..20: note = CRISPR gRNA sequence
  source 1..20: mol_type = other DNA
gttttcttcccagaggcggg

SEQ ID NO: 17980 - DNA, 20 bp, synthetic construct
  misc_feature 1..20: note = CRISPR gRNA sequence
  source 1..20: mol_type = other DNA
gaggcggggagtctatcttt

SEQ ID NO: 17981 - DNA, 20 bp, synthetic construct
  misc_feature 1..20: note = CRISPR gRNA sequence
  source 1..20: mol_type = other DNA
aggcggggagtctatctttg

SEQ ID NO: 17982 - DNA, 20 bp, synthetic construct
  misc_feature 1..20: note = CRISPR gRNA sequence
  source 1..20: mol_type = other DNA
ggcggggagtctatctttga

SEQ ID NO: 17983 - DNA, 20 bp, synthetic construct
  misc_feature 1..20: note = CRISPR gRNA sequence
  source 1..20: mol_type = other DNA
gagtctatctttgagggtct

SEQ ID NO: 17984 - DNA, 20 bp, synthetic construct
  misc_feature 1..20: note = CRISPR gRNA sequence
  source 1..20: mol_type = other DNA
agtctatctttgagggtcta

SEQ ID NO: 17985 - DNA, 20 bp, synthetic construct
  misc_feature 1..20: note = CRISPR gRNA sequence
  source 1..20: mol_type = other DNA
tctatctttgagggtctaag

SEQ ID NO: 17986 - DNA, 20 bp, synthetic construct
  misc_feature 1..20: note = CRISPR gRNA sequence
  source 1..20: mol_type = other DNA
ctatctttgagggtctaagg

SEQ ID NO: 17987 - DNA, 20 bp, synthetic construct
  misc_feature 1..20: note = CRISPR gRNA sequence
  source 1..20: mol_type = other DNA
agggtctaaggaggcactga

SEQ ID NO: 17988 - DNA, 20 bp, synthetic construct
  misc_feature 1..20: note = CRISPR gRNA sequence
  source 1..20: mol_type = other DNA
gggtctaaggaggcactgaa

SEQ ID NO: 17989 - DNA, 20 bp, synthetic construct
  misc_feature 1..20: note = CRISPR gRNA sequence
  source 1..20: mol_type = other DNA
ggtctaaggaggcactgaaa

SEQ ID NO: 17990 - DNA, 20 bp, synthetic construct
  misc_feature 1..20: note = CRISPR gRNA sequence
  source 1..20: mol_type = other DNA
tctaaggaggcactgaaagg

SEQ ID NO: 17991 - DNA, 20 bp, synthetic construct
  misc_feature 1..20: note = CRISPR gRNA sequence
  source 1..20: mol_type = other DNA
aaggaggcactgaaagggag

SEQ ID NO: 17992 - DNA, 20 bp, synthetic construct
  misc_feature 1..20: note = CRISPR gRNA sequence
  source 1..20: mol_type = other DNA
gaggcactgaaagggagaag

SEQ ID NO: 17993 - DNA, 20 bp, synthetic construct
  misc_feature 1..20: note = CRISPR gRNA sequence
  source 1..20: mol_type = other DNA
aggcactgaaagggagaaga

SEQ ID NO: 17994 - DNA, 20 bp, synthetic construct
  misc_feature 1..20: note = CRISPR gRNA sequence
  source 1..20: mol_type = other DNA
ggctcttttgctacccctaa

SEQ ID NO: 17995 - DNA, 20 bp, synthetic construct
  misc_feature 1..20: note = CRISPR gRNA sequence
  source 1..20: mol_type = other DNA
ttgctacccctaaaagcctc

SEQ ID NO: 17996 - DNA, 20 bp, synthetic construct
  misc_feature 1..20: note = CRISPR gRNA sequence
  source 1..20: mol_type = other DNA
actgctctgaactgtgatta

SEQ ID NO: 17997 - DNA, 20 bp, synthetic construct
  misc_feature 1..20: note = CRISPR gRNA sequence
  source 1..20: mol_type = other DNA
tgctctgaactgtgattaaa

SEQ ID NO: 17998 - DNA, 20 bp, synthetic construct
  misc_feature 1..20: note = CRISPR gRNA sequence
  source 1..20: mol_type = other DNA
gaactgtgattaaagagcat

SEQ ID NO: 17999 - DNA, 20 bp, synthetic construct
  misc_feature 1..20: note = CRISPR gRNA sequence
  source 1..20: mol_type = other DNA
ctgtgattaaagagcatgag

SEQ ID NO: 18000 - DNA, 20 bp, synthetic construct
  misc_feature 1..20: note = CRISPR gRNA sequence
  source 1..20: mol_type = other DNA
tgtgattaaagagcatgaga

SEQ ID NO: 18001 - DNA, 20 bp, synthetic construct
  misc_feature 1..20: note = CRISPR gRNA sequence
  source 1..20: mol_type = other DNA
tgattaaagagcatgagaag

SEQ ID NO: 18002 - DNA, 20 bp, synthetic construct
  misc_feature 1..20: note = CRISPR gRNA sequence
  source 1..20: mol_type = other DNA
gattaaagagcatgagaagg

SEQ ID NO: 18003 - DNA, 20 bp, synthetic construct
  misc_feature 1..20: note = CRISPR gRNA sequence
  source 1..20: mol_type = other DNA
aaagagcatgagaaggaggc

SEQ ID NO: 18004 - DNA, 20 bp, synthetic construct
  misc_feature 1..20: note = CRISPR gRNA sequence
  source 1..20: mol_type = other DNA
aagagcatgagaaggaggcc

SEQ ID NO: 18005 - DNA, 20 bp, synthetic construct
  misc_feature 1..20: note = CRISPR gRNA sequence
  source 1..20: mol_type = other DNA
agagcatgagaaggaggcca

SEQ ID NO: 18006 - DNA, 20 bp, synthetic construct
  misc_feature 1..20: note = CRISPR gRNA sequence
  source 1..20: mol_type = other DNA
gagcatgagaaggaggccag

SEQ ID NO: 18007 - DNA, 20 bp, synthetic construct
  misc_feature 1..20: note = CRISPR gRNA sequence
  source 1..20: mol_type = other DNA
catgagaaggaggccagggg

SEQ ID NO: 18008 - DNA, 20 bp, synthetic construct
  misc_feature 1..20: note = CRISPR gRNA sequence
  source 1..20: mol_type = other DNA
gagaaggaggccaggggtgg

SEQ ID NO: 18009 - DNA, 20 bp, synthetic construct
  misc_feature 1..20: note = CRISPR gRNA sequence
  source 1..20: mol_type = other DNA
gtggctcacgcctataatcc

SEQ ID NO: 18010 - DNA, 20 bp, synthetic construct
  misc_feature 1..20: note = CRISPR gRNA sequence
  source 1..20: mol_type = other DNA
gcctataatcctagcacttt

SEQ ID NO: 18011 - DNA, 20 bp, synthetic construct
  misc_feature 1..20: note = CRISPR gRNA sequence
  source 1..20: mol_type = other DNA
ctataatcctagcactttga

SEQ ID NO: 18012 - DNA, 20 bp, synthetic construct
  misc_feature 1..20: note = CRISPR gRNA sequence
  source 1..20: mol_type = other DNA
tataatcctagcactttgag

SEQ ID NO: 18013 - DNA, 20 bp, synthetic construct
  misc_feature 1..20: note = CRISPR gRNA sequence
  source 1..20: mol_type = other DNA
tcctagcactttgagaggcc

SEQ ID NO: 18014 - DNA, 20 bp, synthetic construct
  misc_feature 1..20: note = CRISPR gRNA sequence
  source 1..20: mol_type = other DNA
cctagcactttgagaggccg

SEQ ID NO: 18015 - DNA, 20 bp, synthetic construct
  misc_feature 1..20: note = CRISPR gRNA sequence
  source 1..20: mol_type = other DNA
gcactttgagaggccgaggc

SEQ ID NO: 18016 - DNA, 20 bp, synthetic construct
  misc_feature 1..20: note = CRISPR gRNA sequence
  source 1..20: mol_type = other DNA
ctttgagaggccgaggctgg

SEQ ID NO: 18017 - DNA, 20 bp, synthetic construct
  misc_feature 1..20: note = CRISPR gRNA sequence
  source 1..20: mol_type = other DNA
ccgaggctggcggattactt

SEQ ID NO: 18018 - DNA, 20 bp, synthetic construct
  misc_feature 1..20: note = CRISPR gRNA sequence
  source 1..20: mol_type = other DNA
cgaggctggcggattacttg

SEQ ID NO: 18019 - DNA, 20 bp, synthetic construct
  misc_feature 1..20: note = CRISPR gRNA sequence
  source 1..20: mol_type = other DNA
gctggcggattacttgaggt

SEQ ID NO: 18020 - DNA, 20 bp, synthetic construct
  misc_feature 1..20: note = CRISPR gRNA sequence
  source 1..20: mol_type = other DNA
ctggcggattacttgaggtc

SEQ ID NO: 18021 - DNA, 20 bp, synthetic construct
  misc_feature 1..20: note = CRISPR gRNA sequence
  source 1..20: mol_type = other DNA
ggcggattacttgaggtcag

SEQ ID NO: 18022 - DNA, 20 bp, synthetic construct
  misc_feature 1..20: note = CRISPR gRNA sequence
  source 1..20: mol_type = other DNA
ttacttgaggtcaggagttc

SEQ ID NO: 18023 - DNA, 20 bp, synthetic construct
  misc_feature 1..20: note = CRISPR gRNA sequence
  source 1..20: mol_type = other DNA
tgaggtcaggagttcaagac

SEQ ID NO: 18024 - DNA, 20 bp, synthetic construct
  misc_feature 1..20: note = CRISPR gRNA sequence
  source 1..20: mol_type = other DNA
gagttcaagaccagcctgac

SEQ ID NO: 18025 - DNA, 20 bp, synthetic construct
  misc_feature 1..20: note = CRISPR gRNA sequence
  source 1..20: mol_type = other DNA
caagaccagcctgaccagca

SEQ ID NO: 18026 - DNA, 20 bp, synthetic construct
  misc_feature 1..20: note = CRISPR gRNA sequence
  source 1..20: mol_type = other DNA
ctctgcaaaaatacaaaaat

SEQ ID NO: 18027 - DNA, 20 bp, synthetic construct
  misc_feature 1..20: note = CRISPR gRNA sequence
  source 1..20: mol_type = other DNA
gcaaaaatacaaaaatgagc

SEQ ID NO: 18028 - DNA, 20 bp, synthetic construct
  misc_feature 1..20: note = CRISPR gRNA sequence
  source 1..20: mol_type = other DNA
caaaaatacaaaaatgagct

SEQ ID NO: 18029 - DNA, 20 bp, synthetic construct
  misc_feature 1..20: note = CRISPR gRNA sequence
  source 1..20: mol_type = other DNA
atacaaaaatgagctgggcg

SEQ ID NO: 18030 - DNA, 20 bp, synthetic construct
  misc_feature 1..20: note = CRISPR gRNA sequence
  source 1..20: mol_type = other DNA
caaaaatgagctgggcgtgg

SEQ ID NO: 18031 - DNA, 20 bp, synthetic construct
  misc_feature 1..20: note = CRISPR gRNA sequence
  source 1..20: mol_type = other DNA
aaatgagctgggcgtggtgg

SEQ ID NO: 18032 - DNA, 20 bp, synthetic construct
  misc_feature 1..20: note = CRISPR gRNA sequence
  source 1..20: mol_type = other DNA
aatgagctgggcgtggtggt

SEQ ID NO: 18033 - DNA, 20 bp, synthetic construct
  misc_feature 1..20: note = CRISPR gRNA sequence
  source 1..20: mol_type = other DNA
gtggtgggtgcctataatcc

SEQ ID NO: 18034 - DNA, 20 bp, synthetic construct
  misc_feature 1..20: note = CRISPR gRNA sequence
  source 1..20: mol_type = other DNA
tgcctataatcccagctact

SEQ ID NO: 18035 - DNA, 20 bp, synthetic construct
  misc_feature 1..20: note = CRISPR gRNA sequence
  source 1..20: mol_type = other DNA
gcctataatcccagctactt

SEQ ID NO: 18036 - DNA, 20 bp, synthetic construct
  misc_feature 1..20: note = CRISPR gRNA sequence
  source 1..20: mol_type = other DNA
ctataatcccagctacttgg

SEQ ID NO: 18037 - DNA, 20 bp, synthetic construct
  misc_feature 1..20: note = CRISPR gRNA sequence
  source 1..20: mol_type = other DNA
tataatcccagctacttggg

SEQ ID NO: 18038 - DNA, 20 bp, synthetic construct
  misc_feature 1..20: note = CRISPR gRNA sequence
  source 1..20: mol_type = other DNA
tcccagctacttgggaggct

SEQ ID NO: 18039 - DNA, 20 bp, synthetic construct
  misc_feature 1..20: note = CRISPR gRNA sequence
  source 1..20: mol_type = other DNA
cccagctacttgggaggctg

SEQ ID NO: 18040 - DNA, 20 bp, synthetic construct
  misc_feature 1..20: note = CRISPR gRNA sequence
  source 1..20: mol_type = other DNA
agctacttgggaggctgagg

SEQ ID NO: 18041 - DNA, 20 bp, synthetic construct
  misc_feature 1..20: note = CRISPR gRNA sequence
  source 1..20: mol_type = other DNA
gctacttgggaggctgaggc

SEQ ID NO: 18042 - DNA, 20 bp, synthetic construct
  misc_feature 1..20: note = CRISPR gRNA sequence
  source 1..20: mol_type = other DNA
gcaggaaaattgcttgaacc

SEQ ID NO: 18043 - DNA, 20 bp, synthetic construct
  misc_feature 1..20: note = CRISPR gRNA sequence
  source 1..20: mol_type = other DNA
caggaaaattgcttgaacct

SEQ ID NO: 18044 - DNA, 20 bp, synthetic construct
  misc_feature 1..20: note = CRISPR gRNA sequence
  source 1..20: mol_type = other DNA
ggaaaattgcttgaacctgg

SEQ ID NO: 18045 - DNA, 20 bp, synthetic construct
  misc_feature 1..20: note = CRISPR gRNA sequence
  source 1..20: mol_type = other DNA
gaaaattgcttgaacctggg

SEQ ID NO: 18046 - DNA, 20 bp, synthetic construct
  misc_feature 1..20: note = CRISPR gRNA sequence
  source 1..20: mol_type = other DNA
aattgcttgaacctgggagg

(The sequence listing continues in the following parts.)

What is claimed is:

1. A genetically modified beta cell comprising:
reduced cell surface expression of one or more MHC-I human leukocyte antigen molecules and/or one or more MHC-II human leukocyte antigen molecules relative to an unmodified beta cell; and
increased cell surface expression of one or more tolerogenic factors relative to an unmodified beta cell, wherein a nucleic acid encoding the one or more tolerogenic factors is inserted into at least one allele of a safe harbor locus of the genetically modified beta cell.

2. The genetically modified beta cell of claim 1, wherein the safe harbor locus comprises an AAVS1 locus.

3. The genetically modified beta cell of claim 1, wherein the one or more tolerogenic factors inhibit an immune response when the genetically modified beta cell is administered to a subject.

4. The genetically modified beta cell of claim 1, wherein the one or more tolerogenic factors comprise CD47.

5. The genetically modified beta cell of claim 1, wherein the one or more tolerogenic factors comprise HLA-C.

6. The genetically modified beta cell of claim 1, wherein the one or more tolerogenic factors comprise HLA-E.

7. The genetically modified beta cell of claim 1, wherein the one or more tolerogenic factors comprise HLA-G.

8. The genetically modified beta cell of claim 1, wherein the one or more tolerogenic factors comprise PD-L1.

9. The genetically modified beta cell of claim 1, wherein the one or more tolerogenic factors comprise CTLA-4-Ig.

10. The genetically modified beta cell of claim 1, wherein the one or more tolerogenic factors comprise C1-inhibitor.

11. The genetically modified beta cell of claim 1, wherein the one or more tolerogenic factors comprise IL-35.

12. The genetically modified beta cell of claim 1, comprising one or more indels in one or more genes encoding an MHC-I human leukocyte antigen molecule, thereby resulting in the reduced cell surface expression of the one or more MHC-I human leukocyte antigen molecules.

13. The genetically modified beta cell of claim 12, comprising one or more indels in an HLA-A gene, an HLA-B gene, an HLA-C gene, or a combination thereof in the genome of the genetically modified beta cell, thereby resulting in the reduced cell surface expression of the one or more MHC-I human leukocyte antigen molecules.

14. The genetically modified beta cell of claim 13, further comprising one or more indels in a class II major histocompatibility complex transactivator (CIITA) gene in the genome of the genetically modified beta cell, thereby resulting in the reduced cell surface expression of the one or more MHC-II human leukocyte antigen molecules.

15. The genetically modified beta cell of claim 1, comprising one or more indels in one or more genes encoding a transcriptional regulator of an MHC-I human leukocyte antigen molecule, thereby resulting in the reduced cell surface expression of the one or more MHC-I human leukocyte antigen molecules.

16. The genetically modified beta cell of claim 1, comprising one or more indels in a CIITA gene, a β2M gene, a TAPI gene, an NLRC5 gene, an RFX5 gene, an RFXAP gene, an RFXANK gene, an NFY-A gene, an NFY-B gene, an NFY-C gene, an IRF-1 gene, or a combination thereof, thereby resulting in the reduced cell surface expression of the one or more MHC-I human leukocyte antigen molecules and/or the one or more MHC-II human leukocyte antigen molecules.

17. The genetically modified beta cell of claim 16, comprising one or more indels in a class II major histocompatibility complex transactivator (CIITA) gene in the genome of the genetically modified beta cell, thereby resulting in the reduced cell surface expression of the one or more MHC-II human leukocyte antigen molecules.

18. The genetically modified beta cell of claim 17, wherein the one or more indels comprises a CIITA gene knock out.

19. The genetically modified beta cell of claim 16, comprising one or more indels in a β2M gene in the genome of the genetically modified beta cell, thereby resulting in the reduced cell surface expression of the one or more MHC-I human leukocyte antigen molecules.

20. The genetically modified beta cell of claim 19, wherein the one or more indels comprises a β2M gene knock out.

21. The genetically modified beta cell of claim 1, wherein the genetically modified beta cell is a CIITA$^{-/-}$ genetically modified beta cell.

22. The genetically modified beta cell of claim 1, wherein the genetically modified beta cell is a β2M$^{-/-}$ genetically modified beta cell.

23. The genetically modified beta cell of claim 1, wherein the genetically modified beta cell is a β2$^{-/-}$CIITA$^{-/-}$ genetically modified beta cell.

24. The genetically modified beta cell of claim 1, wherein the genetically modified beta cell is derived from a stem cell.

25. The genetically modified beta cell of claim 24, wherein the stem cell is an embryonic stem cell.

26. The genetically modified beta cell of claim 24, wherein the stem cell is an induced pluripotent stem cell.

27. A composition comprising the genetically modified beta cell of claim 1.

28. The genetically modified beta cell of claim 1, wherein cell surface expression of the one or more MHC-I human leukocyte antigen molecules and/or the one or more MHC-II human leukocyte antigen molecules is eliminated.

29. The composition of claim 27, wherein cell surface expression of the one or more MHC-I human leukocyte antigen molecules and/or the one or more MHC-II human leukocyte antigen molecules is eliminated.

30. The genetically modified beta cell of claim 1, comprising one or more indels in one or more genes encoding an MHC-II human leukocyte antigen molecule in the genome of the genetically modified beta cell, thereby resulting in the reduced cell surface expression of the one or more MHC-II human leukocyte antigen molecules.

31. The genetically modified beta cell of claim 1, comprising one or more indels in one or more genes encoding a transcriptional regulator of an MHC-II human leukocyte antigen molecule, thereby resulting in the reduced cell surface expression of the one or more MHC-II human leukocyte antigen molecules.

32. The composition of claim 27, wherein the genetically modified beta cell is a $\beta 2M^{-/-}$ genetically modified beta cell.

* * * * *

UNITED STATES PATENT AND TRADEMARK OFFICE
CERTIFICATE OF CORRECTION

PATENT NO. : 12,031,154 B2
APPLICATION NO. : 17/993674
DATED : July 9, 2024
INVENTOR(S) : Torsten B. Meissner et al.

It is certified that error appears in the above-identified patent and that said Letters Patent is hereby corrected as shown below:

In the Claims

Claim 23, Column 58, Line 58, "β2-/-CIITA-/-" should read -- β2M-/-CIITA-/- --.

Signed and Sealed this
Twenty-second Day of October, 2024

Katherine Kelly Vidal
*Director of the United States Patent and Trademark Office*